United States Patent 10,233,495 (METHODS AND COMPOSITIONS FOR SCREENING AND TREATING DEVELOPMENTAL DISORDERS) - sequence listing, part 153

SEQ ID NO: 803 - DNA, 1349122 bp, Homo sapiens
  misc_feature (90903)..(190902): n is a, c, g, or t
tgatttaaaacacaaattatttgcttatttttcacactaataacaaagaatatagacactatatatgttccaatcacattgatcatgcagaaaataaatattctttggtactggttttcctttgatcacaaatagatatgagggcaaaatgtcttatcacttatttacaaataactgatggccaaaatggataattgtcatgatagaagttattgacactggctgggtggggtggctcatgcttgtaatcctagcactttgggagaccgagaaaggtgggatcacctgaggtcaggagtttgagaccagcctggccaacatgtagaaaccctgtctctacataaaaaaaaataaaaaataaataaacactctttggttttggtggtgggcacctgtaattccagttactttgggaggctgaggcaggaaagaagttattgatacaaatatttgcaaaaataaaaagttatttgatacccacaaataattccaaagtatgtccatgtgctaatttgtaaataggaaggaagttcttattttgaaacttgcagcctggaaaatatttataaggttgttatgacattgataactggagtacttcctatatcaacttactagaattttggagactgactttaaaatataataaaaagggaaagacagggaattgaacttccttctcatgttttttacaaattttacagggagccagtctcatttatgtaatcacagatttattttacaagtttggacttgcaaaaatatgccaaaatttgaatgccttacccatttttttgggaagcagctaaaatatgtaatgcactgaccttttaatgttcactttgattggttaatggttacacctttacagctcagtcagattgtaaacaaggggacaaaactgaatatataaggtcagagaagtatagtgacaaaatttatgaacccctatacatttcctatgaataaaaaatgattaaaattcatacgtttgctttttaaatatatacataagaaacatcaaaaattaattcaaagcatatattagcaaatatattcttaattttgtcttgaataaccttctttaggtgtgcctttttctacaaagttatgtcttcattaaacatttttcaaattattagtattattatttttaactgatgcttcatattttatttcccctctgctctcccatcccacctttggtgatggttgtgcccatctgagcatttcggggcacatgaccgtaagtaaatcttgagagaggagtggaattattgtctaaacactaacagaaggggattacctgtaaggatagcataactgttgtgcaggaacagaagctgcccagatcttcttggtggagagtgcatagaaaaaagacttagaattatggaacatctgtccccccaaccaccctttcccacccatcccccaaacccccactcccaccctattccccgcccaattaatagtgttaacaaaaggttaatctaacttttttttttttttttgacggagtcttgctcagtcgcccaggctggagtgcagtggcgcgatctcagctcactgcaagctccacctcccgggttcacgccattctcctgcctcagcctcccaagtagctgagactgcaggcgcccgccacgacgcccaactaattttttgtattttttagtacagacggggtttcaccgtgttagccaggatggtctccatctcctgaccttgtgatccgcccgcctcggcctcccaaagtgctgggattacaggcgtgagccaccgcgcccggcttccagaatataaaaaatgagttccatgacgacagggccctcactgagctggcaggcccctccatggatcaccggcaccaaggcgctgtccaaatcattcatggactgcgagggaaggggctggccgctgctccctgcttgatagccagcctgatctgagtcaagtgttacacgtagtcccagtttggtcattccatcctccttcagaagcttcaggagcaaggcaaaaagccttggcaacatgctcagtcaatctactgtgatccgtaggatcactgaggcaattgtgccggtcatcgtttccttgtaatcccagcactaggatttctaggaaatcctgggaatcgttttctagaaaaaacacctctgtccatatgatgacttttccatttgctttgtattctgatccgtggaatatcttcacatttgttatagtctccatggacttcccatctataggacttagacacccttgctaacgttcttgtcatcatccacccaccggatgtgcatgcgctcctggggatcctccgcgtctgccttcccacaggtgatgctgaagtccctcgtctctagcagtgcctgcctcgaggaatccatgttctctgcagtgatctggaccataacgccatcttccacaatactggacttggcaaggtatccagaagaggatttcagagcgccaccgaacacaaaaaaactgctttgagtttgcatatagttacagtagtactgaaaaatcctcgcaatttaggtttttgttttcagttttctctgttttctagtgcataatgacttaataaatattcatttaacaaaaattgaaatctcaaaggtacatataaataaacaatataaataaccatccttattacagttaactttgtgctttaaaaaaaaaaggcatccaaagaaagacagacgtattcatgcaataaaatcttagcaatccctgcaatagtttaacagaattatcagccctcccatcttagtctggacagaatgaaaaaaaaattagttctctcgtgttattctttgagctccaactaggaaaaattactgaaaacagctggacgttacaactgttttgggcagagaagtcacactgttcaggaggaccccatggtagaaactgttttaaaaaagttctttttacttgaaattacacaagaaagcagaaaatgacattgcaaaaaggaaaaaagtataggcaggaacattgttacagaagccaggtgacaatgagaagtagagagtagaaagcaatcaacccttttgaccactgagaatgaggatagtagaaattcaatggctcatggatagcaatagtcactcacatgtcaataacagggattctgaagagtcagacttatgcatacacagagcatctctaccacatgcatgaattatgtgtgagtttggtgataatgaagagagacaaactgctgcatcaactaatatactctgggagtgaagagcaggataaaaaaaaaactgtagagaccactactctaggtcatttaagtattttaaggagaaaaaaataacataatagaagaaagtgataactatctggagtggtgggatgggtggcttctgacacagctcccatgtttctgattccacctcccgatatcttgtattatctccccttcttgagtatgagctggacctggtgccttgctggtaagagacagaattcaacaaaagtaatgcggtgttacttccttggttagctaacaaggaactatgtcttgccccttgctagccacccccaactcttgctggcattccctcttgccctctcgcttgcttgctttgataaagagagttgccatgttgtgtgatgctttgtggagagacccacgtgacaaggaaccaagggagtttacagcacaacacctggcacaaaactaaagccaacaactatgtgagtgagtctgcaaataaatcattccctgtccagccttaagatgactgcagacttttaaaagagtgagagtcagaggccacagctaatccacatgtggattcccaccaacaaaaattgaaataatgtgtgttttaaaatgctaagtttgggggtgatatgttacatataaatagataaataataaagatggtttggcatggagataatgacagaaaggaattcgactattttaatagtccaatgaagaggtatgaaagatctgaatttggatggtagcagtgtgaatgatgtaaaagataaatgtgagattctataaggtaagattttataggacctaccaataataggggtgagaggaggatagagagatgggagagagaaagggagggggaaagagagaaaaggagagggagaagtggtaaatgaacaagatttttagttcaagtcagtaggaaaaccactggcagagttgttttatttaagcattaacaattactttccgagcaactgtgatgtgtaagacattatgttatctgtactagacactgagatgaaccctcaaaatggtgatgccctcaaaatggtatagtgcaaagtagaatgttgtgaaatttttcctaatggagaaattcatccaattagcatttgaggaaaggtatatgtgagttggactttggatagtaacatacagagattagcattagaaaggaagcaaaatatttcattagacatataaagaagtcaatagtttattttcactagattgcaagcatatgaaaaagacaacaggaaaatgtgtctcaattgtcagcctaaatttaacatcttattctgtagtgaaatcacaggacaagtaaatagatgtcttgcacttaggacaaattatttaagtttgttgaagaaatgagatgattgattttatttttaagtaataagtaatgtgagaacatctgcaatcagtaagatttatgtagatccaggctcaacaaactactgccgatgggccaaatctagtctgcagctcattcatgtaaacaaagtttcactggaatatagccgtcctcattcattacgtaatgtctatggctttgacagagactgtgccacctgcaaagtcaaaaatatttactatctgtccctggacaggaaacgcttctcaatccctggtctacatcataaaatggatttgagtggagagaaagaaaaaaaactcattaaaacatatggggtgttactgccttaaacaagtagtatactaacaatagaaatggaaaggaaaagttggagtgtgcatgtgggtatgcatctgtgtgcatttgtgtgtatgtgatgaaaactgtttaaatgcagggtacaatatagaagaggaggccatcgtggtgcttagatggctctgaattgacagtctcctccgttaatatttaagtgcaattttggaggaataagtctttccactcaactcttaagtggtttaatcaactggccatatttttttcctaatggttagaaaggataagttactcagaaggaaaagtagtactgattgagaaagaattataatggaaggtggggggtgattgcatacttctaggaaagctggagggaacagctaaaaaacagtatgatactgaacacttggatgaaagcatgagtgaaagcaggtgagagcagccctaaaaggacgccagtttgcaccaaaagtaaacactggttttcatgctgcctcttgtatatatgtatcaaaagatactggtacttaatgtataaattagaatattaacttttaaaatatgaattgaacttatatggggtttaaaaaaatcaattatttaaaaacatcaccaggttccttttgttgtttaaattctctcctgatagaactaaataggggtctcttaaacagggttcaagaagcagaaacatacataatggtactcaggattcaatgcattaaagattaatattccttgaattagaagagccgaactaagtatccaaacaccagatataggtctagaatagcagatacatctaagtaggtttcaactgtctaagggcacatgcctggtgcagggacatgaacaaattgtgagtaaacagggataaaagccctatgagggatgtttaacattgaaatgtataaagtttttatttaatcacaaagttttctatattggctaaaattttataatgataatgaattattcatgtgaaaattaaaaactgttttttttgtatttttaaagaaaaaagcacaaatacacccatagaacactgtgaaatattatctttcacaatgtacaccaggccaggaaattattgggctaatttgagtcttcaacaaaattttactttgtgaagaaataagacaatgctggagggaccaaggttttcatttgcctgtgctccttctgatgccatctttactctccaggtgaaaggatgtttctgagatcaatattcctctcctttgatagttaccttcttttaaaacctactgaacactgacttactcagctccactctattcttccccgtttcctctgggtcctttgataatagatgctggtatccctgtctgtcattcactcctatatggttctcaggatttgtttgctgttcctccctctgttaacctgagccttgcgggccaaagtaaattactctcccagcaccttttatacagagtggtccatagtagttttcctgacacctatgttattacacatttctctccaagaacatctctaaagctttatgatttatacatttgagttaccttagaccaattgacctaaacacaagatatgctgtcacattttaagctgcttcctcagaatatgttggttgaaatctactgcctctcccttgtccagggtttctaaatacccgtagggtagcttctcaataatatatattactaatagctcagaatgattattatactaacaagaactttttactttcattactgtgtcagaggactcggaatatcattagcaaaacctgtttagaacagccatcttaaatccttgttgaaccaattccagcatgcttttaatttaagtaatcctggcgccgtggctcatgcctgtaatccaatcactttgggaggccgaggcaggcagatcatgaggtcaggagatccagaccttcctggccaacatggtgaaaccccatctctactaaaaatacaaaaatagttgggcatggtggcatgtgcctgtaatcccagctactcaagaggctgaggcaggtgaatctcttgaacccaggaggcagaggttgcagtgagctgagatcgcgccactgcactccagcctggtgacagagtgagaccccatctcaaaaaaaaaaaaaaaaaaaaaaaagaaatcttgagtagtacattccttcccaagatgagcatgcaaacaaagataacatgactttttattctatatgtacgtttgaaagatctctttagtcctttaaaaacttcatgagatgtataattttataaatattgagatgctttgggaaaaatattgaagaaaggccatttgattaggcataaagcacttaaagtgaatgccaagaaagttgcataggtcaaaataggtccacaaaaatgtatagattaatgaaccttccaatgtgaactgactgtttctctgagtgtcttttataattatgggtgaaggctgaggattgggcctggcccagatatggattaggggtaaaataagcagtggcacacaaaagatattttccctgaggcatattgactgaattattgtgatatatgcaagaatgaggagttattccagaagatttcaagagacagaataaaatcttcaagagtatcacagcaactgggagacaaactcattgcaaagaagagagcctgccccaaaagcatggccaactcccttgttcaacacatttctaagattttgaagctgaatagggtgaaatgctaaagggctaagcccaatacccctgaaattaaaatttaatctccaacaacattttttgagactaatgagaagtagttcctaccagctctcaatcaaaagctcaaaaggaacatacttcagaaacagagataagccaaagatgccagtcttactgaaactaaaactgaatcctgactgctccaatatctgattgtattggtaatgactttctcccaacactatctgcttaatagagaaaagtgggaatacattctaaaactactattaccagaatactttattattcttttatacacaatgtccagcatgatacaaaaaacgtctagatatgtgaagtggcaaaaattgtattaatcaaaacacatgtgcacaataagcgcagctcactgattcacagttcagaatttagcagacaaatttagaatgaccgttgctaatataataaaagtaggcaaactggatgaaatgatggagattgcagcaaagatttaaatatctataaaaagtcacacagatattctaaaacagaaacataataattgaacttatgtcactgaataggcttgctttagaataaatgtagtaaaacaagttaacctgaaaagagattcatagaaataatataaattgatctatagaaataatctcaactgaagagatttaataaagcagaacaaaaaagacataaggcactgtcacaacatctactataactaaactggacataaagacaagtgagagagaatggagaagaagcaatatcggaagagccgttggtcaaaaattttgtaaaattgataaagaatatcaacctacttgcaagaaacttaacaaaacctaaggaatataatacaaataaaactttacctatgcagattataagctgctgaaccaaaacaaaactctcaaaagtaagtaaaagagcacaaataagtattccaacaaaaacaatagaagctggagacaatgaaatggcattttaacatgctgaggggcaaatttgccagtctaaaatttaataaccagtgaaaaagcacataaaagtgaagcgcagtaaaatatattcagacaagtaattgttgagagaatgtttgcctaggagaactgaactacagaaatactaaggaaagttcttcagactaagaaaaaattatcccagagagaagcatacaattagaggaagcaatgaaattaactgaaataaaagccttaaaatattggcacaagaagttctaaagatctgagtaagttctgtatgtattatagaaactacatttatgattaacacattttacacacacacacacacacaattccaaccacatgtggattacctggtgaatccttaccaaaacttaaggaactaattgaactagtcttacacaagcattttcaggaaataatacaaaagaaagaacactttaatttttttgtgggaagccagtaatcattgatacaaaaatctgaaagatattaaagaaaagtaatttataaagaatattcaccatgaaaataaacctgagaagtaaggataaatataattaacttgtcttttacaaagtttaaatgttgaataaaatatatgacaaagagtgggagtagctaaatagtgttcaactgctctaaggtccttacattgttggagaagtggaaaaagtacgaacatacttcagaaatagtagtccacaatagttgagaataaatattatatcctctaggataactaaggtacttaaggtagtccacaatagtctagaataaatattctgtaggataactaaaagtactaaaaaggaattacaagtattttaataaaatgaaaaataaataattattctaaaaatggaaaaaaggccaggcgaagtggctcctgcctgtaatcccagcactttgggagtccgaggcgggtggatcacaaggtcaggagttccagaccagcctgaccaacatggtgaaaccccatctctactaaaaaatacaaaaattagccaggcgtggtggcgcatgcctgtaatctcagctactcaggaggctgaggcaggagaatcacttgaacccaagaggcggaggctgcagtgagctgagatggcaccactgcactccagcaggggcaacagagcgattaaaaaaaaaaaagccaaaaaaggaaataagaataaaaaaagatagtacaaatataaaaatattaaatccagaatttgaaagattaaatccagaattttaatacagaagattgtttcagaagattgtttcagaagatgtggaataactaccactcttatagactgttgtgtgaatgtgaatctgaacaaccatcttgaaaattcttttggcgagatctactgaagttaaatgtttgcataccttttgacccagcaattccactcctgggtatatatactcaagatcaatgagtacttcagtctaacaaaagatatatataagatattcaattagcattatttatagtagcccaaaattagaaacagatgaatcatccaataacacagttatatattcataaaatggaatacccctattaaaattataaagtatgaactataggtatatacaagaatctcataaattttgaaaacctaatattgaataaaatcagccatatgcaggagcatatatactgcatgatactatttttatgaagctcattaacagcctattaacattaattcattaatggaatgaatctatataaatagaggtcagtataggagttatctttttttgggttgtagttgactgagttggcaagaagaaggtttatggggtatttgtaagatttttttttttttggaggtggagtctctctctcgtcacccaggctggagtgcagtggcacaatctgggttcactgcaacctctgtctcctgggttcaagcaattcttctatctcagcctcccaagtagctgggattacaggtgcccgccaccacacccagctaatttttgcatttttagtagagacggggtttcatcaggctggccaggctggtcttgaactcctaaactcaggtgatccacccgcctcggcctcccaaagtgctggaattacaggcatgagccaccgcgcccggcctgtaagatattttttatctgagttgttccgtgtatgaagctatgtgaaaattcaatgaggtgtatacttaagatctgtacactctgttatgtgtaaattatacattaatatttaaaagaaaaataagtagattaataaagcacagtttggttttacagatacctatctatgacccaaccattctacatttaagtatatacccaacagatatgactgggaattttttacaccaaaagactttcattataatattatttttatatgcagacactcaaaacagttcaattgtccaccaacagcagaatgtaaaaatattttatggatcattgatagagtggaataaaatacagcaattaaagaactgctgctacatctgtggtgtcacaaatatgcctgcattcatagaaatttcctcaggaaaaatgaatctattgtagaggaagtcagaaaagtgttctattcggtagaagaaaattaatgaggcatgaaagaggcttctgaggtgctcttgtttatggtggtcacatgactgagtccatattgaaagattataaaaattgtacacttatgattgatgcactttttagtctataacaatgtattcatttgcaggagctactctccaaggtaccacaaaccgggtggcttaaaacaactcacatttattgtgtcacggtttgggaagctagaaggctgaaaacaagatgtagtcaaggtagtttcctccagaaggatataagggaggctgtctgtgtctcttgcatctctcccaggatctggtggtttgttggaaatcactggtgtttctgagtttacagatgtgtcagcccagtcttccatatagtgtctgcatatagtcttccctctgtgcatgttccccttgtgttcaattttcccctttttataagaacactagtaatattggattagtacccaccctaatgaccccattttaactagataacctctgtaaagactctatttctatataaggtcacattctaaagtattgggggttagggcattagcatatattttcgggaaaaacacagttcaacccatagcaacatataattccatttttaaaatcccaaaattacatctagcctaaaaaggaatgaaattgaaataaagatcgcagaggcctgcagtaagccttgatgatgtaatacctgtttataaaccaaatgttagaatggcttgaaacagaattgaacatttttgcgctataagacacataggagaaattttaagtactttttttggatgagacattagtctcaacaagactgaatgattttcttttaaggtcacacatttaaatagttaacaggagaaatagcgaccagaatcatagtcaaatacccacctaccccctttccaagacaactaaggtctcaaattgcgcccatttttctcaaattatttctagaatgtttagcaaaagaggcttttaatttggcatatctttgtctacagttttgtagtttatgtaaagaaaggtagactaagggaatttcattttaaaggtgagaatcagaatgacatttgtgaagctatgatgcctgtgccatctggcatacacgagggtgttgtactaaatgggatcagaatgagctccttttggaaggaaacctttaatagactgggaaacattaagggaatcttccctttttatttttatttaattttctttctttctttctttctttctttttttttttttttttttttgagatggagtctcgctctgtcacccaggctggagtgcagtggcgtgatctcgactcactgtaagctccgcctcctgggttcacgcctttctcctgtctcagcctcccgagtagctggggctacaggcgcccaccaccacgcccggctaattttttgtatttttagtagagatggggttttacagtgttagccaggatggtctcgatctcctgaccttgtgatccgcccgcctcagcctcccaaagtgctgggattacaagcgagagccaccatgcccggccttttatttttaatagagcattggaaaatgaattctgcatagctagctaatgaaggaaatccagagtcattgccaaaaccgagttttaaaggaatttgcaatccttcacagttcattcaaggaggcaatggaaattttgaagaagaatttttttaaaatctttcttaaaaggagcccttacattggcattgtatcacgactaaagtcttgctccctccctctctcccttctatgctttttgtttctcttttctatctttcaatgacatcagtttcatggagataaatggttaaaagataatgattacaacacatacagttgagtgacacaaatcttgttgtagtgttagaaatacatcaatacattgggatcataaagataaatggcaagaaaaaaaatctaagttaataacagaaaatgctgattcccacagtccgtgtagaaaatacacgttttttcctgtcagtggagataactgagaccagttaatattgtcaattctgttccttctgactgagccaggtgaggcaaaatttagcagatgacttgagggacaaaactatgaccttggcaacataaaaattaatactgtctacattgtttactaggaaatgcatgcaaaattaatacactcttggtagtacaggttggtttcacttctatagtgtgtagttactagaaagctgattcaacagatgatagattcaacagacgacatagaattgtctaaaatccagccgggcgcagggcctcacgcctgtactcccagcactttgggaggccgaggagggcagatcacaatgttaggagatcgagaccatcctggctaacatggtgaaaccccgtctctactaaaaatacaaaaaaattagccaggagtggtggtgggtgtctgtagccccagacactcggaaggctgaggcagaagaatggcgtgaacccgggaagcggagcttgcagtagtgagcggagatcgcgccactgcactccggcctgggcgacagtgcgagactccagctaaaaaaaaaaaaaaaaaaaagaattgcctgaaattcatcttcaattagtccatggcatgttttggaatttattcacttgtttgcctcaggaacagtagctgttcagatttgttctttgattttggaaatgaggttaccgtgctctgtagtgtcaggaagatgacgtggcataatcaggcaaacggctaggcattttctcagcagtaaattaccagtgcccttgcttgccataatacccacaaaaggcagaggcagtttcctgaggcaatccaggccacaaagaactgtacatttggggaaaacgtatcttcaaatatatatgttaaaatctaaaaaattggttagtatgtattacttttgtggatatttaaacattccctatgcataaagacctagttaaagaggtgcaggcatttggcatgttaaataactccttgatgagaaaccacactatgaataataaatatgacttaataaaaatgaaaaataatgagattagtttctattgaactattcttgcttagaatgcccctgaatttcagtcatagaaattcacttgtacctgggtaagttacaagtacttatttgtgctggtttctgtgtcattggcaattaaaattttggtaagttgaataaaagatctttctaaaaagggagttcttttttttttcttttttgagggggacggagtctcgctctgtcgcccaggctggagtgcagtggcgcgatctcggctcaccgcaaactccacctcccgggtccatgccattctcctgcctcagcctcccgagtagctgggactaccggcgcccgccaccacgcccggctaatttttttttgtatttttagtagagactgggtttcaccgtgttagccaggatggtctccatcttctgacctcgtgatccgccctcctccgccttccaacgtgctgggattacaggtgtgagccaccgcgcccggccaaaagggagttcttacactggcaatgtatcatgattaacgttttcctccctctttctctccctcccacatatgtattttcgtgtcagtatatgtatatgtgatttgtgccatttgtgtgtgtgtaggtaaatgaaagtggcatcaagaaaatctcacattaaaaaaatttgagatagtacaattcttatgcatcatatgttgcataatgtttgactattaagaaatttgcatcacacgtctacttatttcattaaacatgttacaggcaattaatttacttacaccctccatttcttttttcccactctctgggtctcctgctgcagggtcattatatgttccactcacaaaatgtccttgtttttcccttactcctgtcattgatcttctgaatctttctggtgaatttagcatggatgttttgatagaaagctctggcattaactctggagttgttttgcaaggaagattgttctctttttcaccattttttttttaggtccttgaagtgttttcacatagatatttcacaagagccatttcagaactgagaacattcggcgtgcacttttcctcttttggtcccacagtttttatgagtcctacttgaaattatgtttgctcccgtttcaattgtaatattgcacttactcattagtttttagtttgaactctcctgggaggtctaatgtagagtttggacaaagacacagattcataataaacctacccagtcaatttggtataaaggcttagaaggtggaactggccacattttgaattggaggtaagtatcaggaatggtaatggagagacatacaggattttcttatgggaacaagaaacaacctctgggcagtattagagcccagagagtgaaaagcctcttctaacttcaatattctatgtacaaatttacaagacttttttttttctttttttttgagacggagtctcactcagtatcccaggccggagtgcaatggtgcgatctcagctcactgcaagctccgcctcccgggttcacgccattctcctgcctcagcctcgcgagtagctgggactacaggcgcctgccacacccggctaatttttgtatttttagtagagactgggtttcaccgtgttagccaggatggtctccatctcctgacctcgtgagccaccgcgcccggctgagacttttaattgacagactgcattgcataagccaaaggccaacagagaggtgacctttcaaattactggcacaacaggagccgagatcagaaagctccaacttaatgcaaacatcgacaagaaatccgacagaaatgacttctgtgtctggtcaacttaacataacatgacatattgtcaagcgcattttgctttttaggtagaattgtctataacgatttaactgctttagaaaatataaatgtgaagatttgtggtattcgggtttatatataagatatttctacatttaaaagagacagagtggaaaagcttgatataagatttgtaaaatatgtttgtaataatgctaatggaagaggtgagagttgggtggggtggggtgtagatgggaacatggtttggggattggggaaagggaagtcatgctgttaataaaatagtgaggcatgttgtataaagtgtgttttatgtctcaattgaaatgttatagagagaaatttaaaatagatcatgattggttttgaatctgatttctaattttaaaatgttatgagcttttgttgctttcctatttcatacacatttctttatgggtttcacttagactgcatgaaattgcagatgccaattaccttttaataaaattaaattcacatatatgtataatttgcatgtatatattcacggaattttttattctatacgtgatatattattttaaaatggtttatcaatgacataacgtataatttttctatactttcagttttctggtttggattttttctggcaacactaattttcacctacctatactcattgatagtataaagttgtacaagtgcatatttgaccatgattacagttgaatagatgactggaggtacatctatgatgactaatactttctaaacacatatttacctctcatatatctgtgtaaatgattgtaagaggaaggggaaaatagagatgtatcattaggtatactgtcttaaagcacattcagctgctctcatgtttggagaattttgaatgtgatgaatgtttctctttcaccgctaacaggttgtgtgtgtgagccagattttattgcaagtgtttgaaagactattgcaaatatcggatattgccagacagttggtaaaaagcaaattgagtctattgagaaattaattcaccagctgaaggaagcacatttgccttacagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttttttcattctgccctcactttgttggtttctcagttttacagatgcagtgtcatgcgcagaaccctgtaaatgagcatagttcattcaagtatataaagtgctttcgtgtattattattcagtggaataaaatgaatgttaacaggcttaagtgattttcctaaaggcacacaattaatgtatggctggaattcaaaatcgggtcttttcctctgttctgattgttctataaataggggtgtagtgattgattttctacccaccatgacagggaataggttcaaaacttaaaaccctgttcattttataattaggtagactcaaatgacaggtcaaggcagggaggggagccagtcatttttattcccatatgggtttgctccttcaaagacaggattggggtagcagggtcagttcctacaggttataacgatcttaatgataaagttaactaaccataactgaatagtcataatgtgctagcacttttcataatgtatcccaaataatactcacaaaaccttccaaataaatgttacctttttgttatctttgttttattttgtttgagacagggtttcagtctgctgcccaggctttagtgcagtgatgcaatcatggttcactgcagcgtcaaactcctgggctcaagcaatcctcccacctcagcctcccaagaagctaagactacaggcatgcaccaccactcccagctccaaataaatattcttatcccattttactgatgcagaaaaacgtatggcccagagaagtaatgttaagtttattgggggatttaagttgtaaaaaattattttatcgaaccctaatgtaaactatggactctgggtgatagtgatgcgtcagtgtaggttcatcgattatagcaaatgcatcattctggtgcaggatgttgacagtgggggaagctgtgtgtgtaagggagtagggagtctaggggaactcttctactttccactcaattttgctgtgagtctaaaactactctaaaaaatgaagcttattaatcaaaaaaaattcttatattttatgaatatatgggacagctattcatgtatgtggtaaaaagagatttgttacaatactcggcaggagtgtgtctaatatgactgatattcatgtgtcacttataaaaactggcttcataatctgtagattcatttcatttgtgtatgttcgcttaagggcgcacacatggaaacactttggtgttattaaaggtctgttgggagggctcctctttggtggaagctatgtctatttcttaaaagtgatttaagagtaagatgtgaaatagcacttgcccccgaggatggagccaacagagcataggggagttatgtgatgctatctctgagagactggagagaggaatataaaaagcttattccttaaaaaagaataggggaggacttccttacctgatatctcagattatgaagctacagttctctccctgctttagggaaaaataataataacatactttttgcaaaaatcaattactgaacatattcctatattttagatttataatgaagcatttttgtacatattcattaaaaaagagtaattaaaatatttttctctggtttatagtaactaggatggcaacacagatatatcttggaagtatttcttgggatgattcttcaacataaaactattcttaaaaacttcttagaagtctccaggtactcaggaataaggtcattttaaattattccttattgaccataagaaaaataattaggcaagaccacaaaactaaatgtttagactgtttctcctgtttcctgattttcaggttatttttttatcccaattttattttgctgtatggtcatacatttcatctttgaaataaagtatataataatcacttttttttttttttttgagacagagtctcgctctgtcgcccaggctggagtgcagtggcacgatctccgctcactgcaagctccgcctcccgggttcatgccattctcctgcctcagcctccccagtagctgggactacaggcgcctgccaccatgtccggctaattttttgtattttttttttttttttttttagtagagacggggtttcaccgtgttagccaggatggcctcgatctcctgacctcgtgattttcaaagctgttcgagggcatttatcaggcttttaactctaggtactctttcccgcagtgtgacggccaagagaagggatcctgggctctcttccctggccccaggacgggaattcagggggaaaattcacctactcttatcccacaaaagaaaacttattcatcagttgtcaagctaaggagcttcagagtccataaagagggaaattgctaagagcttatcagtagtgtccaccccgcatccccacctggggtcacatggagaatgatggtgggggcaccgatcttgtcctgcttcaggtgaaaagcaggggtgtgggggggtttcattgtgaagggctcctttgttaaaattccttccaattccaggaaaaacatgcactccaaaagccattatctcttttactttgtactaggggacttccaggaaagagagagaggagaaagaagagggcaaaacaactgcagtgaatttagtcacctctccaattgcctttcttgttgcagaatatttcacattccaggaatttccttcttgacctctggactgttgatacacccaagatcttaatatgctttcaatcataggttaaagacatcaagcgccagatcgcttgggcctaggagttccagaccggcctggacagaatagtgaaacccagtcacattttttttttaagggggagatttgctcttgttgcccaggctggagtgcagtggcgaggtctcggcttgtgggacctctgcctcccgggtttggatggttctcctgccacagcctcccgagtggctgggattgtgtgagccaccatgcccaactaattccctaactgtgcaactgcaaggtcactaaacaaactcgtcacaaaacatatttttccttaaatagtaaaaaataatataatgtatgtttcaattaaataagtatctttgtttctcgcttctataatatgcttctccctgcacagatctcccccttcgccccacataatgcttgaaaggtaactcttggttcagtactcaatcctttaaatgttaatccgactgggctggtgcacctaaataattaataaatgtcctcctaaaccccatgagtctatctaattccttaaaaatccctctacaggactgcaggtgtgagccaccgcaccccgcccaatttattaatcagagaggaatagatgggcctggcttggtggcttgcgcttgtgatccaaggactttggatggcagagcactggggatcatttgagcctaggagatccagacaggcctgggcaacatggtgaaactcggtctctttttttttttttgaggcggagtttcgctcttgttgcccaggctggagtgcagtggtgcagtctcggctccccgccgcctccgcctcttgggtttgggtggttcttctgcctcaacctccctaatggctgagattgcaggtgtgagccaccatgcctaattttcttttttctttttttttttttttggtacacacagggtttctacctgttggtcaggctggtctcaaactcaggacctcaggttatccgcccgccttggcttccgggggtgctgggattgcaggcgtgagccagcacgcaaagcccaactaattaatcagaaaggaatagatcggcctggcgtggtggctcacgcttgtggtcccaggacgtcggacggccgagcgcgggggatcgatcacttgagcctaggagttccacaccggcctgggcaacatggtgaaacccggtctctcttctcttttttttttggtacagacagggtttctccatgttcatcaggctggtctcaaactcccgacctcaggttatccgcccgcctcctgggcctccgggggtgctgggattgcaggcgtgagccagcgcgcccagcccagtttattaatcagaaaggaatagatcggccttgcatggtggctcacgcttatgatcccaggaatttggacggctgagcgcggcggatcgcttgagcgtaggagttcgttctatacttgcctgggcaacatggtgaaacccggtcactttttgtttgttttgaggcggagattcgcttttgttgcccaggctggagtgcagtggtgaggtcttggctcaacgggcctccgcctcccgggtttgggtggttctcctgccacagcctcccgagtggctgggattgcacgcgtgagccaccatgcccagctcattttgttttttgttcgtttgtttttgttgttggagatggggtttctccatgttcataaggctggtctcaaactccaacctcaggttatccgcccgcctcgggcgtccggaggtgctgggattgcaggcttgagccagcgcccaaggcccaatttataaatcacaaaggaatagcgtgggggatcgcttgagcctaggagttccagacaggccggggcaacatggtgaaacccggtctttttttttttttgaggcagtttcactcttgttgcccggttggagtgcagtggcgcggtctcggctcccggcggcctccgcctattgggtttgggttgttctcctgcctcagcctccggagcggctgggattacaggcgtgagccaccatgcccggctaatttttttttttttttttttggtatagacggggtttctcccttcgtcagggtagtctcaaactcctgacctcaggttacccgcctgcttcggcctcccggggtgctgggattgcaggcgtgagccaccatgcccagctttttattttttttcttttttggtagagacgggtttctccatgttggtcaggctggtctcaaactcccgacctcaggtggtccgcccgcctccgcctcccagggtgctgggattgcaggagggagccaccgcgccgggcccaatttattaatcagaaaggaacagatgggcctggcgtggtggctcacccttgtgatcccgggacttcagatggccgagcgcggcggatcgcttgagcctaggagttccaggccggctggggcaacatggtgaaacccagtccctctttttttttttttttttttgatagggagtttcgctcttgttgcccaggctagagtgcagtggcagggtctcggctccccgcagcctcggcctcccaggtttgggtggttctcctgcctcagcctcccgagtggctgggattgcaggcatgagccaccgtgccctgctaattttgtattttgtatttttttttttttttttggtagagatggggttttctccatgttggtcaggctggcctcaatctgacctcaggttatccgaccgcctcggcctccctgggtgttaggatcgcaggcgttaaccaccacgcccagcccaatttttaatcagacaggaatagatcggcctggtgtcatggctcgcgcttgtgatcccaggactttggacggctgagcgcggtgaatcgcttgagcctaggagatccagacccgcctgggcaacatggtgaaacccgtttttgtttttgttttgttttcgaggcggagtttccctcttgttgcccaggctggagtgcagtggcgtggtctcggcttcccgggcctccgcctcccgggtttgggtgattctcctgcttcagcctcctgagtggctgggattgcaggcgtgagccaccatgcccggctacttttttattatttatttattttggttgagatggggtttctccatgttggtcaggctggtctccagctcctaacctcgggtgatccgccggcctcggccttccggggtgctgcgattgcaggcctgagtcactgcgcctggcccgaaacccagtcccttaattgaaaaacaaaacaaaaaccacaaagattagcggggcctggtgggcccggcgggtagtcccagctactctgaaggctgatgtaggaggattgcttgagccggagaggggtgggggtgaggtggcagtgagccatgttggcgctgctgcagtccaaactgggcgatagagcgggactgtgtctcaggaaaacaggaaaaaaaaaaaagaagaaaaagaaagtacataaaattgctaaatcaaggaacagcttgacagtatattattgagagaaatagaggcaaaggcgagcagacaccaatgttcacttagtggaactgcagttgtccccagacaggaggctgctacttttccaaaagaaatctattattgacaaaaaaaaaaaaaaagggggtttgttacaatatacaaatagctaaactttatatagccacgaccctcttgcagcactgctctaagccttttcctgctctgaaatagctactattgttacctccattgtagagaatacagatgccagaggttgttgtggaaggaccatggaaactgactaggaaattgacttgtaagtttaggacttaaaggttcttcctgttttgctccttacattgccacattttagttaacatacctcctaaaatactggtcctttctatatttggagggactcgtcttgcagtttgaagttttttcttgcactaagcatttggtcagaagatcatgtgcgttttatgtcagtttaagtttagacattgttcagtaaggaatgtaaatatgagcaaacagttacctgattaaatagaaaacctagaagaaaaatcacctatgagaaagtcaagaaaatgtgaactctggatttgtggctattttcagaatattaatttttttggtatttaatggcattgtgaatatatttatttttaaaaattccttgtcttctgcagatacatatacggtaattaaaaaatgatatgatgtatagattttacttcaaaataattcagaggaagaaggaatgcatataaatgaagtgggaatataaatgaaacaaaactggctgtggccaggtgtggtggctcacgcctgtaatcccagcactttgggagactgaggcaggtggatcacctgaggtcaggagttcaagaccagcctggccaacgtggtgaaacatcatctctactaaaaatacaacagttagccggatgtggtgccgggtgcctgtaatcccagctacttgggaggctgaggcaggagaatcgcttgaacctgagaggcagaatttgcagtgagccaagatcatgacactgcactccagcctgggcgaccacagcaaaatcccacctttaaaaacaaacaacaaaaaaccaacaaaaacaaaaaactgtccatgccatgaatgaaaaattgttgatgatgtgtatatgtagggcagttacattatttttctcaactttttttacatctgaaactttttaatgaacacatgcacacgtcccttgataactggggctgcttccccattactctctcaatagcccttctgattttcacttcatcttcattcttagagactctggattttttattttttttggcaagttcaagtatgtcttgatctatgcaaggactagccagcatgtctacctactcagccatattatcagaaacagaaaaagtgtccagattcttgtcttttcctgttaagattttttaaattccaagaacagtcaccttctaccagacactctgatgttggaagacaaagcatatttcgtaagtggcatgatttctgtgctcaagtttagaacaaagccacagatttcaacatctcaaaaataacttactggactcaccaaatttagaaagatggagattattttaaaaaaagaaaaccttaatttactatgtgacctctaagtatctcagctgaaaattgtaaagataggtaaatcaaaagatgcagataatcatgcacttaatgaagcgctaaatcaaagtatttttggcatatgtgagtttcattttatcacattttttactggtactatagctatttgcaagtacatatagaactacagtgttacatataaactaccaaaaagcaactttttaaaaaaattttattattcttatactttaagttttagggtagatgtgcacaaagtacaggttagttccatatgtatacatgtgccatgttggtgtgctgcacccattcacttgtcatttagcattaggtatacctcctaatgctatccctccccctccccccaccccacaacagtccccggtgtgtgatgttccccttcctgtgtctatgtgttctcattcttcaattcccacctatgagtgagaacatgcggtgtttgtttttttgtccttgcgatagtttgctgagaatgatggtttccagtttcatccatgtccctacaaaggacgtgaactcatcatttttttatggctgcatagcattcgttggtgtatatatgccaccttttcttaatccagtctatcattgttagacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggatctagacacactgacttccacagtggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgctttttggctgcataaatgtcttcttttgagaagtgtctgttcatatcctttgcccactttttgatggggttgcttgtatttttcttgtaaatttgttggagttcattgtagattctggatattagtcctttgtgagatgagtaggttgcgaaaattttctcccattttgtcaaaaaacagctttttaagaaatgagactaatctagcaactttattgagaggacgtgaagtgtttggttaggaatggtgcaattggtggtggttgtggacatgtgagatgtaagatgcctcaacttccaatgttgttcagaagcaatccagctttctgaattattcttatgaattctggatttgaaacagtaacttcccaaatggcaggggctttcagcagagaggaacctggagggaccctgtccctgacaccttctgggttgttagctccagatcaaaagaactcctgatttggaaaaagcttcttgaaaagaagaggggaggtgaccttggtgaagcctctggggacatgagctatttttagggcttttggcaggaaaagagcttttgaaaacggagataaggcatggtattaaaaaggcttacattggagaaagaaatcataaaactccatacagttagggcaatagttttgttttttactaggacagcatcagtttattggagtatttatataacataagcaaggtctcttgatattttaacaattaacaactggattttattttctactataggtgcagtttatcattctgaatccaaagccaaggaatataaacatgtatgcaaacgagcttgtcagagagtatcaacgcaatgtgtatcatctatgcttttcagttttgaacataaagcagtggctctgagcgcgactcggagggcgacgccgcggccgcagccatgggtgctgggcctgcaggggcgcgggggggagggcgacgctaggacctgcggggccgggcgggagagagggctgccgggaccggccctagacactgagccgcggtgggatccccgccggctctgcgaggccctgcgagcgccagggaggcgcctcgagggagccgggcagccgccggccacttcaggggggcccgccacttcagggcggtcgaaagagccttgggggcacatctcggggtgcggtgacccgcccggcgcatttcgggggtcggggcgcatttgccaggggacatctggagcccggccctgcttctgtcgggctccagggtacccctggatggctgcgctgtgccctcgccggcggcccgggcgccacagcggctgagttcgccgggatcgccgggccgccgccgcccttgccaccggctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgttcgaggacatggaccaggcgctcgtggacctcggcgtgctctccgaccccggctcgggcctttacgatgctgactcggagctcgacgtctttgatgggtacttggagtagggtctcgactgccgttcccctcttccctccacgatccgcaacccacgccctggaccagccgcccagatcatggcgccgcagcagctggttgggggcaccatctggacggggatggttccccaggaggagaccctcccctgcctccgaggcctgcctgctaccctcaaaagcttcgtgccaacagagaggttcctgtttggacccaggagagtggaagagagattgggactgagtgctgagattgggaaggcacctgctcccacagaagggggaacgcaaggggcgtcccaagacctcatctgcctgcagcgtcacaccgatggcctggcctcggcttctcattatttgcaactgccatggatgtttacaggaacccagccagagtttgcctccctgcacttcatcccagagcgcacctgcttcctccacttcaccttcggagaggacacttcaaactgcggacacacgcaaaagcaactcccagctctgtttgatgtgagttgagccttcaggccagctgggtttagcccgaggctggtcttagatgcagcgactgtttcagggagtgactcagaataaaaagaagctgaggaagctgttggggggctgaggatgagattctcgcttcttcatttcaggttactcgttcctcagcaagttggcaaaacagatatcatgctggtgagtgccacgttactcccctggctgcaaatgcttttctgaaagtatgagtgtcgtgcctacttaattctgataaacctgtttaagcaatacttaggaggctgacttctttggattaaaaaaatgtatgcaactccaaaaaaaaaaaaaaaaaaaagaaattcaacatttaaaagtttcatttctagggcagtcttccggtttggactacaaaattattttgcttgtttttgtaggggatcgttttgtgttgttttgtgtctttctccacatgatgcttagctctttccccacgtcccagattaaagtctgtatttttgtaattgtgggcacacaatcatatctcttttaatctttgcaacgatgttgaacttctgtagacagaaggatagagaaaacagcttgaaggcagtcagtgtgtttttccatgaagggaaaaaaataaataaaaaaattaaaatgggtgcttttttaagagagattgtcctatactttttcattctgtttttcatcacgtagtttgtatcatagcaagttcattgtcattccagagttcagctttgcccttgtactcagttgtgcttttttcccattggtttttgaggttttgctaaactgttgaatatttaatgtggggacaggaatggactcagaagaaatgttttttattttgattcttactagtcttgtaggcaaaccttccattactttttatgcaaataggatctagttgaatattgtatatcgagtaaatatgcgtctctctctgctcttttcgttgatatttacataacattaaaaagattatactttatcagagattcaagctttttcttatgaatgaagccctataaataagaatattttgttacagggattttgttcttttgaaatttataacaataaagctaaaagttctctaagctgttttatattttttcttatttttcaaagtgtgaaatttttctatcatctgaaaataaattttatgtaactatagtcttagaaatttaatacatttgaattgtatatttagcctctttaatatttccaatgaatacacttcttaaaagtttaattaggaatacagttcttagtttttgagctttctctttgttgactaaattgaaatgttaataaatcatttataaatgacttttccttctctctcttttcctctcctaatttatgctcaaggccaggtgattttatagacctttattctgtgtagtttatattacaaaataatatgttacatcttgatttagaatttacattatagtatccaaaatgtttttgtcaaatgtgtgcttttatcctcagattccggcgcccctgtgactcagagtcacttctttttaggtatggagagtattaacggggaggagaaatgattcgtttgagatttagttatctatataaaatacgaattgtcaggatatttgaaccaaactgggtcatacaatttctgtggctattttgaatagccttacaatgaattaagcttactaaattccttgtacttttcatttaatagctagatgttattgttttaatttgaataatattaagtgagccatattaccaattaacctgaatataaacacttgcttgtttttaatctgagtagtttatgtcttaaagtatggaatggaactagtggtcaatttttattaatctaagtgtctcccatacttctttaagcttttggaaagtttgggaagttgtgattttgcaatgaataatctctccccttggtttcataggcaattgaaaagctgcaggcgggtgctcttgcaactgacgcagtcactgcagcactggtggaacttgaggtatttcttttctctgttttattgaaaatacttgtgagtttatctttattgttcttaaatgacatgaaactgttgagttagtcaaccataaattatatgaccagtgttgcccaccaatattagcacagttatgaagaagcctatgatattgttgttttcattggtgacttttctgagtaatatgaaagttggttaaattccttccttttcttgatttttttttttttgtgagattcatgaatacaaaagttagtgactggatactgaagtttctcattttcagtaggaaaatccttgaagttaacccccaaaaagtgatgtatgttctgttgtttaaaaataaattccaactgtctagaagtgcctaaagtagaaggggaagattcttcacgaacctaacagttagatatataccctgaaattgtgtgctgtgaagtgtgccttgtcccagtgttatggttaggtttgtccccagtttactgtggacatcgaataattgagtggggaggctctcacgtttgccataattttttatactctagagtgaggtcctctcagttctcttgatttggacccttgatgaatttgtgcaggggatattgaggtcttcagaagattgacttgctgctcgaacttggagaagatagatttgtatctatcagttgagaggattatcgtgaaaaatatttttctggttgagaatactccttagggaatcaagtaagacatgatgacgaaacaatgatgagtttgagggaggagatgatagttaaaggcgacatttccaggttgactgggttgtggcccttgtattcaggcgctcataccagggcacgcaccctttcatgcctttccttgtgaaaattgcccaggtgtttaccaaaagtcctagccgtgttttctgtatattctcatgcttaattgtggacctgagcttttgatcatgctttgtagattttaatttctcttggtaatgtcagattggtcctaatgtagtcaaggaaggtgaaagaatatggtgagcacctagttctattgaatcttacatggggatgtgtgatgccctcctaatatgactgatacatttcatgccagctctaccagtcattagccatgtgtccatgggtgtggcacagtctgtccttgactcagtttccctatttatgaggataataattcccacttcacagagttgtgaagattaactgagttcatatatgactaatacaggacagtctcttagaacagtgtgtggtacgtagtaagcacccataactgttagcaattattacagttatgaggtgctttggaagtggtatgtatgagatgaatatttatggtaactattaatgacaagttttacagcatcaaagaaagtttaattatatgttgaggatcagaggagaaaaatgacataagaaagaagatagatgtatttaccaccaaatgttacctttactcaaaacagacacacaaagagggcttcatctaacttaactaattcaattgttagttggaaattacttgcatggaatcagcataggtttgggaaagaaggttattgagtagctggagaatatactagaatggcaaccatgaatgcaaaactgaataaaattaagtttctctttttatcttagaataactttaattttcctaagtcatacttatatatcatgtttaatatttcattctattttcccctagtgttgaatctgacttttaagggatttacttatttatacttaaaaatgataagaatacattttgaaataatgagtttctcctgagtaagtggacttatagttttggataacttgtgtttttttaagagtgtggatatgaatttaaaggaaaaaaatttcttgttctattatttttgattggaataagtcataaggataatggtagcatagaattcttccccaagtgactttagagcatcccacacctcaacttttagttattttattttatatatatatatatttttgagatggattctcactctgtagcccaagctggagtgcagtggtgcgatcttggctcactgcaacctctgcctcccaggctgaagtgattcttgtgcctcagcttcccatgtagctgggactacaggcatgcaccaccacacccagctaatttttgtatttttttttttttttagtagagatggggtttcaccatgttgaccagggtggtcttgaactcctgagctcaggtgatccacctacctcggcctcccaaagtgctgcgattacaggtgagagccactgtgcctggcctcaacttttgattattaaatttgtggaagaatttcaattatctttaacaattaacttttctatggactctttgattgaaatacatgttaatagtttaaggttaagcttacactaacaggaagaattttcctaaatcttaagaattatgttggaaatcatgcttatactgccccctgcagtttctctcaccttgaataattgtgattcattaccttaaaacaggataggttttcagatggacttcagttggggaagtattgtaatagcttgggtcaatggaaagacgtaagaagattggattctaatatttttgtacttagaaaaatataagtagcagtattgagtcctttcagaatactgaaaagtgctgagaaaaattctggagagccttattaataatgcattatgtttaatttgagaataaatacttatcttagttttggtcagtctattcagttaagtcatgtctggattattgaacagatgcaaacagtcattgttctcttctctttagactttgggatatactttttgatttaaaaaatgatgttcttgccactgagcttaaggaaacaatacataaacatatttttaaaacttgcccgttatattattacttaggcagatattaaaattgatatgaattccttaaatactaattgtggattgaaatgactgaaatgttttaatggtctttattgcctagaaagagtatctggctgtatattttaaaaatgtgataatttgtattttcccaaatagtgaaaagtatactgatcttaactccatgcagtgaaggaggaagagacaaggcaaaagaaatatgtgtgtgtgtgtgtgtgtgtgtgtgtagtagtgtgttccacacacactaaagggaattatgcagacatatcattttttagcttttcttagagactgataattttgtgtcgttttatttttctttaccaccgctacagacaagtgatgtcatcttaagactgtcacttctggacaacagaatgaggtgttttcttcatttaagtaaaggaggagcaggtgcaaaagttcctatctattaaattgaccaccttctccctttagagttttgggagggaaggtggctgcttctgtatgagaggttttctgcagtgtggaaatgcaaatgatattactccaaagtatattttgtttatcttcaaaatgtagggaaggaaatggaaaggtcagtttatagatcatattttaatgatttattggtaagttgattcattcctgttgtttcgtatagcttttttgagattatcttaataactgatgagaaagtgaattctgttcactggatggtacaactctggtttcactcacagcagagaagattaatattgtgaaagaatttggtcttcatatttgggactatacatttggatgccagttgcttttttggctgcttttgaaatagttttggatcaagtagtgacagtggatttaagattccagaccataattttgcatatttcaaatggtaaaacttctaatgtgaatttcttttttgagaaaagtggatatagaactgggtgagtcatgatgctaccattttcttaggattgtttctaaaatagaaagtgtttcatggattctgatagaaaatgaactatctataaaatactgcctgaagctccttttgcacaatggtgtttttcttaaaaagtacaaagacctggtttaaaaaagtctaatgagtaataataggtgcaatatgaatgacagacttttggaaggtaatttataatcttttgtgagaaaactgatgaatttcgcagaggttttgaagatcttgttgtaacctttgagaaattttggttaattcattctgaaaactgattattttggtaggtagaataccgtgtattaagaatagtgataggggctgggcacagtggctcacgcctgtaatcccagcactttgggaggccgaagcggacgcatcacgaggtcaggagatcaagaccagcctggccaatatggtgaaaccccatctctaataaaaatacaaaaattagctgggcatggtggcgcgttcctgtaatcccagctagttgagaggctgaggcagaagaattgcttgaactgggacccaggaggcagaggttgcagtgagctgagactgcactgagactgcaccactgcactccagcttgggctacggactgagactccgtctaaaagaaaaaaaaaaaaaagaatagtgataggaatagcttttacgttttatgtagtaaaaggcaaattatacaggttcctttgttaaaaatcttttgttgaacttctgttattaaaaatggactgtgaagttttttattcacttaattcatgctttaaagctccctatggtcaggggagatgctaattcatggttaaaactcgtttcttgtccaaatgctttagcgtttatagggcagattatattgggccaagtttttagtcattctgttaaaaacagttcgtcgtctttggatctctgtgtaatacaaatattgcttgcttgtaaactctagggaagtcctttaagaataacttgttcagatgactgatattttggtatgtaagagaaagaaagtaggtattttcattatatatttatattatatataatactgttatacatttgtctgtatctttgttgttgttgagacagattcttgctctgtcgcccaggctggagtgcagtggtatgatctcggctcactgcaatctctacctcccaggttcaaacgattttcatgcctcagcctcctgagtagttgggactacaggtgtgcgccaccacacctggctaattttttttgtgtttttagtagagacggggttttgccacgttgcccaggctggcctcaagctcctggcctcaagtgatccatctgccttggcctcccaaagtgctggggtgacaggtgtgagccaccgtgcccagccaggtctgcatttctttaaggcagggatctccagaatgggaatgttggtcacacttgagtagttcattgtgagtggaccccagcgcaggcctcttgcgcagctgcaggaataggccatattctctcccctgggctttatacttccggctggaattgtctgtgtgcctcagggggatagaagaaacttctacggcctgccagtccttgaaatgcctagtggtcatggagatggtgtggcttcctgatggcatatgggcatacctaggatggaaggggacattgggaagagctgatacatttcccttttccctcaccaaacttataacaagttttcttgtgagcagatgcttaaccacaccctgctccctaccctacttcagtcatttggtttttattgcaaaaaaggaggggcatctactttaaggtcatttctgtgatttgggaagtttaaaattatttaaataaacgagcatctcatttcctgtacgtttttatttttgtagaaattatattttcataagcagagtggtcccttgctctttccccagcaccccctgccccccagtagagctgaccacactggaacgacagcttgatgcatttagctcacatttacgtaagtgctcattaactataatgtggctggtgagtctaattttagacctaccacccttgaaaatctcatttttcttttccattgataatatcttttattctctgtaaggggagtgggatgtgtttctatgtatgtgaagtagaatatttaccttttttcttttgtagtacttacaatgttttcattgcatgaaattggagttttgaccttaggtgctcttttttcctttttttttttcttaacttggtattattgatgatttcaaagatcctattttgcctgtctgtttagcagtattcccagtggtgcttcagtatttctgtgtattccagctgtttatggagtctttatgtttctctgcattttttattttttgaggtgtacacacacagttacgcttcatggagttgcatccagccaagtatccatgttcttcttgtgaagaggcagagaaaatcacctctcccaagaatttccaccttctgaacaagggaaatgtatccttaagagctgtatgcagatgggaggcaacttgtttgcttgttctgctgctagagcattggtttaattagaagacaggctgtgggtggccatgtgcagacaaagaagcaccagacagagcccgtttagcctgggtcagtaagagtaagttacactctttttaaaacacttttttgagtactgatgctgattcttgccttcagtactaaggggcaacttgtaacttactgtttgtgtttacacatagatacatctgttctttttctgagaccctagaaatgacacatgctctctagcacaaagtacctgcgcaatggaaaagcagtgatttcttccccaaccaccctttttttttttaagaataaaaagaaaatggaatcaatgattacattctagattaattttacactgtagcaaacccggtgttagcgtttgaccaagtcaaaacacttaagtatagagcttgtcatgcttttactttgtagtaatgggaacatgagaaacgattttagccttttccagccatttcttgataaggtatgtgggtctcatcagatacattcatccaggccgaacctagtagaagagagggtccaagatcagacctagcagttcctgaggagcatggaactctatatgtgtgcccttgtttttctctgggagttgttactctcaaaaatatacttcattttggaattcagttttgagctacctaaagccacatatggtagtgtggtggagttagtggaaatcctgtgtttttgactatgtgaaagcaatttagacttttggatttttgagtgtacaatgtcttctagtcctatattaatagggatattacacaaaagggatttaattagattcattggtcctaggatttatagtgttgtgatttttgaatctgtgtgtgtgtgtgtgtgtatttgtgtttgtttggatctgtatcatttgtggcatcaggtttataccttagcatctactgttttggtttgttttgctcttggtaatgaaggaagtaggctaaaaagatttttctatgtttggaaaatcacaggctggtatgatggtgtttaatttcaaagactaccttttgattttaagtttttttccatctctcaaacccacccctttattcagaatctggaaaagaatgaggaagaaacttaagttacataatttttaagattctcggcctggcacggtggctcacacctgtaatcccagcactttgggaggctgagacgggcagatcatgaggtcaggagatcgagaccatcctggctaacacggtgaaaccccgtctctactaaaaatacaaaaaattagccaggtgtggtggtgggtgcctgtagtcccagctacttgggaggctgaggcaggagaatggcatgaacccaggaagtggagcttgcagtgagccgagatcgcgccactgcattccagcctgggcgacagagcaagactccgtctcaaaacaaaacaaacaaaaaaccagattctcatcaagattctaaatcttgctcttctctctttctttctctttcatgtgttcattacctaagtgttagaataatgaaggattgtacctcactatagaaatcagcttaaagttgaatcttagacataccaattgacaaaagttctttggccattcccattgccaggcagtttttactggcagtcattctcactcagggtccagcctcctgcatggtgtacacatttcctgacagctcatgacacgcatgtactgtaacacaggacatcaacactataacacattcatagtggggaatttatttatgtttagtttttctggagtatgtgcaaatgtaagcatattttctagtgggttggaagtctttttattaaaaaaaccttagtagaggacttaaaagttactagtatccctctttcctctccagttctgaccatgtcatttgataaaaggatggtttaaattattataattccatggtctgttaggttcttcttgagtgatatttccatattattgtcaatatggttaaaaggtataattatttaggttgaagggaagtataagtagatgtatacagcagatggtagcctctagctgagatcccaaggagaatatcctgttactgggaaagggtgattatgtgtttatttagcaaacacaaagtgtttaccatgtgccaggtactctttaagcactttacaaatattggctcattagttttcacaagtgccctgagatgggtactgttgttagccctgtttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctattgcccaggctgcagtgcagtggtgcaatctcggctcactgcaacctccgcctcctgggttcagacgattcttctgtctcagcctccccagtagctgggactacaggctcctaccattacactggctaatttttgtatttttagtagagatggggtttctccaagttggccagactggtcttgaactcatgacctcaggtgaggcacctgcctcagcctcccaaagtgctgggattacaggccttagccactgctcccggcccctcattcagtttaatcaacaaatgaacagcgtcactaaagatccctcaaactcagtgatgaacacatctgaaaaagttaaagaaaattaagttcaaagaagaaacttttcattgtcaccattgtcggtgaatgtagtgatctaaaaattctctttatcattgtgctttaaatagtgatttagttttgatctttaaatgtcaatagactattgatattttgatctttaaatatcaaatatgtatggactatgtgaatattgaaaagaaaatatgaacagtcacttttacagttcgggtttttgtcttaaaattttgttgtaatttctcttcctaatcttagatctgtttgaggagatggtgcctgtgtcagtgtggcagtctttggctgcctgtgatcagaggaaagccgatttgttaacagatcaattgctcagatgagagaagccaccactttggcaaatgggtaggtagagcttaattttagagcctaaagttttccgtttggttgttctttagtttgtgaacattttagtttctgagcttagagctaaatgtcaagagtatataaaatagaaaatgtagacacacacaactatttttggtggacactgtatttgtgaagctctagcaaatatagttggaagaaattatagaaacaaggtgaggatgtttgactaaaaatttgtattttaagagatatttatttgggggaaatgagaagtagaaatgaactcagatacatggtacgtttagtgttctgaaccaatttttgtttctgatggattggatactaagaaaataattcattggtttaaaaaatttttaggtatattttgcacacacaaaatacacctattctaagtacacagttcaattattattatatgtatatatatgtttatgtgtgtgtatatatatatttttttgtttgttttgttttgttttttgggacagggtcttattgtcaccaggctggagtgcagtggtgtaaacattaaacatggctcactgcaatctcaaccttctgggctcaggtgatcctcctgcctcagcctcctgtgtagctgaggccacaggtgcaagccaccgcacctggctaattttttcatttttttatagagacgagatctcgctttgttgcccaggctggtcttgaactcctgggctcctggtcttgaactcctgggctcaagtgatcctcttgccttgacctcccaaagtgctgggattacaggcatgagccaccatgcctggctatttagttagttttgataaatgtatgtacccatgtaaccggcactatgattaagatagagaacattactgttaccctaaaaaaattctctcatgcccctttcccagtccttcttctcctggcccctggccactattgatctgctccctgtcttaagtttagttttactttttatacaatttaaaatacatgtaatcattctagcatatacatatacagtacttacagtatgtacagtatatacttagaatgtgttttgctttttttcacttagttactgtttttgagattcatctatattatgtgtatcagtttgagtcttttctgtggctgagcagtattccattttatggttatggagtagtattccattttatggttatagagcagtttgttaactctttcacctgttaatggacatttcagtttctatgaacattcgtgtataaagcttcatgtggacatattttagttctcttgggtaaatacttaggagtggaattgttaggttgtgtggttagcatatttaattttacatgaaattgccaggttgttttccaaagtggttgttccattttatatcctatctgcactgtttgagaaatacagttgttctgcatcctcaccaatacttggtaccgtcagtctttttagttttagctgctttcgtgtgtgtgtagcagaatctcactgtgatttaatttgcattctcctaattactaatgatactgaacagcttttcatgtgcttactagccattcatatcttttctgtaaagtgtctattgaaatctttttctcagtttttaaaactgagttttcttaatatttaaagagttctttacctattttggaggcaagtcctttgtcagatacatacgattgagaatatagttgaccctgaacaacataggggttatgggtgctgacccccctgcacagccaaatctgcatataacttctgagtccccaaaacttaactactaatagcctgctgttgaccagaagccttactgataacataaacagtcaattaacacatattttgtatatgtattgtatagtatattcttataataaataagctagagaaaaaatgctattaagaaaatcataaggaagagaaaatatatttactatgattaaatggaagtggatcatcataaaggtcttcgtccttgtctatttcatgtttgagtaggctgaagaagaggaggaaggagggttggtcttgctgtcttagaggtggcaaaggtgaaagaggtgaaagtccacatatacatggactcacgtagttcaaatctgtgttgttcaggggccagctgtatttctctcgtggttggcttgccttttcatgtttttagttttgattaatgcatggattttaccatcatttttcttgaacaagaaaggaatgtaagtttactctagcatatgataaacaggcagtctgagattttacagagcttcttttctgaggagttcattgtattccatcatttcatttgccttttttctttacatagtaggtagggatatgtacctcccttccccatcatgtaaatgaaataactgaggaatcgttagtgtgctacaaaaccgagagcagatgaagattctgtaatgaagacttagatcatctatcttctgttgacattttgcctagatgatgtgaaattataattattgattctgttgaaagagagcaaaaaagaaaaaaatacctattttgtgtattgtttctgactcgttagagatgctgtaacaatcaaaagtataaaagactgcttttttaggatagaatttttgacttttaattacttagactgaaacaagtttgaactgtaagccaacgatacctaatatattttaatgcggtcataatttttcggcttttttttttttgtttttccagactgagtcttactctgtcgcccaggctggagtgcagtggtgagatctcagctcactgcaaccttcgtctcctggcttcaggtgattcttgtgcctcagcctcccaagtagctgggattataggtgctcaccactacgcctgactaatttttgtatttttagtagagatggggtttcaccgtgttggccaggctggccttgaattcctgacctcaggtgatccgcctgccttggcctcccaagtgctgggattacaggtgtgagccactgcaccagcctattttttggcttttaattctgaattgtgaacttaattttttaatgattttggtttaattgtatcaatcactgatttttttgtttttctgttaatctttgctttgtttttcattgatagggcttatccagtttttctgggtgctaactccattgctgttgatttggttatagaagattaaattaaataaagtaaatattgatgagttaaattgttttagacttcaatataacatagtatctcattttttcagagtgctagcttcccttaatcttccagcagcaattgaagatgtgtctggagacactgtacctcagtctatattgactaaatcaagatctgtgattgaacagggaggcatccagactgttgatcagttgactaaagaactgcctgaattactgcaatgaaatagagaaatcctagatgaggtatgttttataagatttgcttttcaagtataaacactgtgatcccttgatgtccagcagggattgggactggagacttcctcatgctagtgctcacagtgtagttagtattcatcactttggtgaatttactgtggcccagagccgcctctttagcataagagtaattctggttgagtgagaatgggtttcattcttatcttaagggtaagtaagtacacattaatgaaactcaaatgaccactgtgtaaaactagtatactatgagaaatcaactatcatatgaaccgttcagtctttgtaattattgatttattttatacatagcgtgtagcaagatttttctttttaatttaatttgtcttaacctggaaggttaaaccctttaatttatccctaatttcttgaaatatattaagtatatttattttatattatttatcttataattccaatgtctgtggtttctgtgggtttgattctatgatttgtaatttttgctgattcttgcttatggtggcttgttttctcttgtgttcagtttttttgttactgttttttaaaactttaaaaaatagtttcagatttacagagactttgcaaatttagtgtggaaagttcctgtatatttttcacctagcttccctgaaagttaaaatcttacgcggtcgtggcacattgttaaaactaggaaattgacattggtacagtattattactcagattttaccagttattccaccaacgttcctccttctgttccaagatccagtacagaatactgaattgcatttagtgttcagtgagttttgattgtgcattcatatttcctgtaatttatttgtgggaattcattgagatctgggtttaaggtgaattctagaaagaatttgtgtttgcttctgccataaaaaggcattatatacctggcacctcctcaaacttaagaggctttttcctttcttttataatcttttaattatagtagtaatttatcttaggactttgtgtcacacaaatagtgtggtttctagtcccaaattcaggcttttgatcaggaatctcagataatacttctttttttttttcttttttctttagagccaaggtccagacaggcatgttttcttctgtagggccgttttctgttttaaaaattcatccactgagaatcatctatttggaagtataccagtttgagtgtggagagtgcttttgatctgacctctcaccttttattgtccctacctatgtttcttgttgacttttcatgttctaaattcacaatgcaagtcaatggtgaactacacagctggtgaactatggatggtgggctagtgctggcttgtggcctacttttgtgtggttcactagttaaggataatttttatcttttttagagcattgtcaaaaaagaagaattctatgtgccatagactgtggcccacaaagcctaaaatatttactctgtggtgtttgacagaagtttgctattctttgtcctaagctatcagggattgtcatgtattgttggtgctagcactgtgtctactggtagattagtattttcttgtgtttctggccccctactatcctgtcatcttatctacacattaaaaggcatttaaaaatatattaaacataattttctgttcgttgtattggaatgaaattctaaatcttttattttttaatgtaattgatcagtttttcccctttgtttatggcttctatttatctattttaatcttaaaactttctttaaattgatacatggatgtaaatagtctcatgtattcttcctttttttttttactgagaaaggtgatagctaattcagccttaaatttataagactttttgttaaatgcattataacttagatgtctgcaagaaaaaagtcgatttatattctaacctagtattcccatctcaccaaattctcccttatattgtgtatgaacatttaataattgcattaaattttttaatccagaaatgacatttcagggttctttttgcttccttttaaagtcattaaggtttttggatgaagaagaagcaaccgataatgatttatgagcaaaatttaaggaacgctggcaaaggacatcatccaatgaactgtataagcctttaaaagcaggtaaaaatgtgtataaatgaccttcatttgaataaattcccaatttggacccacatttttacttgattaaattaggctcagttgtaaattcgtttttaccgaaattgtttttcctcagttttagtataaagattaaaaaagttcacaaaagtaatctgccaattgtcagaagtacagattcttaagaacagtataaagggaaaagttaaaatggtcctccaactttcattttctgttccaagctctgtgcatattttattttatttattttttttttgagacaaggtctcgctctgtcacttaggctggagtgcagtggcaggatcacagctcgctgcagccccaacctccagggctcagtcaatgcttctacctcagcctcctgagtagctgacaccgtagacatgtgctaccacgcctggctaatttttgtattttttgcagagacgaggttttaccgtgttgccctggctcgtcttgaactcctgggctcaagtgatccacctgcctccacttcccaaagtgatgagattacaggcttgaatcaccatgcctggcccctgcgcatattttaaaaacataaatgagagcatattatatttatggctttgtaatttttttttcatttagtagtgaatcctgggtggtaaaacgaaaatgagctttaagttattttgaggccaaatttatgcttcttaagactttgattatgaagattttgtgcttgctgagataaatgctgtcttcatggtggctggagattagttttatttatctttgtaaaaagtttgtatattattgagatttttctaaaaatctttttttttttaagtcacattgctcttttgagagaggaatacttttaaaataaatggaccaatttttggagagaatgatttcttcctacattcatgagttgtaggaaaagattaatattaattagcttttatttggcagatagtaaccaccaaatgtattttaaggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagagggaaccagcttcagaacagttttagataaagctgtgcaagcagatggacacgtgaaagaatgttacccgtctcatcgtgaccccatcgtgcttttgtgtaagccagagcctgagctgaatgctgccatcccttctgctaatccagcaaagaccatgcagggcagtgaggtgagaagggcactttgatgtgggttgtcatctgcttaagaaaaccacattcaagccattttatataatgcactgccaattccttattgtcatctttaaaaaaatgcagaaataaattggggttgttatatttaaagtagtatatagactgtgtaataggaaattatactaatattaactatcctgtaatagtcacttccatttattgaatgcccttttttgaactaaattttagatacttcataggtcaacagtatttaatttgggttttataaaagagagaagcttggaagtatagaaatttcctgaaatgaaaggactgggtatggccagatacacaaattctttatttcttccattgttctctactcccttccaccttgtttccccgggactacctttgaaaggaagattggcaaggtgtgcgtgttaataaatggatagctccgtcatggtgtttctactgatgacaggaaagagaaaattgaatagtagggcatctgatttggaaagtcctaagagaaagtgcaactataatttaatggcctatcatggggaggtagggtaagttagtaggaaaagatagaggtcccaaatctctgcacaggaaaacaagccaaagggcaagaaatactgctgaaaacttcttgaaaaaagtgaatttcctgggatagtaagttctgaaaagtatgagttttgtttcttatttgtctttccacagatgcattttatatgtttcatatatgtattccaagacctactggatatctgctctgtgtaaggcactatggtaggtacattggaaaattaacatacaaattatacacaggctttaccctcaatttatgatccattgtggaatattagtcatgtacaaggatgactgtaatatagggaagaagtttaaaaatgtcacagggaaagtatagaagtatgttatgaggatttagatgaagtacttaaatttcagtaatttggagtagttctcttcagaggcttcttaagagattggcacattatgaggacagagtggataggcagaaaaagtaaacgtgtaggatcggagaagggctgagtagtggctgtgtctagagagttatccgaggcacagaggatctgcaaacacagcttttactcctgatttctcatgacagaaggtttacagacatgttgagaatggctggaatctgcttgtttatttatttattcaccaagtgtttgaaggcctgctattccagagcagtgctgagcaccttggtccctaacataaagagacaaaaaactgctctgggttacctttagtgtagggtaaatgcacaggtaccgggcacctctcaaagggaagagaaggctacgtagttgaatgtgcattgaacctgaatctaacgggggaacccagtggaacagggaatgtgagttgttgctttgaggacatagcggagaaaagggaggtggtcagaagattaacttgtgagcaacaaagaacccgaagaagaaactgtagacccttggaagagcaatacattctggtaccttttttattttagaaaaagatctctgtttagtactctctttgtattctttttggtgtcttgtacgtgactcagaattatgtggcttttgccctttgattcttctgctttcagtagaaaagtaaaaatggtttgtgctaagcaaaatctgcattagtatgcactgatttgttgatattttattcagttgtatcagttttattaatccttacttgtgttacacaggagaaaggaacttttatagtcaatatgaagtaattttttggaagctagagttcttgatggggtaaccacaaaatttcagtactctctatatattcgtttgtcgtgtgccttaatcaaataaggcaagcatcaggtttatcagagctatttcagatggttgtcataatagttgatgacgcattttagccagaatttttatgataaaaactcagttttttgattgctgattagagtgatgcaatgtatatgttttattaaaaagtccaagtttgatggtagggctgttttttcttttattgtgaagtagcctactttctagttacttattttcagtctctttgggcatctggttttagatattgagatactctgaaaaattttgcagactagtggtcatttgtatttcaagatttttgtattaaatacctaggatcactgcttgtgattggttgcctatgatctactgtggcctgaagtctggtctgtggttggctggccaagccttggccctaatgtatatggggctgagtctagccaggggaaggaacatctatttttttgcacaaggatgatgttcaattttactcaaagtgttacatctgctggaagtaacggagggggtacctttaaaaaaaaaaaaaaaccctttatctccttagaggtagagcataaagagaactgtttaaaactgtgtgccctcccagaggagtgccttttttggattcacagactagtggaggatctgcaaacacagcttttactcctgatttctcatgacagaaagtttatagacatgttgagaatggctggaatctgtttatttatttactcaccaagtgttttttgaaggcctgctattccagaactgtgctgagtaccttggtccctaacatagagagacaaaaaactcctctaggttacctttagtgtagggtaaatgtatcaagtttctgctttcgttggtgtagacatagttgcttatttgccttttctgaaaataaaatgacaaggttataaaagtaaaatagaagatttcattgagggcatttctttctttctttttttttttggccgtggggggacggagtcttgctctgtcacccaggctggagtgcagtggtgcaatcttggctcactgcaacctctgcctcctgggttcaagcaattctcctgcctcagcctcccgagtagctgggactgtaggcatgcgctactatgcccagctaattttcgtatatttagtagagacagggtttcaccatgttggccagggtggtctcgatctcttgacctcgtgatccacttgccttggcctcccaaagtgctgggattacaggcatgagccaccgcgcccggcccattgagggcatttcttacggcttatattgtacttggtgctgttaaatgccacagagggttttaaatctaaaactcgggtcaggaacctgtggcttgtgggccgaatcctctgcctcttctctttgtatggcctgggagctaaaaatgagttttacattttttaaatataaaactctactttctacttcattttttaaatggctaaaaaaaagtcaaacgaatgttttaatatgtgggcattatataaaattcagatttcagtgttaatacatttttgttgaaacatagctgcgctcattcatttacacattgtctttcatactacaaagcagagttaaagagttggaacagagactgtggcctactgaggcaaaaatattttctgtttggtcctttaccaaaaaagtttgtaagttcctgatctgaaagacaaagtattgacagcctaggtgatgccgttcctgccattctgtttgacctcatctcctgttctgccttttgtttactatgcttcagccagagtggcctttttttctttcctttgatcctgccaagcttgtgcctgccacaggactgttatatttgcgtttccttctgtgcagggctttcttcccatttccatggctattacctctttttcattagtctcagatgtcacctcttctccatctttgtcattgtctacccacattattctatttttgtgtatttgtttaatcctcccctttccatatttatttaatcctctctggtccccaaatgaaggaaaagactgtttttgttagtagtcgtgtccatggcatctagaatggtcccaaaacaaaaagcatttgtttgaatggtcatcgctggcagccttaacttaataaagggatacatttaattgcagttgaaaggtagctggagctgtgtataagaaataaatatgctaggattctaattatttatatactttgataacatgttaaacctcaaatttgaatttagaagaaaatttaggcagtggttttcttattatcgtggtcattcatttgtggaagcagtttaattcattttctacttcatttactctgttaaaatgaggcgagtgtcatataatctgaaatatgttaaactagtgcactgcatatgaatttttttaaaagatgttcgtaatataagggatctctatctttgtgtggtagtccacaagtttgttcataaattcgttgtttgaaatggcatttttttccccagaaagttagaattattgcatttttgaatatcacaggatttgttaactatttggccctctgtatcagtctggttagaaagcttctgtatcagtctggttggataccatggaagttgcggtaagcttttcttcctaatctaggtaatatgactgaatacttaccctttgttagaagttatgttgagcactttatatagattatctcagtcttcacaacagtcctgaaataggtactattatgcccattttgcagctgcgaaaattgagttttctaagtagtaacctgtccttgattgcacagtcactaagcccattatggtctctaagggagtatagtcagagttgaagtgtttttaattttctatgtaattacgttttttttgtgtaattacgtttcactttgatagaccattagttcatttgtttccatattcaagttttgacttaatcttgttttctgagtgtgtaaaaaatgttcatgattcaaaaggtacatgcagagtaagcctcattccttttccttctacttctttcctgtatacttcctgtaagtaatcatatccgttagtttctggtttgtccttactgattttctttttggaagaacaacaacaaacaaaaaacccaacctcccccaaaattatgcatacatatgtatacatatgtacatattatgtatgtgtatatttattttctgattttccttctgtcttactcaaaatgcagcacactatatatgcttttgtaccctttttttctcatttaataatatgtcctggaagtcacttggaaggaaacttttattcacatcgtctgatatcaagttctactaggtctttaaacagactttgtcatatccacccacgtatgattctttctcctcctccttccttttagagtttctgtggtttgatgctttctagactctaggaatcatatttctttccctttccacagccttctcccctgtaccctcttctttctctccctccctctctccttcccttcccccttccttcctctcttgtccccctcccccttctcttcctttcctttccttccattttaaaattaggatgtttagaagatatagatgtaaatgaggccaaaaaggaaattcgcctacatttagcagaaacctcgagtctctggtcttcacaaagggatgttactttggacgttcctatcaaggagttaactaagactgtggaagaaagagtagggtaggaatttttagaaacaggcagttggtagggggatcatgggaactggacttgctgctggtaatgagaaagacaggggtggagacagggctcatgatgtcctcttcttccctttgtctttccccctgttttctttctatgagcatcattggggcaagcagaatagggagattgggttgatgttcttggtggtcctagcaaagtatgaagagatgagtgaaaggggcagcttgaaagtgctcattagaaggcacttgaacactatgaatataaaggggtatttatgaatcaggtgggtataagtcagagagtgtcttgactgaatacaagagataaatctctgttttgtttttgtattttgttttgagacagggtttctctctgtcacccaggctggagtgcagtggcatgatcatggctcactgcagccttgaccccctgggctgaagcaatcctcctgcctcagcctctggagtagctgtgactgcaggtacacaccattgcacccaactaatttttttttaatgtagaaatgggggtctcactttgttgcctaggctggtctcgaactcctaggctcaggtgatcctcctaaagtgctgggattgcaggtatgaacctctacatctggcctaaaactcttaatgctatgaagagaggcacaagaaccctctttccttttcctctcccggtgtataaaataaatgtggtatatacctttatatctgtgtctttctctatttctttctccatctaccatgcttgcttcataactatctctatttctatcttcacctctatttctctatatctctgtctgtcagtctctctaggcaaaataggatatctacttacgtagcaaaatcataccttcccctgcttcacagccatgattgggagggagtagagtgtagagtggctaagagattggttttggaactagtcagacttaggtctcaaatttcacctctgccccttagtaactgtataaccatgtcacttaatttttttgagactcgttatccctatctttggaagagaggtcataaatatatataccccatggggtattgtaaggaatacataaaattatatttctgaagtgtttagcatggtgcctaacacataggagttcagtaaattgtagctgttggctactgttattaatgctgcttttgttttaatatgagtcaactgaaggtacagtgtctatctacataaacctgatgttcaatttatatttggctctctgagaactcatctctctctcagcccaaatgaacctttatatattatttccttcttgaaattggctttttttttcagttaaactaaagtgtcttttttattgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggcatgataaatgaagaagctctttctgttactgaactagatcgagtctatggaggtcttacaactaaagtccaagaatctctaaagaaacaggagggacttcttaaaaatattcaggtgaaatttatgtatttaataacatctatgttttaaaaattacagaaaagatatgtctggactaaacctatattcaattagaaaaatgacattggagaatatctgtagttgagagtagaacttaatacatatatattttgtaaaattaaacttggcatatcagttttatttgtgtctatgaaaccaagtcactccttgtttttttttttttttttttttttttgagatggagtctcgttctgtcgcccaggctggagtgcagtggtgcgatcttggctcactgcaagctccgcctcccgggttcacaccattctcccgcctcagccgcccgagtagctgggactacaggcgcccgccaccacgccctgctaattttttgtatttttagtagagacgggatttcaccgtgttagccaggatggtctccatctcctgacctcctgatcctccctccttggcctcccaaagtgctgggattacagacgtgagccaccacgcccggcagaaacaaagtcatttctatggctaaaatgttgcatattacttaggagtgcttgatacttctgatatttttcatggtttcaagtttttaatagctttgttttttttttccatacgggaggaaaatcgaaattagttggaattactgatacctttaattatacggctaacatacatacagacttcagtcattttttaaaaaaataatgcaaactaaatatgttgagaagtttgaagttagttttcgtgtttacagataggtagtttggactaacaaagacttgaaagtttgcccttttcatagttaatgtgcaaaattaaacatatatttctactcctaaacattgtatctatatatgatataaaatattccaaaaggtaaaataattttcatgttatattttttgcaagtgttatatactaatagaaatctgtgatcattattggttgttttgacttctattggatttttgaaatttttacttaagaaagatttaaagcataatgaggcttcaaaagagtatactaggtatttctagtaattttgcatatgtatttaattacatatgattttcataattggaaaagatcaataaaaatgttatgagccatattttataagtaaatgtaaatacataaatctttcttttaacaaggtctcacatcaggaattttcgaaaatgaagcaatctaataatgaagctaacttaagagaagaagttttgaagaatttagctactgcatgtgacaactttgttgaacttgtagctaattcgaaggaaggcacaaaggtatgaagtacatgcaaaaggaaccatagctagcaagtacagatgtgaacgtataggttggaagttaaatggtatttccagttgaaccaaattactctttgcctggaatgttagctttaatgccattgcctctgcgaagtttgttacaggagggagaaagcttaatgaaggtggcaacatttcatgggaaccttgaagaatgaattgcatatttcaactggcagaaaaggggtacaaatattccaggtagcaggaattagcagagatgtcaatgacacctttttaagggataggaagttgattaatttgatgaattttgaggggacaggagtagtcaaagctgatttgtgatggaaaagctgggcgggcatgacttttatattctgtgtggtggtttgctgaggacagacttgtggcctgcccaagtgtcagaaggcttgctgaatatgtaagtactttcttgccttgtcctttaaaaagtttagggaattcacttatatttgtttttaccaatttgtttttgagggaacagtgatttttaagttttctcagatgcataattccttttggtacttaacttcataataatcactgaataaagttaccttgatataaatacagtagctaaaatgtaaaaccctctgaagagagggtgaaaatactgcaaagccttccaaatagagaggatggtaaaatgccattttaacttggtttaaaatgctttgtttaaataggtaagctgagaaaaccctccagagagcctttagaaattcttttaagggtttctgaagtatgcttgcatttctttttttttttttttttatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccggtgtgtgatgttccctttcctgtgtccatgtattctcattgttcaattcccacctatgagtgagaacgtgcagtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatatgagtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacttgttgtttcctgactttttaatgatcgccgttctaactggtgtgagatggtatctcactgtggttttgatttgcatttctttgatggccagtgatgatgagcattttttcatgtgtttttggctgcataaatgtcttcttttgagaagtgtctgttcatatcctttgcccactttttgatggggagtatgcttgcatttctgtagtgaatttgaaaacctaatccttccacttaaataggtttcatgttattaaacaattgacttttctctaggaattaggaagattttcatgatcatgaaacttttaacttgttacatttttgatgataatgttctataaaaatgattttattatttttattttctttaggagtcttagatcatatttaatattaagttgttgggcctagtaaattgtatggatgtatctcatgcagatctcagttcttcggctttaactgtcattgacaaattagctttagatcacattactctctggattaaaaaattgttcttgttcattacttgtatttgttctttgcttatagttttacaatgagttgactgaaatcctggtcaggttccagaacaaatgcagcgatatagttttggcatggaagacagaaagagatgaactcttaaagtaagtctgttttgtgtatcaaattgtacttaagaattttcttttaaaaaatcatgtggagacttttggtgtgaacttggtagtatgagagcagtttccctccttttctcatggaagaaggaactagatagagtattttacaaagcaacaagtaaacagctgcacagtctgggaatgaaaggatgaaaagaagcagaaactctagatgcaggaagtacagtgaggtcacagaaatgataaaacagttcaggtggcagatctcaggaagtgccagtaaatacaagcaatttattttgaagtggcaaataggttccttacataaaactagagctatagaacatggaggagacgccgtgaatagctcagagaataccagcaaaatcactttcagaggaggctgctgagaaagcagggccagttaacatacgactcatttcctgctgagtaatcaacacggagtagcacagcgctgataaaaggtgaaaaacattaacaaaatttaataaaacttcatagatgaagaatatttaccaaaataatattgtcacagaataggtgaaaattatgagcaaacgtctgaccatgaactaaacaaaaagaacaacaacaacaaatgtaagaaggcagtcattctaaggccggggtccccagtcctggggccatggactggtactggttcgtggcctgttaggaactgggctgcacagcaggaggtgggtggcagacaggccggcggctgggcgagtattactgcctgagccccacctcctgtcaggtcagcctcagcattagattctcataggagcgcaaaccctattgtgaactgcccgtgtaagggatctaggttgtgcgttgcttaggagactctgactaatgcctgatgatctgaggtggaacagtttcatcctgaaatcatcttccgctcccctgtggaaaaattgtcttgcatgagaccggtccctgatgccataaaggtttggggactgctcctctaaggaacacttggagcagaaattccagaactgcaggaatatggtaagaaaacaggaagtggtaagatgtgaggtgtcagaattcaggaaagaagtagaagggaagaatcaaaccacgacatgggaaagagcacaaagggcgagtaaacactgaagaacacacaggaacacagagtagaaatgaggaaattaaaatgaaaccaaagtcaagaaagaatgagaaaggattagagagaagatgggcacagaagatctaatatgggcaaaactgaatttctctcaaagaagaaaaaccagacagaacagttatttaactttctgtaaacagagcacttatttcatgatactcaagaacattttcttaaaacaagtgaaggttgttgaaagaggatatcacatggtaggggaaattgatcaagaactgtcagcatcaaggcatataaattattggccttaaaaggtaatggcagaatcctttaggcagtcaggcaaaacaatcaaaccagtatataaaaaggtgaaaaaaattaggctggcagctctgtatgccagaagagagtggagtgattgctgtaatctcaaggatagtaaatatgagctaaagattttatatcatatagtaaatacatgctaaagattttatatccaaactgtccttcgggtgcataaaaagccatatattcattagtaataaatataaagagctgaaagagtcttataccgatgaccctttcagccaactagatctttattcatctctctgttcatgttcatgttcattcacctctctgctcatgttcatgagagaagttattttcttctacctctaagaaagagcaggtgagttgtttttagaatatttctactaaacctataaaaagcaaataattagaatgttttaaaaatggttctaaatgttttaaaaaaggtgacttttttttagatagagttttgctctgtcgcccaggctggagtgcaatgatgcaatcttcgctcactgcaacctccgcctcccgggttcaagcaattcttctgcctcagcttcccaagtagctggcattacaggtgtgcaccaccacgcctggctaatttttgtatttttagtagagacagggttttgccatgttggccaggctggtctcgaactcctgacctcaggtgattggaattacaggtgtgagccacccccccagcctaaaaaaagatgagtattctccatattagtcttaaagataaaaaaaacctaacaaagattaatacaaaacagtctacagaccagtttcagttatgaatatggatgcaaaagtcctaaataaagtatttgccagtaatagtcaccaggacgttaaaaaataattattgaccaaggggaggggggcatttattccagtattcagtattcagtgttttcatgtcaaaggaaagattacaggcttgtcttaatagatgaggcagaagcatttaagaaaatgagtgttctgatactcagtaaaataagaatagatagaagatagatgcttccgtaacatgaaaaaatatatatgtatgtgtgtgtatatatttctgcccaaaactcagtacagtgattaatggagaagcactataaacagttccctctgaagtcaagaacagacaacaaatgtcactgtcagcactatttttaaatactatactgcagtaccagccaagacaatcacgtgagagagaaatttaaaaattggaaaggaagaagtaaaactagcactatttacagacattatgattgtacaactacttgaaaacccaagagaaccccaaaactctgcaaataataaaataattattactgaagttgttgatcataaaaataatttgtagaaatcagtggctttcatgtaaataaacctatagaggataagatgaagagacccacttacggtagcaacaaaaaggataaaatataaaatataagtttgtcatatatgagacctgtgtgaagaaaaaactatttcaaggacacaaaagaaggcttgagcaagttaaaaagcatgttcttggataggatgactcaacttcatcaagatgtcaactctcagttaacttatgtatcaactgggcgtgatggcatgcacttctagtcccatctacttgggagattgaagtgggaggatggtttgagccctggaattctaggttgtagtgcgctatgattgtacctataaatagccacggtactccagtctgggcagcagtgagaccctatctctaataacaaacataaataaagaaataaacatatacggccgggcgcagtggctcacgcctgtaatcccagcactttgggaggccgaggcaggcggatcacgaggtcaggagatcgagaccatcctggctaacacggtgaaaccccgtctctactaaaaataaaaaaaattagccgggcgtggtggtgggcgcctgtagttccagctactcgggaggctgagacaggagaatggtgtgaacccgggaggcagagcttgcagtgagccgagatcgtgccactgtactccggcctgggcgacacagtgagactccgtctcaaaaaaaataaataaataaaaagaaataaacatatgcattcaacatgcttttgattaaaaaaaaatcagcttttcatttggaattagacaagttgatcctaaagttcaagtagaaaaagaaacaaggtcagccaggaaaacaataaaaagagtagtgaagggatactagttctaccagataataaggtatataataccatctttaattaaaacacagtggtactggtacatgattagacaaagacagaatagaaaatagaaatagattcaaatacatgtgtgaatttagtgtaaaagatcttcaaccaaccagaagaggttgtagtcaactgcccagccatttagaaaataaaagttatctttataccagagtaagttctgagtggaccaaacttgaaatttgtaaatgaaatataaagtataaaatagaatggaggagaattccttaataaagctgggatgggcaggatctaataactcctacttaaaatccagaagccattaaaaaaaagaaaagaataagtttctcatagaaatatgataaacagagtcaggatatgacaaattggggatccaatatttgaaacttattcacaggcaaaaggctaatttactttatttagaaaagaactcctagaaatgaacaagaagaaaacccaatagacaactgaggaaaagacgcaaatagaattttgcagacaaggaaatacaaatagctcttaaataaatgaaaaaaaatgaataccctcattcattataaaatacaaatcaaaattagtctgaagtaatatttttcagattggcaagaatctgaaagtttgtttaaagcctgttctgggtcttccacattcattattctctacggtcaatcacattccaaggattgttgcctccaatgcatgcctttttctcaattttattttctcccatcagagtcatgcacagattagctcccaagtgagctattataatggcctcctagcatctaaactctccttttttccaattgatagttctgccagagttgtcttcttaaagcagaggttagaccgcatttctcttaagtaaattccaatgacaccaaaacagtgattcttaataagaattacaagtagggaaatacagatgggagagtttgcttagtaaataagttcataaaatctaggttaaacaaagttaaatggggtttgctttttgctgttgctttgttaatgtgcatttgaaatttctaaagtggcattacatatccataatttcccttatctatttgacaaaggaatctggtttgtttagaagcattttttcagaactgtgataggtcaacctttcagaaattcctcattatcaacagtcaaatccagatgtattttctttggctctcacaacaggcttagaggaatttctagtctgttctcctgatgtttcattatgtgcatcttttgcttaggcctgttaaacctactcaatgtgtgtatcttctactccatgtctttattcctactgttgtcttaacaggaaatccttgcaacccaattcatagtttttgttctttggaaaaatccaaatcatgtatcatgaatacatattttttctctattgggatttgcctgtttttatgtatcacagccagaagtaatcactgcatagtgtatttctgtagaaagatagaagagttctattttaacacaatatttcctatatacccagcaaaggtctaggtatttatacatactattgtatttattcatctcatcaatgcaatgaagaaatattaataaatccattatatatgctaaaaggtagcgacacatatatgctacatgtgcaggttttctcaggtattattagctagggaagctgtgttgtaacaatcttcaaaaacttctttctattgtttacatgctattccacatcattttgttttcatttcttttgtagtatctaatgtattctactaaaaaaaaaagtagagtagttggaaaacttgtgaaaaaaacatatgtattacatatataccattcttcatgattctcaaaattttcatcattattaatgttttgtgtatatatatatatatattgtgtgtgtatgtatgcatgttagatatataatttaaaagaaaacaataagttggtggcttatggcaaattgttccttaagtcctgcatttgaaacatagacactgagtgaatcagcacatttgatcatcttttaactacaatagatgattatacattaaaaatacattaaccatccaaatacatcttttttcttatttatgtatgtatgtatgtatgtatgtatgtatgtatttttatttttttgagatggagtctctttctgtcgcccaggctgaagtgcagtggcgcaatctcagctcactgcaagctccacctcccaggttcccgccattctcctgcctcagcctcccgaatagctgggactacaagcgcccgccaccacgcctagctaatttttttgtacttttagtagagatgggttttcaccacgttagccaggatggtctcgatctcctgacctcgtgatccgcctgccttggccttccaaagtgctgggattacaggcctgagcctcggcgcccggcccaaatgcatctttaggaaaattatatttaagctcttcatggagacattaaaaaaccaagctgcattaataataaataattatatcattcattagtaaggagtaaatagctgttttctatttgagaagtattaattggattgtccatctgtatgcaggaacatctgttttctgacatgctttaatcaccatttgttttgtacttgtaccataattacacttgtttgtaatattgaaccgagacaatgattaaaatcaacttatgaatacgattcttttatgcttttgtatttcattagaaaatgtgtaattctggtatgacatttataagtatatataaaagaaagtatttgattaacaaaatgcctcaacagattatgtcagtaaaatgagtgttatatcatgcagtctatgttactattttggcatttttaaggaaagtttattgcttcacggaagcttttttttaactgaccatctatgaattttctgtattctttatttcattgtgatcacatggtcatagaagagacatttttagatcatcagaagttgacagttttcagtgtagtgtatgtgcttagtataagatggaattaagtttgttgtatgggtgattgatgaatttttactgaatcatggataactgctgttctattaatgacatttcatcaattaactcttttggatatggtttatcacaaaatgttgctgatttaatgtttgtggattaactgaggtgaaagtgatacctggtagaagtttcattaatacaaattttcctctcttaggagtaggatggattatattatttgtcgaaatgcctttgcatgtaagttcttaactgtcagctttcttgtcctgtgaatcatatcttttctgtatttgctgaaatagagacttaacattgttaaatgatttttccatgtcatggaaaatgtatgcctctaaatctgcgttccttcctacaaattacaagttcaaaatgactttttttaagaaacaaaaaaaaaagatggatttctcgtattttgtggcaggataagctccctgtagcctatcttaaatgttgattacgactaaaactatgaaaagtacaataagcaactaactgaggaatctgaaaagtaaataaaagtagaattatgagtgataggcaaaatctggagaagcaccctgcagtagtgtgagcttccattgttgtatttctttcaatcaaaaccaaaacaaacaaacaaaacaaataaaaaccagaaaagaaccaccaccaacaagaaaacactcaaggaaaatagatattgtgatagaaacagcagaaatgtcgagaaacaaaaccagaaggttagaattattagagaaaataatataaaaagtaattttaaatatctaaacaaaattttaaaaaggaatttaaaaaaataagcaaggagaagacaataaaaataggttgataattcatttgttagcatttgtctgtttggtatttgttgaccattttatttttaaaaaatttggctatatttgcttttggtgtatttcttgtatatgtattgtaaaatttagtatttattattattaaatattttatattgttaaatgataatttatttttattgataagaaagatgtagttttctggttgttatttttgtaattttacctgcatttatatttttctccatttatttagataatacctaatggttccccacaatgagtggcaattaaattagactctgtgctattttcactttctcaacttctcctgaactatttgatttttgtggcaggatatttcttaatatttgcctttgtgccacttaatgttttcatactattatgggcaaattttgagatttaaaatgaacccattactctcagctattatagacgaggcaatcagggagctaattcctactttcccctttcttttactctctcctcctggttgttacagttgaatcatttgtacattatcagaatcatcagtaaaatatctttttacatcttctacaccatgtatcccttaaatctatatatgacgcattgaatgcttacctcttgccttactggtagtattttacctactcagaactaggttgattgaactttgtcctgtggtaactctcttaataagaactttctgtaaagtgttccctgaattatgggtgcttataactgtacactttatagctgatagatatcttgcaaggataaggataaccatttgcttctcccttctcttctttctcaatatttccccccattttctggtgttaacttttgctgtggaaaactctgatgccaaaatgattttctttttctctaagttgacaatttttgcttaagccctcacataatgctttcttaatctttaaagtcctagtcccatacacagatatatcttggtgttgaacattctaataacatacataagcatatactacacagtaatgtaaatatatgtgcttatgatgatctatcttgtcttaatataggcaataacttttttctaattctatcctatgttttacagtttttggatttttggacggggagaggacttactacatattcttctctcacaccctttacgacccttacattatttggggttcagtctcccttgttctctttacaatttagtttttttttttttttctacaatgattttgtttttaaatcctatttctttcatggattctgccagttgctattgcactttctggctatctcttccccattctcttgcatttcacttcatggtctctttatgttttattacacccttaaaatttatgttggaatgtataaatgttcattccttttttcatctgttttgtagcaacatgtttctagttattacaagagttgatatattccttttttatctttattcttaagagtatttttatgtgaatgctgagaaaattcctttagtatttctcatatgtgaaagttgaatttcctacaggacaaaggaaaggggttgtagaatgtgccccagcctgctagctcaagggccctctcatcatttgctacagtgacagactgttgcctcattttggggacattatggagtcaccgctcgttctccataagagcataaatgattaccaggtagttgttactgtcttctctccttgatactcatacataactcatagcacatatggaagcaaccttctaaatacccatgttttatctttaaaatgttctttgtgtgtagctgcccatttgttttgtgctaactgactgaccctattaccttcagttgtaacaacccatttaaggtagaaacgaaggacactcatctccatgtgttttcagaatttaaatgaaaaaataaaaagaggctgatgtcacttcccagtttaacgcaggggttttatttatttatgtacactcaatcaaactatgactattacaaatggttttaccgctacaataaagatagttaattcataactcaataaaaatgaagagtgaaagattaaaaaaggaaagcaacaattctaaactataaaatctacttcagaaagctacatacagcaaagctcaataaataaattatgaaaaaaagaataatatgggataagttttatggtttaggagataccttcctataagccaaaaacctaaaaaaaaatgctaaaggtatagcttgctatagtacgtggtaggagaaattaacatgtataaaatcaataacactcacattatgtgatagtctacagccaaagaataatagaaagcaagtgaaatgcttagcatagctatttagtctactaaattaggtttgtgaaaatgggaatgccaaatgccttaaggcttatggcaggtgcaaaagcaaaacatcagaggtcaacctaaggatatttttaatataaaattaatgtacctgcattgtaagcattattttttttgtatggtagaaaggaaaaaattcttgtattattctactataaatgtgtattctttgctctactaaatttgcatgtcatcgtcagcctttcactttgtcttcagctaacaagaacctcttgggttcatcctttggagaacctgatatggaaaatggactgaactaggagaagagcctttgtttagaccacatgctgaggtctagtggcttcaattaaaaatatataaatgtggccgggcacagtggctcacgcctgtaactccagcactttgggattctgaggcgggcagatcacgaggtcaggagttcaagaccagcctgaccaacgtgatgaaatcccgtctctactaaaaatacaaaaattagctaggcatggtggcacgtgcctgtaatcccagctactcaggaggctgacgcaggagaatcgcttgaatcctggaggcggaagctgtagtgagccaagatcatgccattgcactctagcctgggacgacagagcgagactccgtctcaaaaaaaaaaaaaaattatgtatatatatatatgcttaatctctaagctttggaaggaacagcctatctacagaaaaatttaaaacttggtcatgacaggtacagagttgggccccattaattttgttgacattgaggtcagcagattctgtaaattttcactatacctctcatatgatctgccgccacaccattcatactcttaactttatttctcctcacaccagtaaattactaaaactgccaagtttttttttcacaaattaatatctttagcattctcctccttcagcctgcaatgaaattatctactcccctccctcctccttcctccttgactcccgctaatgcacatttgtgtttggtttccacaccaaatgagctaccttcaataagcatcccacaactccacagggaacttttgtttctctaccttctgtgctgtcaaagcgcttggctcagaatgagagatctgtctgcatttcagatctacaaattactcattgtgtgaccttggacatatccctaatatttttgagcctcagtttctcaaaaattagaataaagataccaaactcctggggttttgtgagagtaaaatgagacgatgtgtgtaagagactcagtgcagtgtcagtatctaccatgtgctatgcactctgcgttttctttttcttttttttttttttgagacggagtctcgctctgtcacccaggctggagtgcagtggcgtgatctcggctcattgcaacctctgcctcttgggttcaagagattctcctgtctcagcctgcgagtagctgggactacaggcccatgccaccacgcctggctaatttttgtatttttagtaaagacagcgtttcaccatactggtcaggctggtcttgaactcctgacctcaggtgatgcacccacctcggcatccgaaagtgctgggattacaggtgtgagccaccatgcccgggccaacccatagccttttggtcttctctcagccaaggcatccagtgaaaatgcaatttatttttcagattcctctggagaattaaaaagtctcttttgcggctggacacagcaactcacacctgtaatcccagcactttgggaggctgaggcaggcagatcacaaggtcaagagatcgagaccatcctggccatggccaacatggtgaaaccctgtctctactaaaaatacaaaaattagctgggtgtggtggcacaggcctattgtcccagctacatgggaggctgaggcaggagaattgcttgaacccaggaggcggaggttgcagtgggccaagattgagccactgcacttgctctggtgaaagagcaagactccgtctcaaaaaaaaaaaaaaaaaaaaaaaaaaagtctcttttgcatcaaattgccatactctctgctcttggtcctcttttccatgtactcattcttcaagcatttattttctcattgcctgatccagatcattgcaatgaccaaaaaattttcgaatgctatgatttttgtgatattcttttagcaagttaatcacgatgttgcattcttgagtgtgcaagtgtggaggtaagtcaggatgcatctttaagacaaaaagatgggtcacggcagtgccacaccactcacggccacaccaggagagctgaaggggcagtcaccaacgaagatgcctgacccagaagctggctgccagggagccaagagccaggtcactccacaggtggccaatgcccgggggtggccctccaccgccgaagctgctgctgctgctgctgctgctgcttattattattttgagacggagtctggctctgcctcccaggctggagtgcggtagcacgatctcggctcactgcaacctccgcctctggggttcaagcgattctcctgcctcagcctcccgagtagctgggaccacaggcacgtgccacctcacctggctaattttattttttgaatagacagggtcttgttatgttgcccaggctggtcttgaactcccgggctcaagcgatcctcccacttcagcctcccaaagtgccaagactacaggtgtgagccaccacacctggccaagttctacttttctaatatttaaaatatgaaataggccgggcacggtggctcacacctgtaatcccagaactttgggaggctgaggcgggcagatcaccagaggtcaggagttcgtgaccagcctggccaacatgatgaaaccccgtcactactgaaagtacaaaaattagccgggtgtggtgacagatgcctgtaatcccagctactcggaaggctgaggcacctaaacccgggaggtggaggttgtagtgagccgataccatgccactgcactccagtctcggcgacgcaatgagactctgtctcaaaaaaaaaaatagatgatgtcagtgatttctattacatgagatctggaagcactctgtacctgattgctccacgtttagtggtgctaagttcaaataattcaggtggtgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgctgctgtcatttgtcgttcaaactgtgggcttcttggccaggcgcggtggctcaagcctgtaatcccagcactttgggaggccgaggcgggcggatcacgaggccaggagatcgagatcatcctggctaacacggcgaaacgctgtctctactaaaaatacaaaaaattagttgggcgtggtggtgggcgcctgcagtcccagctactcgggaggctgaggcaggacaatggtgtgaacccgggaggtggtgcttgcagtgagctgagattccgccactgcactcaagcctgggtgacagagggagactccatctcaaaacaaaacaaaaaacgatgggctttctgtcgtgtgtgtgtaccttttggatttgagggcagggggatgacattgtgatctggcctcctgagaaaccaggcacaccctgcctaccttggaaggcggctttcccttccccacctccctctccctccatctgttccctctttccctctctccacttcactcccgtcccccagctcttctctcccatctttttgttctctgtctcttttttttttcctgcattaaacctttcgggagtgtctttgtaaaatattaagaagcgttaggtcttcaacatgtgtgtttacttgcaggcctgagacctgggaggaagctggagaaaagatgccctctgaatctttgtgtttggctgcccaggctcgccttgacaccgaatggttgaaaacagatatacaggtggggtttgacatgtctctttcttggtgtatttctgcttccatgtttaaatttctcgtgtaaggcttttttttagggtatgtaaggggaagtcagttgtatcttgctatattagaggagcaggtttgtttcctgtaacttaaaatgtaacagtctttatggctgtttttgtagatcgtgcgcggctgccttttaattagtttcttgcaagtgcaggaaatgagatttattaatagggaaaatttttttcttaattattattactggttgagaaatctgctacactcctaaccatatcatggtgactgttgtttgttactgatagtttttgagctgttgagttaactgtcgaggggaaaattggagaagtaagttgcagtaattatggctgctagaaactcactccttttatgaggtcttgtgtttgtgtttctggagagaaaagagttagttcagttgagctgtttgttttgtatttgtaaccaatacaaggactaaggacaattgtgttgaaactgaggtcataatgttgggatcttaagggccgaaggttccaaacaaatggtatgtatagagttctctctgacttgaaattttccctttctggacctccggatgctgaggctgggagtgtccatatgacagtgccttccatgacaggagtcagcaacctttttttttttttttttttaacacgtatcagtaattcattctgtatattttgaaaagttttaacctcttcttcctagccctccagtatttgttaataaattaaaacgtttcccaaagtgttttttgtgaaacaataattctaaaagatgctctaagaaaagctaagtacatggaaaaatccaaagtgtatattttatttattacatttcatgaatttttgtttctgttttttcctcttgagagggagtcttgctctgtctctcaggctggagtgcagtggcatgatcttggctcactgcaacctccgcctcctgggttcaagcagttctctgccttagcctccagagtagttaggattacaggtgccctccaccacggccagctaatttttgtatttttagtagagacagagtttcaccatagtggccagactggtcttgaactcctgacctcatgatccaccctcggcctcccaaagtgctgggattacaggtgtgagccactgtgcctggaccacatttgatgactttttttgtcctttgttcttttaaaaatcatggttagaaagcagagcataattgttctttatgtagaatccaactgattggggtttttagggagatgttttgacattcagtaaatgtttttgttttccattattaagactatgaattttttattttactttctgagacagggtcttgctctgttgcccaggctggagtgcagtggcgtgatcttggctcactgcaacctctgcctcctgggttcaagcagttctcctgcctcagcctcctgagtagctagcattagaggtgcccgccaccactaccctccgcctttcaggttcaagcgatcctctgcctcagcctcctgagtagctgggattacaggtgcacgccagcatgcccggcaaatttttgaatttttagtagagacgaggtttcaccatgttggtcaggctggtctcgaattcctgaccttgtgatccacccgcctcggtctcccaaagtgctgggattacaggtgtgagccacatttttagtagagatggggtatcactatgttggccaggctgctgtggaactcctgacctcaagtgatcccctcaccttggcttcccaaagtgctaggattacagatgtgagctaccacgcctagccgtattttgtatttttagtagagatggggttttgctgtgttggccaggctggtcttgatctcctgggtgcaagtgatcctcccacattggcctctcaaagtgctgggattacaggcatgagccaccacacctggccaatgggaggtctcgcttcccttctctgcagcattccataagcaatgtgtttgggtagtatgtgttcgattttctctatgtatactttgaaccctacagtagtgaaaggaagagtagacaactttgaagttgatgtggtgtggtctttgagctggtggtgctaattactcttggttgttttcgtggcctccagtgacttcatcctgcttttgctgttgtaaagtgttgtaatttatgctcctgagaataactcttgaggtgtacttagggttcttgtctgcttcctggtgactgtcgaagcttttcatcttgaagaagggagatgagcagtgttccagtgtactgagattaaaattaagaatgttgcatttttttaatatgtaaaatttatagccagctgtagggtaggggtggcctactttctctaaagggccagatagtaaatattttaaggtctcactggaccctatggtctctgtcatagccatgagaccttgcagatttagtgccaaagtagccacagacaataccacgtcagcgggcaggggacgttcattctgtaaagtgtatttatggacaccaaaagatgaagtccacagaatgtttgcaagtcacaaaatactgtttttcttttgattgtttttcagttattaaaaaatataaaatacagtggccgggcgtggtggctcacatctgtaatcccagcacttttagaggctgaggcaggcggatcacctgaggtcaggagttcgagaccagcctggccaacatggtgaaaccccatctctactaaaaacaaaaaattagccgggcatggtgatgcacgcctgtaatcccagctcctcggaggctgaggcaggagaatcacttgaacctgggagaatcgtttgagcctgggaggcagaggttgtgatgagccaagactctgtctcaaaagaacaacaaaaataaaatactttctctgcgttcagaccatacacaaagaggctgtgggctgggtttggcccctgggctgtggttagtgaccccaaacacacacacacatacacacacgtagggcagagtctggcatttagagccagcacctgtgttctcacctgagctgtgttcctggctgggttctgctgtgtattctgtgacccaagatgtctatctaccttggtaaactggagacaacaaagcctgcctccttcaaggttgtttgtaaagatttaaaagggtaatgtattgttgttaggccagatgctttgcatagtacatgttaggttattttcactttttttttttttttttgagacagagtcctactctgttgtacaggctggagtccagtggcgagattccagctcactgcaacctctgcctcccaggttcaagcaattctcctgcctcagcctctcgggctgctgggattacaggtggctgccaccatgccgggccaattttgatatttttagtagagatcgggtttcaccatgttggccaggccagtctcaaactcctgacctcaagtgatccgcccacctcggcctcccaacgtggtgggattacaggagtgagccaccacatctggcccattttcactttccattagctgcttttttcccccattcatttcctacctttctgtgtatgatttctgaattaaatgtatttcatgtcttaaccttctgaattgtttgtcctctcattttccatgctgttaaggaaaataagaggctaagtgagacgtattaaatttgcatgtagtttctcagatcaggataaatgctcacctgttgcagaacgggactctgctcttgcttcacccaggatgcctttcctagttccttcctagagtggggccgcaccctgctccagccctccagacccagctccctgctctgacatgattccaccagactgtattccagctgtcctccctggacctagatattttccttcttcttctttttttttttttttttttcctgagatgaagtctcactcggtggtccaggctggagtgcaatggtgtgatctcggctcactgcaacctccgccttccaggttcaagccattctcctgcctcagcctcccaagtagctgggattacaggcacgtgccaccaagcctgggtaatttttgtatttttagtagagacagggtttcaccatgttggccaggctggtgtcgaactcctgaccttgtgatccacccgcctcggcctcccaaagtgctgggattacaggtgtgagccaccgcacccccccagccaacatatttttattaaaaaacttatatgaaatttattttattgtggtatgtagttcagtaaattttgacctctatagattcatgtaacccccatcatcatcaggatggagaattttcttcaccccaaaagctcccttgtgctgctcctttttatcacgtgttccctggtctcataccctggcaaccacggatctgttctccatcagtatggggtattctttttgagaatgtcatgtgagtggaaccatattttaagtaacattttgaaaccatcttcatttactcccagttatatgtttgagatttatgtgctgttctgtgtattaatagttctttttattgctgaatggtatttcatcatttggatgtaccacatggtgtttatccattctgccattgtaggaccttgtggttgtttccatttttctttcccaattgtaatcctgctgtgagcattactatacagattttatgtgaatatagtttccatttccctaggataaagacctagtagtgtgaaagttgggtcatgtgctgaactgttttccgaagtggctgttttagtttgcattcccactggcaatctgtcacgtttctgttgctctgtgtctttgttagcacttggtgttatcagtgttttttagttgagccattctaacaagtctagtgggatctcattgtggttttaatttgcacttccgtaatggctaagaatgctgaatatcgtgttcttctttgccactcttgtatcctctgtgaagtttctgttcagatcttttgcacggaaaaagctgtatcatggaaccagtaaaataaccaaggagaggttgattaaagttctgtttataaccctagaagattcctgccctagggatatgggatggctgaacgtaggacaccgacactggacagatgaaatagcagtttattagtcacgcatgctcacagccctggggtgggggacaccgcatgccattcagttaatcatgtgtgttgtaacttttcggggagggacatttgcagagactaatggtatgacattctgaaaagcggtgacagattaagaaattttttaattctgcagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaaacttgccattttaatcatttttatgtgtacagttcattggcattaagtatattcacattattgcccagccatcaccaccatccatctctacaacttttgccctttctccaactgaaactccgtatccatgaaacactaactccttctgtccccaggcaaccaccattctacttttgtctcagaatttgactactcaaggtgtctcctataaggggaatcatacagtatttgtccttttgtgactgggttattgaacttcttaggtgtttggggttcatccgcatgtgtcagaattttcttttaaaggctcaatgctattccattatatatgtaagccacatgttatcccttcatcagtgggcaatcaggttgctttcatctcttgactgttgtgagtaatgctgctatgaacattggtttacgagtgtcttgagtgtctgcttttaattctttgtgtctatacctaggagtggaattggtcaataatgtggaatgcttacatatttattttttttgagatggcatctcgctgtcacccaggctggagtgccgtggcgccgtctcagctcacagcaagctccgcctctcgggttcacgcaattctcctgcctcagcttcctgagtagctgggactacaggcgcccgccaccatgcctggctaatttttttgtatttttagtagagactgggtttcaccgtgttagccatgatggtctccatctcctaacctcgtgatccacccgcctcagcctcccaaattgctgggattacaggtgtgagccactgcacctggccaataatgtggtagttagatttatgtttaacttattattgttgtttttgagattgggtctcactctgtcgctcaggctggaatgcgttgatgtaatcatagctcactgcagccttgaactcctgggctccagtgaccttcttgcctcagcctctcaagtagctaggactagaggcgcagggaatttctcatcttctctctactgcctctgagttggagatgtcagagggagccatggcccactgtaaagtaacacaatgtcctcacccacagggttagaacccctcttctggtggcagctctgaggggagcagtcacatgtggagagtgcagggctctgtgtccagctgggggaaggaggttaccaaggggattgacccccctctggccaggtggctgccttctgacacaccagtctctctctctagcacggtggcccctacacacccagcctgtcaaacctacagccctcgggaaggctttggccaaatccatgagcggctccctctgttaagaaggaagcacagctgaagcatgaggagggcagtagagtgtgtatgctccgccgcgtctccccacagtctgaccagaaggaaggggcctttcagccaggctcgcccaggctggggttggagtgtcagtatcaagccaatgtcttcttgcttaatgagtgagcccaggtgctcccgtgcagctgccaccgtagtgagggtgaaccggcaggaggctccacggcactttcaggctcaggctgcctggtgagatctactctgtgggctctgtaggctggtagaggcttccaggaggaggaggggatgcagccaccagtccccactcctgggagtcgtatttctgaaagcttgggtatacagtaaatattaggctgtgggctggtttatctatggatttgatgtgggagggttataggtacaagcagtttaaagatggaaattttgagagaacccttagtgctgggtaaggcaagcaggcttgtcaaagcagctcttttggggaggccagaatcctgtaccaatgtcctcagcatgttcatcagctgctgggggagtgccggacaggatgaaagcacaggagaactttgtggatgataaaatgttccatatcttcaaaggaggtgggttacatgggtaatgcatttgttaaaagtcatcaaaatgtaaaccagatctgtgcatttcacggaatataaattatacctcaaattagaaacatttttaaaaagacagatgggctggatgcagtggcacacgcctgtaatcccagcacttggggaggccgaggcgggtagatcacatgagtcaggagctcgagaccagcctggacaacatggtgaaatcccgtctctactaaaaatataaaaattagccaggggtggtggcatatgcgtgtaatcccagctacttgggaggctgaggcaggagaattgcttgaacccaggaggtggaggttacagtgagcagagattgcaccactgcactagagcctgggcaacagagtgagactccatctcaaaaaaaaaaaaaaaaaaaggttttcaacattcattaaaggcagagtagcttgttatagactagcctccccacaggaacagttagaaaaactggacaaaaatgtgtccccccttccccccaccatcaaaaacaattgttggaaggtaattggggacctcagccaggacttgagtgaccaggcctaggaggtgatcctgacagtccttagtgcttttcccacatttggtgatcggtcaacagtagagggctaagaggctaagaaactgagtatgaagtgatagttaagaggctggagagcctagctgaatgtttggcactctcacagggctgaaatgacataatgagaatttgggtcccagtaaggagatgagaccttggtggggatcctggaagggccacccctaagagtccaaaagaataaaaaatagaccagctgtcacaaaaactaaaacctgctttgagccagcttagtcccaaactagatgaaggcgatctgcttgaacgccaattgtgtgccataaagtcaaagtcagtactctctggaggcagataaaactttactaggcatgccataagacaagacaacgcaagacaaaaggagaaaacaaacaaaaaaaacaatagaaacatacatagatattagagtcctcaggtagaatttttttttttttttttgaaatgggagtttcactctgtcacccagcctggagtgcagtggtgtgatctcagctcactgcaacctcaacctcccacgtagctgggattggtgatccacccgcctaggcctcccaaagtggtgtgattacaggtgcaggccaccgtgcccggccagtattttgccacaatttaaaataaattttctttttttcaagtttgttctcagactgtattcacaaggtcacatggcggcttacacttctgtaggccttgttgaccgttctttttagatactgatgatcttgatctttttcttgtctcctccgtagaagaatgggatgcaggaggtgctgcctaagcctgggcgctcctgggcgttcttcattccagggggcagctgcatgatctgtgcagtgcggttgtcatgggaataacccttcccggcctctcgtgcaggctccaggctgccagggtggctcatatcagaaggatatttggagggagggaggcagggctctgagcaccgctcctcctgcgtcttctcctgctctcccatcctctccttcttctcccgcctcttctccacctgcctccggatcttctcctcctcctcctgcatcttctcatactcatcccacagcctctcctccttgaattgcagcctctccacctgcttccgcatctgctcctcctgctcccccatctgctcctcctgctcccccatctgctcctcctgcttcctcatctgctcctcctgctcccccatctgctcctcctgcttccgcatctgctcctcctgctcccccatctgctcctcctgcttccgcatctgctcctcctgctcccccatctgctcctcctgcttccggatctgctcctcctgctcccccatctgctcctcctgcttcctcatctgctcccccatctgctcctcctgcttccacatctgctcctcctgctttcgcatctgctcctcctgctcccctatctgctcctcctgcttccacatctgctcctcctgcttccgcatctgctcctcctgctcccctatctgctcctcctgcttccacatctgctcctcctgcttccgcatctgctccttctgcttcagcatctgcttctcctgcttccgcatctgctcctcctgctcccccatctgctcctcctgcttccccatctgctcctcctgcttccgcatctgctcctcctgcttccgcatctgctcctcctgcttccgcatctgctcctcctgcttccgcatctgctcctcctgcttccgcatctgctcctcctgcttccgcatctgctcctcctgctcctgcatctgctgctcctgctcccgcagctccttctcctggtcccgcagcctctgctcctgtctccacatcttctcctcgtgcttccgtagcttctcctgatcccgtagctcctcctgatcccgtagctcctcctcctgcctccacatcttctcctgcaaagtgttggtttgaacctcaaaaggaaatagagtcataagctaggtatataaatgtaatctataaaataacggttttcgtctatgattctttaaaaagaaattttaagccgtaaccctgaggttctgatttcccaggcatggtcccaatttgtagatttttagcacactctagaggattctgtggtgggaccagaacaaggacccaaattttccagctcttggctggagcctccccacaccctgcatgatccctagaccatgtcccagccggatgcggctcccacacccccggggctgccgccgctcacctgtggcagcgggattttgtccgtctccagtttcctttttagctccttgatgtggagctggatctcagacttttcagtttctaccagtcgaagtttttcttgtagttcggcatttttctccttcagctccttattggttatgctatggccggaggcagtagagaaaggaatgaacgaagaacagaaaggaccgctttggtgatcgaccctctaccctcgccccacaaccacagaaccgtggcactggaagggaccccaggaattaaaagtcccaggtggcaggccagagagaagacatgagttgcctgaggctaccccatgagtcagtggcacagccggcactggagcttccctgcacacacatgtaaacctgtatgaccccctaccatgctcacctgtaccccccacctcccagcacaccacccacgctaagggctctcagacctcccatccccccctcccctatcctacatgttcctgaacagctccagactcatggcttccctctcctttgttaactccttgatgtactgcaaacagagaaaggtcaagtcaggatacagcaggcagaggagcagctggacgaccagtaacgacagctacactgatactccacagtaacacttgctcctctccgtcacacccgacatgttctcaaggcgtttccaaacccgtggtgtcatttgtttttcttttctttttttttttttttttgagatggagtttcgctcttgttgcccaggctggagtgcaatggcgcgatctcaccccaccgcaacctccgcctcccggcttcaagcgattcttctgcctcagcctcctaagtagctgggattacaggcatgtgccactgcacctggctctcacttgtttttcggagaactcagtaagggtggaaggcacagagaaagagactgaattgatagctggctaacaggggcccagagcgatcagataatattgttattgctattactgttattattaccactgttggaacctttcttgagtgcttcaccaggcactatgctaacaatcccatttaatcctcacagccaccacaggagacagttatcattatcacctctattgtgtagatgaaaaacatggggtattaaaggttaagtgcttgcctaagatcacttagagctgggatttcaacacccaggtatatctgattctctaagcccattcttttggttgggggtaggggcacagataaggaggaggaaattaatcctttgttgatttttgaaagaatgatacattggcatagtccaaacctcagaaggtacagaagggaaatatcttcccccaacactgttcctctctcctgagttttttatgaatccttacaaacatgttttatgtatattaccataatacgtacgtacacacacacacacacacacacacacacacacacacacacgtacatgtgttccctctctctacacaaatggtaacatactaaagatactcttctgtaccttcatggtacaagtaccctcaactccgcctaggatttgaccaaggccacagccaagtatgggtggggtgggcacttggcctccgagctctgtgtccagtgctcgctccccacagcgccccgcaactcacccacagcagctgactcagccccaacctgcctctaacaaccacgcacaaaagcagcaagaaatggcccatgctgtcttctgggcaggacactgcatcctgcagaagggacctttaggctcattcctccatctgcgaagctgggctcccaggggaccgggtaggtggttggactcaccttgtccgccctctcgtgctctgcggacatagcagagagagcccgctgtaactctcctgcaaagtgccaggaatgatgcaggcgggctgccagatccttggaatcttctggaatgagagaggttgagctgcagcccaaaggcctgtgaaagtgccaggttgaaggatgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttattttcctatagaaaagaagaggaagacagagctcttactagagggaggcagagatggcacagcaagagacatgcccccagaatggccccactgtcccaggacaggcccacccatgggaccaggttatcagggaccctgtggggatggggtggaagctgggaggtgagccttcctccccaagctgggagtaggcgagacgagactggggcctctacatctgagtgccccccaaacccagcggtcatgtcgtgagcaaagaaagaaaccatgttacctctttcagctgagctcggttctgttgtttctgtggggagagtcaaaggaaggtgactgagggtggtccctcgactctattccccaggccaggaagcggtaggcaggggtcaggaatggattttaagggcaaagttctcagacccaatgggaacacaaactggtcaactttccttaacgcccaaagaaaaaggatttgggtctttgttggcttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacatgtaagtaaaacattaccatccccattttacagatgtgaaaagagaggcccaaagagctcgagcaattttccctaaaccgtgtccctcgcagttggagagagaagtaggactcaaacccagaattcttagccagtacccagcagttcttccttccacaatcttaacagttaccctcgacctcccccttgtgccccttgtcctcaggagaccggccagccaagactcacatcctcaggcgagtggcagccccccgaagtggttgtctcagggttagcgccatgatttattttcttctttttggtgtcggttgctccggtaccaacaccagcactgttccactgatgatagtctgtaaactgtggaaaagaggagcagtgatactcatgagaactacaagctcctacagtcactttacagtttatacaaaatactctcatagacgatctgacttaatgccaccaacgactgtacgaggtgttgtcgcaatcacttagtgactgagagggattgataccatggctaaaagaaaggcaataatggaactgaaactcagtcttctgactctgagctctggggtgttgccacaaatcagcagctgccagagaccaaaaccagaggcagaggtagaaaagtaaaaagtaggcaggaaggtgtacactgtgtggtttacagtcgtacatcctcttagagtcatgtatcctcagggcagaaggcagcctttctgttaaatgtgggaattaaacagaaagaggacaacccaagctgcatttcagagagaagtcttgtatactctttgaaatctatgtgactatcatccctaagaacattaatgttttgtgtctcccacgagaatcaaggaaaactgatgcttcagaaagatgccccatatgtatcctgtggcactcaaagtaccccaggttgagatgagatgaggaagattcaagttgtcaagtccagtttcccaagatctcttgcacagaagatgagcaaatctcacttcaaagatcactgactgatgggcactctggtcccagaaccatggagaattcaaatatgaagtggagaacttagaaaaaactgttaaagtctctctggagagtagaagcctgggagaaaaccaaaccaaacccattatcccatcagtgctgtgcccaagttgcctctttgagattggcatggggtcacagggttgggacccaggtacttggagacgtgagcccaaagagcccagggaagtcaggcttggggcagcggtaggtgagggccgagtatggagtggggagccccaggagtcacctgcccaaagtcaccctggggtgactggtgagggcaggtgctggggcatccggttccttgggaacgtgagcccgaagggcccagggagatccatttttggacaataggaggtgagggcagagtacaaagcagggagccccacgagtcaccggctgaaagtcaccctggggtgaccggtgagggcaggggcaggactgctgaggggttggggctgacacaagattttggttgggggagcccagaggcactggggggggcccggccctgcgtgcctctggagtgacacggattctggcagctgttctgccatcagaggggacctggggctgggttggggttggggtgctgcaatccgatgcgttttacctttttcttggtcccagccaattttctttgttgggttttttcggacatcatggggtggggagggtggtggggttggggtcacattggcgtgatccaggcgaggacagtgatatgcctccagtcacgtaccacacagctatgtgactgagccacaggaggcgtcaccggggctgcactagaatgcggaaaaggggcgtggccttaatgctccaagcccattggtcaatgagaaagatgaaagggaaaggaggcggggccaggcagctgcgggtcatgaaggtcctgtgatgtcacaaggaaagcctcccatggaactgctgtccccgcccactctgggagaggggcggggctggctttcacttacttttttttttttttacatatataactttttattataatttaaggtatagtcgataatataatgtttttttttgttttgttttgttttgttttttttaattgatcattgggtgtttctcgcagagggggatttggcagggtcataggacaatagtggagggaaggtcagcagataaacaagtgaacaaaggtctctggttttcctaggcagaggaccctacggccttctgcagtgtttgtgtcccggggtacttgagattagagagtggtgatgacttttaacgagcatgctgccttcaaacatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaatgagaagtctcccatgtctacctccctctacacagacacggcaaccatccaacctctcaatcttttccccacctttcccccctttctattctacaaaaccgccattgtcatcatggcccattctcaatgagctgctgggcacacctcccagacggggtggcggccaggcagaggggctcctcacttcccagtaggggcagccgggcagaggcgcccctcacctcccggacggggcgactggctgggcggggggctgacccccccacctccctcccggacggggtggctggccgggcagaggggctcctcacttcccagtaggggcggccgggcagaggcgcccctcacctcccggacggggcggctggccaggcggggggctgacccccccacctccctcccggacggggcggctggccgggcgggggttgacccccacctccctcccggacggggtggctgccgggcggagacgctcctcacttcccagacggggtggctgccgggcggaggggctcctcacttctctgacggggcggctgccgggtggaggggctcctcacttctcagatggggcggttgccaggcggagggtctcctcacttctcagacggggcggccgggcagagacgctcctcaccttccaggcggggtcgcggccgggtagaggcgctcctcacatcccagacggggtggcggggcagaggcgctccccacatctcagacgatgggcggccgggcagaggcgctcctcacttcctagatgggatggcggccgggaagaggcgctcctcattttccagactgggcagccaggcagaggggctcctcacatcccagacgatgggcagccaggcagagacgctcctcacttcccagacgatgggcggccaggcagagacgctcctcacttcccagacggggtggcagccgggcagaggctgcaatctcggcactttggggggccaaggcaggcggctgggaggtggaggttgtagcgagccgagatcacgccactgcactccagcctgggcaccattgagcgctgagtgaaccagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggcacagcatcagagggagaccgtggaaagagagggagagggagaccgtggggagagggagagggagagggagaccgtggggagagggagagggagaccgtggggagagggagagggagagggagagggagagggactcactttctaaactttaaaactttatcaccttagttgaggtacaaatcctgttgtaatggaaaatttacagcgtgcttaatgattagtaaagcagattatattatccaacattccaataagataaaataatcacagtgatttctcttttttggaaaaagtttctcttattctcctacattattgttaagttttttttttttttaaactagagatatgtctaatatattttaaaacacaaagcttttgaggtgggtgtggtggctcatgcctgtcatcccagcacattggtaggctgagatgggcatatcacctgagatcaggagtcaagaccaaaattttagtattttagtgtgtattttagtatttattttagtatttaatacatcatttagggctacatgtagccacagaaagaataaatctgattcagtgacttaaagaaatatagatttcatttttgtcacttaaaacgtgcagaggaaggcagtccagggttcttttcagtttcctgatacttccttagcctggtttctattcttgtggtcacaatgtggctgctgtttttccaggccttggattgccttccaaggagggaaagatgaaaggtcaaaaggctgagtttgtctctttttagctgaaaaacacagatttctcaaaagttgtaaaattatactgcaattcaattttcatccttttttttttttttttttttgaaacgcagtcttgctctgttgccaggctggagtgcagtggcacaatctcggctcactgtcataatgtccgcctccatggttcaagtgattctcctacctcagcctccctaatagctaggaatacaggcgcatgacaccacgcccgactcatttctatttgtatttttagtagagacgagatttcaccatgttggccaggctggttttgaactccagaccttgtgatccgcccacctctgcctcccaaagtgctggaattagaggcatgagccactgcgcctggcctgcaattttcatcttttggctgcaaataagttatgtcactattctcagctgggggagtgtttaactcacatgttgcttcctctctgttacacaggttttaagatttatgaataggtactgaattgtatcaattgcttttttctttcttgattgagcagtgttttttcttatctttttatgttgataaggtaacttaacagtgattggcttttgaatgttgaacattgcattttggaattaaatcaactttgttgtgataaatgattaataccatattatatatggttgagatgggtttgctcctagttcatttggtagttttgtacttacgttcacaagagaaagtggagtctaagtttttctgtgtgttttttttttttttttttttttttttgccacggagtctcgccctgttgtccaggctggaatgcagtggcatgatctcggctcattgcaagctccgccttccgggttcacgccattctcctgcttcagcctcccgagtagttgggactataggcgcccaccaccacccctggctaatttattgtatttttttagtagagacggggtttcaccgtgttagccaggatggtctcgatctcctgacctcgtgatccacccgcctcagcctcccaaagtgctgggattacaggcgtgagccactgcacccagacttgtgaggttttaatatgaagtattaaagctatgctggttagacaatttgagaaatgtttcttctcctatttctgacagagtttatgtaagatgtgtgctatttcttccttaagcatttggaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctcatgaacactcctcaatttggagagagagggactgtgatgaggggggttgagatggtacccagagcctgatggccctcaccagcttcaggagaaacctgctcccctccagggctccttcctagggtccggcttgcactgcattctgggagaatcctgtagccccatcttccctttacccattggccgtttaatggtatcccattctcacatttagccttttgaatgaatcaaccaccatattaaaaaattaatagatttaatttttttttcagcagttttaggtttatggagaaattgagcagaaagtttagggagttctcctgtacaccctcaccccatttcccctgtttcctcattattaacatcttacattggtgtggtacattcgttaccattgatggggcagtattattattaactggagcccatagttaaaacatattggggttcactcttcatgttgtatattttatgagttttgacaaatggggaatgactcagctaccatgtctttgttttagtagatcgttagttgctttttgtcttattagctgactcttgttttgaggagaactttttgtcacatccttttgcaccccggcttactgtggcgtggggcaggggtactgggggccagctggtctctggggagcagcactcactgcatcctgcccccgccccattctgctcctttctggtctcagcagcctcccttgctcctttcacctgcctaccccagctcagctgcctgctgcttagatgccactgtggggcaaggaagctgcccccagtcggtccccgaggattctgcccagatagggataagaatcaccgcgagtgtttgctgagcacttgggaggcataggctcggcgggaagggaaggcctgcaggctgaggtggtctgctttgagttttgcagcgttgcctgcggtctccgtgggtgagggaaaaggcacagggaggtgcagaagcgttcctggcgccacggagccggtcagtgacagagccgggtctcaacccaggccactgccctcggcagccaagccccttctttattttggaatggccacctggccaactggcacacagggagaactcatgaaaggaggcgtggctcactcctgaagggagagggacacaggagcagccttgatgcgcaacgccccctccaggccccgagtccctgtccttggaggaagcaggactcccaggtgggagaggtgaagcagatggcttcccccactgcaaggaggaatcccggtgctcttctccaccagccttccctttggtcgccccctggcgtccgcgtcattgtgggaacactcgggcgggatgtattttaaaggagtgcctgatgcgtgtgggtgtggtggggttgggggtgggggtggggctgggggtggttgcagcggggcctatgcaggatcccggttggagggggctgcagaggctactgctgggcctggtgtcgccatggcagctggagagcgggcgaccggtcgcttggcgtcctgcttggggttgttgcccacatcaccgagcgaacgttcctgtcccgcccactcactgcgaggctgggcagggccgcttgccagttaattgtggggattattatttttttttttttgtagacggagtcgcgctctgtctcccaggctggagtgcagtggcgctatcttggctcactgcaagctccgcctccagggttcacgccattctcctgcctcagcctccggagtagctgggactacaggcgcccgccaccacgcccggctaattttttgcgttttttagtagaaacgaggtttcaccatgttagcaaagatggtctcaatctcctgacctcgtgatccgcccacctaggcctcccaaaatgttgggattacaggcgtgagccactgcgcccggccggttgtggggattatctgagagttgctggagtgttctgcacttccttgcgaaccttttacctgggtgggcagggggagaggccgagtcaagggaaggaggcaggatgccacacacgccctgcagggagagtcatctgctgggcactgcgacacacagaaagccaggagcctgagccccgcccgcggttgttgaacggagggagaatgaacaaccgctgacttcctggttcctgggtgccgcatcactgcccctctgctccgggtcaaaccggctgtatgcttagcttcaggaacatgtggcaggtggcagcccccggccccgtggcaggtaacggtggttttgcagtgtggcgtgctgtgggggccggcaggggcacagctgggcaggccaggctttctctggctcagtatgcagggctggttcttcccagaggaggcagaggtcagggaggagctctttccctgtgtctcctgaacagcttcatcagcacaccctgcagcggggactcagtgagcatcctgcagctgtcttgtcccagaagggctgtgtacttttggccctgagggcaacctctgcatttcctttctgggggctcccagatgagccccgctcccccaggtcatcctgatccatattgatgtgataaccccctcctcagtccgaaacatctggaggccccgtttgtccgtgggataagaatgggcttgagcatggctgtgggtgctccgtgtggcgacagtggcatgttctgtggcagcttgcttcctctgtagcccgatgtctttgactcccagcccgatgctccctcctcacccagcagaggcccctcctcggcctttgcatttgctttcatttatcttccttctttaaggctgcttttgagggtttactggccagcagcatcatgtgcagtctataaactgtgtgccctctcggggccaggtaggagcctgagagggaatgggagaagtggtcacgaatgattgtgaggactgcagaaagaagacagggctgagaagagtgtgatttcccctagaattcagagatgcctgcaccagctgggttttgaagaatgaataggagtttgccaggaagattctagaggaacaacagcaacaaaaagatttaaacatgggcacagaagaggtgaggcacagatggcacagggatttggggtgtgatggggcaaggaagccatgggcagggtctaggcccaggacctcaggtgctttgcatgccatgacttggaggcaatggccttgtcatgcagaactgtgcctccctgggccccattagagtccctggctcttggtgtgcctttcatgcccacaccacggtaggagcaggcaggtggggtttggcctgggtttccccaaaatggacactactccttcttgtgcttcagtatcagagtgggcccgtggagtgggaataaatgtttgggtttaggaggcctccagctgggtggcctgctcccaggcaggaaacacagattagaggaagtatcaagttggaaggcagcagccgtggatgttaaagctggaggaacctcttaaggaatggctgtcagctccctcgtttggtgtggtaggaagatgagggtgagaggggttgggagcaggtgctggagctggagcctgaacccccatatctcagtgctgccatcatccttcataataaggaaactgaggcacaggcaggttacatagtcttctcaggatgtcagtggcagagctaggacgtctatctctgcagctcagttctgtgcgaagtccaggcagatggtgctgatcagtaaggggtgctggctgagcgctgatggccacctgcatctcaaggagaaacagtgtcactggctaatctgatggcttctctgggcaccagcacgtgggcaccatcaccctttctctgcagggggtttgtttagtgtatttggtagaacatcccccagcctactaggtgtggcatgctctatgccacaagctctgtatctcaggcagcattttgtactttgaaaaaacaagttgggaacagaaccctgatgaatgtgtttcatttcctgtcagagcaaatgaaacctgaaatattaatggcacgagatttcccttatcttcctacaaaatcttcctacattgaaaaatgtactccccacaagcttagcatgcagctctgctacctgtggcccgaaatcattagttgtccatactcactgacctttggaaataaacacgaaggttcacttgaagacttgggggagaatcacggtcaacttgtgacgcttggtttttcagatattcagctgctctggagagccttggagttccagctgctctagaggttctggggagggagctgttagcctcccatatgagcgtgtggcccatcgttgccatccacacctgcccctctgtgggtgaataagtggtttcctttctcagctggttgacgcttcatttgtttgtgttctttttctttacagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaagccgtgtgtgtgactggtctgttacctcagcggcgggtgcccgcctgtcctttcattcacagcttggatgcggctctgcaaattcactatgcggtggcagccacagctgctctgtgctcctcctggatcctgaaccttggaagctgtcactaatgagttcggtgggtgggtgctctgggcaccaggtgtcagctgggcaacgccccgctgcaactggaggtgccagcaatgctaccaggtcacggggtcagcgccaggttcttgacccacttgccccagcagggagacacgtccgcagagcactcactaatggaatgagggagccagggagccttgggcttcttcagatttcaacgtaaatggcccctgggaaaggtgtgcatgcgtgtgcgtgtgtaaaagccggaccgcccatcccagcaccctgtctgcacctgtgggtcctttgcagcctgtctagagtgacaattctggcagctctgccagcacttacctttcttcatggccaccgttctggtgtcacctggtgtgggaaagccaggtagcaagcacgggctttgttcagaggcggtggcctggggtccagctgggttaggctgtgggtcttggatgggcaggagccctcctctctggcctgcccacagcagcgtgagctccttgctgtgggcactgaccaccttcacggcccaggattcttggggaactgcagagtaaggagaagacttactctcacctagccgcccagagggtgtgggccaagggcttgctccagcatgaccttggccatcaggggcatataaaagagacggcctttcaaggcgcacaccagctttgtgcctccctcttcccagaaagtatacatggtagaggcaaagaaagctgttccataggagactgtcacagagagctgcgtatatgccgaaatgtatatgcactcgctctgaatgaatatgcttaagaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaattaaaaataaataaataaataaataaaataaaataaaataataaaataattcacaattctagcaaaaaaaaaaaaaaaaaaaaaaagaatgaaaagcaaatacaattctcgacgtggccaacaaacaagaatgccagggatggccacatccttggggaatgaagagaaatgtcgcctgagtcaaagctggagggaacgggattccactcaggaggccaagggggacattcctgccgtgcccaggacaaggcggggaagcaggtcccggggagagagccctggctagctgaggacatgcaggcaggactcccaccaaatcatacacatctttaaaaaacctgtatttaaggaaacatctgagccatggcctgcattcctcccagcagcccttggaggccatgtccatggaggggctgccatggccagcgtggacgggcgtgggtgtgtccaggccctggccctccccactctgccccggagttgaccctctccggaaggcttctggaagcacagctgagtggcatgggtatcccaggctccccggctggctactgcaaggtcctctcaggaccctgcccctggccactggggtacacagcctctcagcctgcctctgtcccagttagacctcagagacacagaggccagaaatacttctttttattaaaacacggatcattattaaaacaccttgaggtacattaaataaatacagcctttccagttgtacagacaggtctctggtggcttgaaaacaatttcctataaattctgccttagcagcctctgagagtcagcatgggtggggagaagcatgtgtgtgtagcgagctttctgtggcctggtgtgttacaagcatttaatgtggatcctcatctccagccaagggagacctgaagtccttgcggatgatgctcccccttctgcgatcttgcttgccatagagttggggtccatgttctccccactcagcaaccttgtggcccccaggctggggtcaacggtggtgtcacagcaggtgccaaccccctttgggtctcaggggagggcaggggatgcccggggcccagctgagttggagaaggagcgtgtcacccccaaagcagccacagttggcccatttcagatcccagatggaacatgattggagcgggggaaagacgcatagggaggggaagcagccagctttctcctgggctgtgagctgacgtgcagcccggggcctgggctcttgctgctggtacccggatgccgtggagccggggccaaggggaccacagcttctgggtcaagttgccagcacattccctagtctaccagcacctctctcttctggggaccttcccaggaagcccagaacctggaccctcctagagtccatgagtggccctgagcagcggggctgatgggggcaccccaccccgtccctgactgcctcatttcgaaggggcagaaggttccagcccagcggcatcaagttgggtacagtttccgtatccacaaaacagagctgccaccagcgcaaacccagagctgggtgaaggtggggtgcaggtgaggggcctacagggaggcactgctggggcagcagccccattggccattgggaccgggccctgctgcagagaagggaaggatgctgagcagcaggctgagggggtccagtaggcctctgccccggctgcatgaggagaacaccccagagaccgagtccactgggtggctggtggtcttggcctcgctggaattgcagccatgtctgaggactgcagctctagcccacccaagggctcagcccagggacaatgctgtgtgaacccccaagccctagtgtggacccccccaagcaggtgaaacccctgcggcgtggccccagcgcacctcagagacagtggagattcagaggccagggcgtcaggcgtggctgaagctcggctccagggcggccattctgaaaatccaccaattaatttcacctgcaaagggacttgccttgagggaattcaaaagcccccacttgaggaaaattagagatttcctgttttatagtctgaataaagtgctcaaaaattcatctctagtacgtctctcctgcaaaagtgcaggttgtcatcaaaaggcctggcttatgtgttttcagctctctaaagcaatcgaagccttttcagccgaccacagctgaaggagtcccacaccgcagcccccagggcagggataaaggactggaggaaggctctgggcacctggattggaacctcacccccttcccagcttccagccacacagaagctccccagcacactggccacagtggcattagggaattgggggagctcaaggacaagccccacaaagccgagggaacagcagcgtgagccccctgccctggcacccaggagtggaagacaccctctggtccccctgcgcccccatgccaggctcatgggctctctggggagaccttggcctctaggctgttttgttcaccgcagggcccacccaacgcagctcaggggctgtggctgctagtggccctgaacaggcatttccatcactgcacaaagttctcgtggatggcgctgttccacggccattgttgggagcagctgccactgatgccaccagaaaacaaggggatgggggctaagaaagtccaaggtccccaggctgtccccaagctgggcgtgtctgcttctccataagcagcacgttgggtgtctgcttcccttctcgtgtgggtttgtaagtggtttatgatcctcctgcgcaggtgtgtctgctgccgcatgcccggggaaaggtcagctctgggtcaaagggacctgctttatcaggaggggctacttctcagagaaaccggcctctctcctgcagaactgtgacccgctgagctcaatcaagtgagctcagacacaaaggagctgggaatcggcacttgttgttacggatcacacaactgctccagggacaggatgggagcctggagaaagggggcccaagaggagggggggaaggcaccccacggagggaggccgagctcaaggcccaggagatggtgggttcctccaacccccgcaacaccggcctgttccctggggggggccgggctatggcagaggcccgcactgcacatttgtttgcacaatagccctgtggacagaaagttgggcccaggctgccatctgtgctaacactacctatttcctttcacaggaaataggccagagcgtgatgaacgcctaatgatagagccatcgagccacatgagaaaatgtttcatgactcgatgtcaccctctgtccactgaacactaagttaaatgggggatgggagactcctgctttggaaggccctgattttggagatactttgagtctttaggtgacgtaagtgtcgcctgttgctgtattcacatttgtgcaacactgctcagttcaaggtgctgcacgccagataaaaccagagagttcactgtggacgtgaaagtcatctttccgaattactgggctaggcaggaaatgcaatccccaaagagacactgctcggctcccctcgagagagggggtaacagttccctgcccacaccgcccccagatcatcctgggtgtcccccccacatttatcctccgccaagctgggcctgaaggcctctttgtcaggcatgatggcttctgccaagaacatctgtggcgccaggcgttggtgtccacggtcagaaatgtggctccttcatacctggtccagaacgtcagcgccgaagacggcctcctcctcgaggcgctcctcgttggtgacagccaagcgcatggcacccaccatgtgctgtgcctcggtggggagggcacagtgtgagtgttccaaaaacttggccaccaaaaccctggcatccgcataggccttgctgtccactaaagagcgtggccgctctttggaggtcgctgggaagggctctggtgttggccgttggtcagttttccaggtatctgggtcccccgctggtgaaagctgggcccgacaggcagccgtggcagagcgagacatggaagctaaaaatcaagggcaaaagtgcagttcaaaactcactgaaataagaagttaactcaaaagcaaagaaaagcctgctcgggaggagcctcctgctggggtttctgtgttcctggggctggcgctctgggcatgccctgctgtccccatccctcctccccttctcaaccccaaactgaactagtgtcaacctccaggggctgcagcctccaggagcgaaggcctggggggaagggccaccacagcaggcagcgacccacttctgccctctgctagaatcccaagggcacaggggctggtccttcccagtcttctcgcctccacgacctttgcccctttgggtctgatctcttgctggggcagaatcatggcatctagagacagggtctgccttaagaccagaactgggggtggcagagggaacatgagaccgccccccccatcatgccaggtgcaggcagccaccactcagtgccctgctccactgcctgccaggccagaggctggggacctggctccagctccccacagagctgacagcctctctgcatgacccacaggctggacactgggctgagggtccctgtaagacggccagctccgggctgtcagtggcgagggacgccaacaaggaccagcgaaggcccggcttgcccagcctgagcttcacgccacacaaagttggaacattctgggtcgtctgttctggtgtcttgtttggtggcaactggaaagcctagcaattaaacatgagaaattaagaaactcccaggtggggcccatctaccccagatgaaatctcataaagtgggctgagcagtcacaggtgtgttaaattagtgctagccctggatataagtgcaccgagagacaaaggaagagaaaggccctcaaagccagacagtgggcagcccccattcccgggggtggggtgaggagctgcatttggaaacaatgtagccaaggacccaccaacacccgccccacctcccagcaggcgcagtcaaagcgctttagaaaagaagcgtctcaccgctcccaggcacagcctcagacagtcccgcttccaggtcctggctacacgacggcctgtgtgaagaggcatcgccttaaccagaaggagaattcagtgaacacatgaaaggaaaaaggaattcctgagaaagctatcataacccgcctgtgactaagacattttagatggcgagcaagcaggagaagcctgctgagctgacacccaccgagcggcagatcagacaggaaccgccctgcagctggccaggcctgccgtgggtcaagtggtgtcccaggtcccaccctgacacagtgcaatgggccagtggctcaaagaaagcccagcacccttcatgggaattcccaccctcacctgaagggctccaggcaccctggaaggcatgtgcctgcggcgtgcacatcagcctagccaagaggggacagaggcgtcaggcgggtgtgtgggtgccgaggtgtgaatttcactgagagggacaggcccaacaaagccatcagggggccacagagtggacccatgagcccctccaagtacagggcatcctcctccaaacctcagtgagtgaatgtgagcatggtggagagaggttccggagctcaagaaaccagcagaggggggtgtttcagaaggtttgacgggactctctccctgtgagctggcaatgggatgcaggaaggaggaatacagagatgaccgcagccagggagtccacatgtgccaaacctggtatttccaccaggagggtacctccaggcaactggccactgcgggctctggttcctttcagggactcggttccgggctccagtagagatcagctgggcaagaccatcgaggggagactgagccaggacccactgcgccctcttcagggttcctgcacttccacttcatgaaaagtccccacagcaatggcatggaggtcaaaggcccaccaatctttattggcagaaactgtgcctcctctcaaaagacagtgatgaggactgggtgtgagttctccagcgccgggggtgcccaagactcccggggagctactgtgaaatgcaaattcctgcgctgctggccacagggacctggtgccaggtcctaggctccagggcactgcccgcagacacagtcgcatggggcgatttttgaaagctctgggctgtgtggagagccaagctgcctgggaaatgctgctgaaaacgcacctgtgtctgcgtggggcggctccagctgatgacacccccatgcccagagctatcgttgggggtcatctgtcctgtgccagactctaggccttttctgggccctggagcacgtgtgcagcacttatagctaatgtcctggactgggccccgggccccttgaatccttcctcccctgccagagtgacaagcctggtggggtgcagaggggcccacaggctgctccccacccacccctggctcaggggccatcaagaccacattcccagtgtggccccagacaggatctgcagggccgggcctccactctcaggggtcactgagacctgcagcatccaaggaaagctggccacactctggggacatgggtgagcctggccaacctacctgccatgctagatgtgcacaaggtggggtcgctggtggagcgggacacacgcccgggacctggctgcacctgtgagcccatgccaggatcctctggagacacatggccagggggaagggcaggttcggagggtgctggggcgcccacagggccatcgggggatgggctggaacctggcgtagcagtgccctcggacaccaggaggcttgtgctgtcagctggtactgcaagagaagggacatggcattagagtgggcggccgcaggggacgctggcgtgggacaggcctgcccctcaaactccagacctagatgaactctgaaaccctgggggtgcggaaacactggataagattgacaaatgctgctttatgctgttgaaagttgggggcaccagatgagctcccagaaatcattccaggaatggcatggttcgggggcttagacccttcacactacacaagagactaaaagtcagaaatcagacactttggtcacaagacgctttggtctgggtgaacagggccagtgcaggggtacacagcagccccaagggacatcaaggcatccccaccaggtcgcggcaggccagatctcaggcccgcccttgcaggggtgcagccccgggcctggagtgcagccagacagggtggtgcaggcaggtgggataaactccgcccaccagacactggccttggctctcagggtgtggacgccacgccagcagcagcagcagccttgccctgggaacaagcggggaatgcagactctcagctggaccccagacccatggaagcagagactctggcgctgggcccagccaccggggttgaagcgagccctccagggaattctgatgccctccaaactgtaagaactgctggtctggaccgggatgctggtcagggctgggctcttgccgggaaccactctacgggggctggatcggagtctgttttaataccatctccacggggtgtgcatgcatgtgacagtgtgataagctgctcctgcactctcccctcccatcaccaggtgccctcagagccccctcctggcgccacagtggagttgcctgcatgggggacacttcatagatcacagaagcctggactcctccaggcgtgggggctttgggtctgttcctgccatccctttctgtttttccctgcgtctgtgagcctgcccatgggcaacaggcttttcaggccacctcccacttcatccttcctgtccgtctgtgaggcagccccaggttacccccaccctacagctgcagaaatgggcttagacagggaagggttgagggtcacacagccaccaaggtggtcctctactcaggagagtcctgacccctgtaccccagcagaagcctcggtgctggaagctctgctggtccctgggtcagctgtagagttcaccgcccaggtcccaggagggaggaagatccagccctgctgaattctgggtgaggagcacccctgtctatttccacctgccctgagatgggaaacaggaaggggctcaggtagcaccagcccccttcagcccaaaccctggaatgctgcaggtgtggccgccctgtgacagtgactgagatacactgtaccctgggttggccgtgggaaagtcactgaataccttcttgaacagcctctgatggcttggagtgaccaaaggaaggaaaagattgcttccaaatcccacgactgcaaagatgctgcgctctacaacccccggtggcctcagaaagatggctccttcctgtttctcttagatgctgagtgagtgttcagcaggggacagagcgccctggggcgatcatcctggccctctgtgggatcacatgagttatctaactttgttctccaaataagccagcccatgtgacccctcgcaggggcctcaagacggtggctctctggctcacttggcctccgtgccctttctccctctgctgctaagggcccttctgctttcctggagccttagaccacctcccccgccccggctctgcacgcgacacccaccctctgtgtctggggatttgacccttgcacacgtgtccttcaatgccctcaaggacatgacttccagcctgcaccctcctgccagccgcccagcccagccaccttcttcagagggaggtgccgtgtggacatttgcccggtaggtacaactttggctctggaaaggggaccctagatggagtcgtgctcttcttcaaatccatatccctcaagtgagaaagtggggcagaggaagacaaggtctccccggagagcgcaggagatctcctgcatatgctgactgtagtggatgcagacacaggaagaaatgtggggatatacagggtatttaatgggaaagactgctgcaaactccaccctcttaaagagtaagaaatggagggaggaggaggaaaaagagaagagaagagaagagaataggacgaggacgaaaaagagacacccttgaaaacaggaacaccccacttcaggagctgaaagaggtaagcttacctggagtgctgaagccagcactggtgtttgggtccccggagctggactcggccacctgctgacctatacttgtaacctacagtaagaaacagaaagcgtcaaggcggctggtccgtgggaacgcagcacagcagcctccagtagtgtaggcgcttaaacttgtctcctggtgggaagcgctgagagacgttcatccacacctccactcttctcccctacatttatgaggtggggtgtgagggttcaagttgcccttgccaaggccaaagtctagttttcttttttctttttttgagacggagtcttgctctgtcacccaggctggagtgcaatggcacgatctcagctcactgcaacatccgctgcccggattcaagcgattctcctgcttcagcctcctgagtagctgggattacaggtgtccaccaccgtgcccagctagttttttgtatttttagtagagatggggttttgccatcttggccaggctggtctcaaactcctgacctcaggcgatccgcctgctttggcctcccaaagtgctgggattacaaggtgtgagccaccgcccctggccgaaagcctatttttctgaacttttgcaatcagagagcctggcagggccacagagccacctgagcctacgagttgcacagtcatcgagcttttgtggctttcgatttctttttcttttctttatttatacattttagagacaaggtctcgctccatggcccaggctggagtccagtggtgcaatcatagctcactgcagactcgaactcctggggttaagcgatcctcaggcctcagccttctgagtagctgggattataggcatgagctaccacgccctgcttttttcagctttcttcttggatatactctgattccgcctggagaggcctcagaataaggggaaggctatacctcctctgctctctgccccatcttcattttgcccattctgcgtgggccatggtttccacctcagagggcatcagggcctcccggatgcgatgtttggatgtgatgccagctacacacatgttgcatgagcacccccatgcaccccatgctacctcagaaaacaattttttgaatccctgtgttatttcagaattgctttggggatacacttgcaaataatgagctccagaggagactgggaaggtgaggggggctcctgcgacttgctctgattccagctcaggtaattacatttctgcctcccttatctcccgccacttcaatcagatagctggtctccttcatctctcctcttcaaccaggctgacaccagggcgggggctggggctgcagccttcccacccacacaaagggtgtgagctgcccccacagcgtggggctcgagaggtggttccgagacaaagagaagacggagagctgcccaagtgcgtcctttgatctcactaagatgctttcgcataatacggtccatactatttttcttccttagccctctcattctgctgggagggaatcggtgagggagaattcaccccaccatcagcacccacctgctttttcactgaagtcattatgtgccaataaccagtcctggaaatctctgtccagaaccttccactgaatcacaaagagcgaacaatgtcctaacggtttgtttcatcctgtgtctcccctcccgtatctaaccctctctcggacttgcttttcttttggatcgtagacgggtggttaacttagaactccgctgtctaaaagaaaatcttctggtaataaagaaatataaataaaacaagagaaagaaaatatacagtgggacaaggtcaggaggaaactggattcacttcatgttgtgcagaagcatcattcacttccttctggctcccggtcagatttggtttccagaggaggcagctcctgggagcctatctatcacctctcgcaagcagagtgtcaagagtttaatttaaatgtggcccttccctgatgtcagaagccaccttgccacgctaagccatggggaaaatagcacttcctttcatacagcatttttgatgaactataacagcagtagaaaagggtggggaagaaatatatttgtggcatagaatttaagttgaaatttgagttcagtgaggaagctcataaacacagctccttacagaaggagagcggggagagggctgttgacaggagacgctgtgggaatcacttcacctgggtcttactggtttgcagatgtgctattctgaacagtcatcgtaactggaaaataagttggcttttcaacaaataattcaaattgtatgaagctaagacacttgcatggaaattctgccccattctgtagtttcccactcctgggtgaggccaaccattagaaacagatttatgaagagctcttcgtttggggcaattccagcgattatggaaaatgtgagttaaaattttaggctggtggctcaaggcaaactttgaagacactttgctaacagattttatgtggatcgtaagtgtcaggacctggtgctgctcctggactctgctggtccctctcccttctcacaactccttgtctcgcactcaggttcccttccacctggcatgctgccaccaaattaaactcctaaagcatcactgggtcgcacccaagacgccaaactcctcaagggcacttctacagtttgacatccaaagccataaaatatctgcccaaatgatttcagccctggggtgctgaagctcccacagccaggctccaggctgtcctgccatgcgccttagctggtgctgtgaccttcacctgcaccacctccccctccttcacacaccccagcccgacaagcccccccatatcacctccccctctacacgcaccccagcccacccagatcaccaggcccgattcctctgcagaagcctcaaaggagttcgtgtctgtccggtctccatgtgagagtgcgagagtgccacgacagggggattctgtcctacatcctctggagggccaccgtcgtcagtggcccctgaaccatacgcttgccacccagacaagaagatcaaactggtaatttctcaatcactttcctgctatcaaaagaaactcactccttgaacactggctgaagagtacagcctcaaaccacaggaaagagaatggcatctgacctaagccggaagggaagtgtgcacggcccgtcacccatgcgagtgctcacggagcccaccctcgtggaggccgccccctcttgggttaaacctcttccccagcacaccccctgccccgccccagagtcagctcctccccgacagagcccgccttctgcagcctcctctctttatccaaactgaggccgagggcactttctacgccatttgtcctaacaaggaggagcactactgaccctgcctcgcccgggctgcggggtcgtgctgtgaaggggtgctccttgctgtctagtcagaggggccttgctgcctggggaggggacagctggtggtgcagctggcggcacggccttccctctgtggacggtaatgggtttctttgacttccagactcccagacacggccgtgaattgaaaagtgctcccaggccatggggtcaaagacagtgggcccgagggctctagcggccccttcatcaccagatgctgccctgctgccaggcgggcgcccagggacaggccctgcaggcggtcgtgctgtgcccctgccagcactgggagctgggggtctccgagccaacacatgctaattcgagatcagcctctgacctttcagctgttctcaccgcagttctgagaaagagatctcaactgagagaattccccagagttctggagaagggtgtcgcattggtttcagaaccagccagatcccttccaatatattctattcttcagagaaaacagtaaaactgtgaacacaacaggaacccattccttccgggggccgctgtgaggtcagacattgaatggcacacccaggtccagaagctacttccagcaggcagggccctcgggaagccagggtctgggctccacggacaggggttcctgtcgtcaggaggcagaggggtccaaggggcagggagaaccgggaagcaggctcagagccagtcccagtgcagagccggaattgtgatggcagcaggcagggtcactgagcagaggcggtgaaggggacagagctgcccccgcgccacaaggcagccatggggaaccacacacccctgccgccttcaggggtttccgggtccatctgccgccctgcccggtgcccctgctggctacagcatggagcttcccattgcaccctcggtcagcctcccctctgccttcccaggggcttccctcacggagggccctgtcctgggcctgccatccccagtatctaggtccttccacatctgcctggtaacctcctcaaggtcctagatccacactcccctctacctaccatcccatcttctctcctctttaccaaacatcctgcgagagtgatctactcctgctctcaaagtgggagcagcagcagggctgaggcttttatacccccaacttcaataccccaattactgactcaggagccctgggggtgggcccagtcattaggatttgattatcaagttccccacagggacacccactggtgtctgaaaaccacagccacacctgcgctcccctgcgcacgtgccgtccactcctttacctggtgtggtccagccctgccctccatcgcatcaaagctgctctgccaaggccaccagcagcccctccatggtgcgccacgtggccctggatgttagcttctggacagcacctgacccattgctttcttccagaactgctggttttggcaaatccaggctcctgggagccctgcctagtgccctgtagcctgtcgtgtgtgggggtgcctttctcctgccacctgcaatggtgtcattctgtggggctccctctctcacatttcccaggccccagtgacagcggcagctaactctgatcactatgaactacagctcctgtcatctggtggacactcactcagaattcaacccaccacacccagacaggtcaacacccatgcacactcatccgagactctttacggacgaccttctgtttgggggatacgctgtgcctgtccttcttccctctgagcctttgcacaggctgttccctctctcaggagcccttccagccccactccctgcacctcgcatgcctgatgcccacccagcctgacctcccagaccttccatggacccccaaattgggcctgacatcatgacaggtgccccacagtgtactgggctccccttgcagtgctgatgacaactattatcacagccaactgtctccactgataacattgatttgaattatttttatcataaatggaaaactaaacaacattgggaaggcagaggtcccagctcagctttataaaaacacctaagaacatctccattactgccagttcaggaatgggatttcagggccatgcccacctcctgactaaaggattcctctccacaggcagctcccacacatctgcttctagcacccacagtaaaaagggggtcctggccggggctcagggggccactgtctgcagcctgcctggctgctccaggtgtttcagggtggctgcttggggactgtctgcttgtgtgaggatgtgctgggggctcacgggccagccggaagctgatctggcccaccacaagccaccctgaaggaggtccctgtggtatatatgactccccaggtgcggggcaccttacagcgtctgaatgcgctgtccatatatgactccacagggcacagagaagtcacatctcttcctgtcctaagaccaccctgcctgcaacggtgaccagtccttgtgggtgtgattgtcggaagggcttgtgagcttattcagccaacatggaaactgctcctccacccacagaagctcctcagggtcagcgctgccttggtcactggttgggacagggaccagcattgccacctggcttgcgtgcatgtgggctctcgggatctcaaagtgacagggagagcattgggggtgacatcaaaaggtctgaaccctgtgctagggtgtctttacaggagtcagcagacagcgagcagctggccaggcctgatctgatgcccggtaccagtgcctggccagtgatctgggtagagataaccatccggggctccacggctgctgagaagcccaaagcaggtgcagttctgggtgggcctggatgcttctggtcatgctgtcatctgctctcctctgcttgttgcttgggctcagaattggcttcagcccctacccccgcccctccctggtgaatctgcaagtctcccctgcccacgccctctgctccaactcactgctgtgttccccagccatgccccagtccccgaggcctccaggacctccttggccacctgtcacgggagttctctgcatttcctaaactggactgtcggcctctctagcaggattggggcaatgttcatggatgatatcctaaaatatgttttccagtcgtttgctttctctccctgtatttcagggacaccagtgagctgtcgatttggtctatttacataaccccatgttccttggagggtgggtccttggaagatcccttgcactatgggccacgtgacttttccagatgtccccatctctctgtcctggctagcagcattccacactgagtcatgacaacaacgatgatgaggaggaaacaataccccaaaagggtgactgacttgctgaattcagaacttcccatgttccaagtcctgttggctccattacggacaacatcccatttcgtcccataaccctggtactgttatgatcctcattttacagatgaggaaactgaggctccacgaacatactgcctgtcacgtgtcaggcaccatgaggctgcaggagtgcctggcatgcccagctcagagaaggctgaaaggacctggcaactgaggcacttccctggcctgaagcttcttggcctcagacaggaccagggatccagggctgctttctccccaccccagagggcggtgatggcagtgtgtgatcaagacaggccggggcgccctgggtactcggtccatggacccagctctgctcctgggggctctccccttgggtcaggagctgtcccaggtccttttacctggatcccagaccacctaccagcacaaagctcagacgcacctgggctgtgactcgtggctgcagaaatggaactggggatctaaggggaaaagcaccagcactgggttccccaggcccgggctggcgtctctgcaggtgccgctctctgagcctgtggcctcatctacagcacagggctgataagaccaacatcccacaggtttgctgaaaggcttcaagagagatgaatgcatccgggggcctcggcacagggcgctcatgagtgttcacctcacagccagctcggacctggcgcggtgtgaggtgccttccgagggcaggccgggacggtgtccctagcattcccacgggaactggctttgtctggggccccaggcctcacctggctggcagggggctggcccaccaccgcctcgtacggaggggggagctcagcaggatagagcaggccggggctattgatggccacgtcatacaaagtgccgaatggagacggagcaaagtccaggtggaggcccctgaaaagacagaatcatcacatcgtcattgcccgaaggaggaggcagaagtgctgacagctctcaaagccgccagagcaggggcggccagggcttcccctcttctaatacttcccatcattgtgaaatcaaagcttcagtcactgggcgatttgcacttttgttttttttttttttctggaacgacatcaacattttcaataaactctactgacctgtccattaaaattcaaataatcatacagctgattacatctttcattaaactgtacatgttacacaaatgactgcaacgtgaccgcagctttgcacgtcatgagaacttaaggcagcaacacctgtctgcctccggcttctttcgggttgcgttgcaaaggtgccacggggaacgctgtatgtctaagaccctctccttccactgcccctcctctgttctcaccgccatgcctgcaggaccactgcaactcccaccacccggacactgctgcccatcttagtggtttcgagatgggggcagccgcgggagaccaacctctgggcctcagtggacggtgtgcaggtgtactctggggggtaatagggtggaggcgggagtggggggatgaactcgtcgaaatccagggtctggtggagaacggtgccgtgaggagtcacgcaggtggggttggcaggatgtgacctctgcggaaggaactggaaaacagagacaaccacagagttatctgggacatcttgtgtggcttgtgtctcattaagctaattatacgagagctttaatgatcagtttggaatgcctgtaatttcaactgtcaagccatgactgctaagcacacactttaaaatgaaggcgccaggaggaacgcctcgtctcagaagtctcaaaacgctttgttgcccacgctgttatacagaatgcctctttttaaagaaaacatatggtctgggaagtctttcatgctgtccctaccactccaactggcccctctgatgacagtactcaaagactgcagacggaaggctgcctgacgtgcgtggtttaagacggcacttcggctgggtgtggtggctcatgcctgtaatcccagcactttgtgaggccgaggcgggtggatcacctgtgatcaggatttcgaaaccagcttggtcaacatggcgaaaccccgtctctactaaaaatacaaaaaattagctgggcgtagtggtgcatgcctgtaatcccagctacttgggaggctgaggcaggagaactgcttgaacccgggaggcggaggtggcagtgagccaagattgtgccattgcactccagcctaggcaacagactggagtgtttttgagactctgtctgaaaaaacaaacaaacaaagacggcatttctcaaagtgtgttcatgagaaaacactagaccctcccctcgaaatgtccccaccccaccccagaattcccgtggtcaatctgtgggaaatgccacatgctcccttcttggagtcctgcattgtgcattcgtgtgttaaaggctctgagaagggctgtgctgaagtacttatttagctgtttaacattttaacccagcatttctcaaatatttcataatgggcccctttggacacgtagtatctattaatattttgcagtctcaggatttcacacagtttgtaaaacactgctctgaggaaagagagacaacttcatgagttccagaacattctactggccaaccttgaacaccgagatgctgctttaatagtgaggtgaaatcactttaacaaaaatgaaacctgtttctgcctagttttccgtttctgaaggactaaccaacaaccaactgcttttctttccaccttcacatctctgctgcccagaggtcacctgtggcgtgagatgcctgggacattgctccagctccagtcaatgccgccctatgagtgtctacacggcaagaagatccatgctgcaaaagctctgggccaggggccctcctggcgcagggcaggtgaggtaaggagaggaagggtgagtgcgtgtgtgtctgtatgtgtgtgttgtgtgtgtgtgtgcatgtgcatgtgtatgtgcatgtgcatgtgtctgtgtatatatgtatgtgtgtgtttgtatgtatgtgtatgtgcatgtgtatatgtgtatgtgtatgtgcatgtagatgtgtgtgtctctgtgtgtatgtgtatgtgtgtgtatgcgtgtgtgtgtgtgtgtgtgtgtgttgaggggaagacagggacccagaatcaccctacacaagcaaggacagctccattagaaaacagtgaggtctccaagcactgtgtggggactgcgctccccaaagcattcatgaagaacgcatctgaacgggtcttgaaagattggtgggatttcatctagtgggcgctcagggagacactcaagccccagaacaggtgagccagggaaggatgtgtttaagaaaagcaaatagataaggctctggaagtcaattcttaattctggggcactggggagcctgtaagggtgttggagctggggagcagggggactggagctgcgtggtaggaggtgccttctggcagcaggggtagggtgggctggagctgacagaggccaggacgtgaagcacttttgcacgggtatgggtgaggtgacgattctgaatggggtcaagcgctgtgaaataagcatgctctaggttgacgaagaaaggctggtggccgtgtctaaaggtctaacacatcacaggaaaatggctcccgtgggcctcctaacacacggagcacactcctcgcctctctggctggaccgacccacggctgcgtgtgtttaattgtccgaaacagaggtgaatcatccgctgtgagcgggacgcatgtgcgtctgtggtcctccgccttggaggctgtcagtcctgatgcctgctgcacagagctgagaagcagggcgagggcaaatgccctcaggtctaatcaggaaatattttcaattagtctctatcagaaattagaaaaaatatcaatgacatacccaagcaaaactaatgacatgcagacaccaaaacactttccaattcaaggcaccattccaccaggaaggagaacaagcatttgaggaggggcagaggtgcaagggaccctctccgcaggtgcaagtgagcagaggctgccacacactggaggctatgtaaaggtcaaaggacgcggctgcatctgctccgggtcgcctttcggggacatgttggccccaccttcctggacccttttcccaggaatcctttgaccttgactcctcagcctccccagcgagaatcctgcaagtggcgcttgacgtctcccctctcttccccaccatcagtgtgtgtttaattaggtctgggtgtgtctcgcggcccagggtggccagctctgtcctctgctctgcaggctggggctggaggtctgcagactacgcttcccaggctgccgtgcctgggctgccggcaggctctgcctgtagggggtgccagagggcacctggccggcctgcggggcgaggagggagctgcgggtttcctgcgccttcccacctcctcccttctgttccccggctttgcgggctgagagctgccctccgcacttattccactctctgtaagctcagcaccctcttctgttccttcagccttccacacccaagtaacctgctccccgtaactgtgttgaaatcctaagggcaatttcttttcctgaccatctggggcacatctattttacccacctctgtacccgtctcacaatcgcacacagcgggtactcagtaaacttctgcagaggagacgggcagacgcctccttgcggggcaactccactcagcccctgtccacctcctcctcgcaggagcttctaacctgtgtgcctctctgccttgattttctgtctctgtaatttggtcgccatcctgctaccacagctgtttttaaatcaatctgatgaggtcactgcagttgaaaagactttaatgagaccctggctcactgaactccatctggtttccagcttcctaacccagcgcccccaaactccccgctctttgaacaaaccagctctaatccctactatcaaacacgtattgttccttcttcccagctccccacctccctttcacctggcgcctcccagtcaccttcaggaccagcggaaatgcctgtgaccctgaaaagccagtgggcagccacccctcccccatcccacccaagctccaggctctgcagcctcacctgcatgttgactgccaggtataaagctcaactctgcacctggaggtggagggcaaaaaaggggctgtgaacagtcccttctttcccaggtggctctgtttgccctgatctgtaactgtcttctctgatccatgtggtgacaaaggtacacctgtgtctggtgcccagctggggctcatgcacccgatgtgggcatcactagtgcccagggctgtccccgcacaacaggagtgaggatttgagaccccgctggagaagagcccctgctcagtctgctccggggagaggggatccgaactcaggtgtgtgctgtccaccttctcaggtgggtgcacgtggaagtgatggaggatgagaactaaggctacctggccttgggcagcttcccaaagcccacttaacacagagccccgaacatttcagtctatccacacagcccagagtctgggatctgagggagatcgtgaagaggtcaacctgcctgggaccgggagtcagaccgcaagtcagttgtctctgggccctgcctgggcactgagggcccacaggatgtgagcacatttctgatcctgtgagtctcagtccccttccctgagaagcaccattgctcacacagacccagacagcagtgctgtgtggctgaaaggaaggcttggatcattagtatgagctcatccagcccatgcctccatctcctgccatcgggaacaaggtggggcagggcaggcatcaggggtctgtggacaagggccggggatttgcagaaacaccgtggagctctgagctgcctgttcctccaggtcccagccgggtctgctcacctccctttatatttagtggtttcctgcccagcacccactctccctgctccctctaccaatgtccttgccacatcctggctcctgaagggagcacacacacctctgaatttttccagaaagactcagaattacagggaagggccttctccctctgccttccttagacttggtagaaacagcaggcttgttactaccgaagtttgctgaatcaacttcctcctggacaaccctgcagatgagctggagctcccgctctgcgctccagaccctggggagagcccgccctgcggccccctggtcctgccgccacccccaggtaggttccatgcccacccagggctccagggtgccttactgcacagggtgaggcctgtgttcattatgactgtaattgcataaggaaatagggatgcagacaggaagagctgctcgttctgtgaaaaccaagttgaatgctttggaaagactcaataaaggagggcagccaagcagaaaccgctgccaagtcaagtccaggcaaggcaggtctaagagcagagaagaatcataaaaatctagggaaggtctgtctcccctggctggcttcccctggctggctccactttagaggaactgaatctgaaaatcattgatggtgtgatttccacaaactttctgcaagaaatacacccagacaggacaacagacccataaccaaagggatgaccacagccccaaatgagatgactggttgacagatgctcattagcatatctgacgtcaaagaaaaacgattgtgtgtccacatcatttttatgattgtctgcattagctgtttggatgaagttcctggtctgatagataagtagcacctactgtccagagacaattctgtggagcccaggcctcaaggacctcaaggttactgtgggtccccagagtgccctctccagcaggtgcagccagtgctggggtgaggcggagagaagacactggtgaacttggtgatgctgtggctcccatggggtggtgtcgtgtccctgaccagccagcaccgcttaaccagctccatgggcaaacccacagttaccacgcgatggaaggcacagtgccccctctgcactgtctaaaggaggtcaactctgtagggcagacagctacctaaatgacaataatgaaagatgaagttaataagcgcatgcctaatggagatacatgtcatagtagatgatattcctgaggctgcagcagctggcgaggaagtaagtgaagaagaaaacaatgtatcagaaaagtggaagaatgagatgacatttaaaaacaaaaaaaaaatgacattacagacacttaaatgatcaaaaaccttttctgctaaatgatgtcaatcaaccacattgtatcatcagaatgtcttttgccacgatttccacacatattagagtagctcagcttcatcagttctgacaataggcagaacgctttgcttctcatggatacaagcatgcattatgctagttccatcggcagttaatgatcccaaattgctgatccacagaaataagatgggagtttcaggttctttggagacttgttcttgctattcctagattcccaccagcactggacacatagcaaagcccctgagataattgctgactaactgaatgaatgaatgagtgagcaaagaagtgaacagatcagtaaacacaaaactgggactcttcctgaaaaatggttacggctggaattttgatcaattgtgtaagttgtcagcacatcaatcacaatagaaatcacagcctgggtccttcctgctaacatggaggagcagggagaggggctgggaaagtggggctgagacccgcacagtggagcagagttgccaggctgcagggctgccttgggggcaaattgggaagaggtgctccttcctgtgggaggtcagggcatggctgtcatcccctcagcccagcacccctctgtagggcgcagcacaacagggcaccagagaagggccgtgggggctggagctgtggctcggggggcttcccacaggttctttctgagaaaagaaattagttgattgggaaagggtggccgaagggcttacacacacttgcccacagtgaccttcctccttaattatgctccctttataaattagtgcttctcacttggaaggtctcagatacaaataaacaccagaaatgaagagttagtacaaccaaagccacaactgaatgcaagaaatgaaaacccgctcagaacaaagaggccgacatacaggaaggtaaagaacacagaaacagcagtgagcagtaaagcttctataaaattaaatctaaaggggtcatgaagatgtgaagggatgctgtgatttaagggctaaggaggagtgacatagaaaagacatcccaaagagcttacactctaacacatttcgcctggaactaaatgactttaaaccaccgcaggaaaacccagaagctggccatggtgtgggaggaggagggaagtgacgcactccaaagaaatgacagggtaagaagaaagtcatgctgaggaaagcacaaaacaccaagacacacagatgccaagagacgccttcttctctgggactagtggttgcctggttaatgaataagaaagttatttaaagtggggagtttcacacacacatacacatgcaaacataatacatacatactgaacccattttactttaacttaaatcctgtatatgtggagaaattcatagaaagacacaaactaccaaaacagacttgagaagaatagaaaatgtgacaagagattgaattagtaataatacaactacccgcaaggaaaagtgcaggctcagatggcttcactggtgaactctatcaaatatttaaagaagggccgcgcatggtagctcatgcctatcatccaagcacttggggagcccaaggagagagggtcacttgagcctacgagttcgagaccagcctgggcatcatagagggaacctgtctctacaaaaaaattaaaaaattagctgggcatggtgacgtgtgcctgtagtctcagctacttgggaggctgaagtgggaggattgcttgagcccaggaggtagaggctgcagtgaaccatgatcgcacctctgcactccagctggggggacagagtgagaccttgtctcaggaaaaaacaaacaaaaaaaaacatttagccgggtgtggtggctcacacctgttatcccagcactctgggaggctgaggcggctggaccacctgaggtcaggagtccaagacaagcctgcccaacatggtgaaaccccatctctactaaaaataaaaaaaataaaaaaataaaaaattagccggatgtggtggcatacatctgtaatcccagctactaaggaggctgaggcaggagaatcacttgaacgtgggaggtggaggatgcagtcagctgagatcaagccactgcactccagtttgggtgacagagagactccatctcaaaaaaaatttaatgaataattaatacaaattcttcataacaatcttccaacaaacggaagaggaagaaacacttccaaactcttctattaatatgaaaaggattacttatcataaccaagtgggatttatctcgcaaatgcaaggttggcttaacatcagaaaaatcaatctgtgtaattcaacatattaatagaacagaggacaaaaaccctatggtcatctcaatagatgcagaaaaagcatttgacaaaatccaactttctttttgataaaaaagacccaacaggctggacacggtggctcatgcctgtaatcccagcactttgggaggccgaggtgggcagatcacgaggtcaggagattgagaccatcctggctaacacggtgaaaccccgtctctactaaaaatacaaaaaaattagccaggtgtggtggcgggcgcctgtagtcccaactattcaggaggctaaggcaggagaatggcgtgaacccgggaggcagagcttgcagtgagccgagattataccactgcactccagcctgggcgacagagcgagactccatctcaaaaaaaaaaaaaaaaaaaaaaacaaccaacaaactaggaatagaagggaacttcctgaatctgatcaacagcatctatgaaaaacccacagctaacatactacttaatggtgacagactggatgcttcccctagatacaagctaagaaagtccactctcactgcttctattcaacatcgtagtggaggttccagccagggcaatcaggaaagaagacaagatgaaagacatccagagtgaagtaaactgatttctatttgcaggtgacatgattttgcatatagaaagaatccagagaaaagcccaacaacaataaagctcaaaatgagttcagcatggtttcaggatatgagatcaatataaaaaatcatttgtatttctatatattagcaatgaatgatctgaaaatttaattaagatagtaattccatttatgatagcatcaagaagaataagatactcaggaataaatttaacaaaaaagcaaaacttgcacactgaaaaccgtgaatataactgaaagaaattaaagaacatctaaatgaatggaagggtacctcatgtccataggttggaggacttactattgttaagatgacaatattcctgaaactgatccacagattaaccacaatcctcatcaaaatcccgggtggattgtttgcagaagttgacaaactcaacctaaagttcatatgaaatcaaagggcacagaatatccaaaacaatgttcaaaaactacagaactggagggctcacacgtccacacgtcaaaacttactatgaggctacagcaatcgaaaccatgtggcactggcatcaggacagacataggtcaatggaatagaattgagagtccagaaataaacacgtatatctatggtcaattgagtctgactaatgttaccaagaccattcaacggggaaagattcattttttcaacaaatggtgttggaaacagaacaaagctggacccctacctcacacagtgtataacaatgaactcaaaatggtctaaacacctatgtgcaggccgggtgtggtggctcacgcctgtaatcccagcactttgggaggctaaggcaggctgatcacaaggtcaggagtttgagaccagcctggccaacgtggtgaaaccccgtctctactaaaaatacaaaaattacctggggtggtggcacacgcttgtaatctctgctactcgggaggctgaggcaggagaattgcttgaacctgggaggcagaggttgtggtgagccgagatcacaccactgcactccagcctgggtgacagagcaagactccatcttggggaaaaaaaaaaaccaaaaaaccctaagtgtaagagctaacagtaacactataaagctcttaggcattgctttcttagatgtgacaccagaagcacaaacaactaaagaaaaaagcagagaaactgaacttcatccaaattgaaacttttgtgcatcaagtgaaaagataacccacagggtgggagagaaatttacaaattatatatctgataagggggttgtgcctgaaatacagaaataacttttacaactcagtaataaaaagacaaataacccaattttaaaaataggcaaaaggtctgaaaaacatttctgtagggaaaatatacaaatagccacaagtgcatgaaagtatgttcaccatcattaattatcagggaaatgcaaatccaaaccacaatgaaataccacttcaccaccactacgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccacaatgaaataccacttcaccaccactaagatggttacaattaaaagaaagatcataaatgttggagtggatgtgaagaaactggaaccctcatggtctcacggtgggaatgtaaaatggcacagctgctttggaaaacaatcttgcagttcctcaaaaacagaatcatccttatgacccagcaattcccctccaaggtatatactcaagataaattaaaacatatgttgacacaaaaacttgtacaaggatgttcataacagcattattaataacagccaagaaggcaaacagcccatatgaacatcaactgatgaataagcaaaatgtagtatactgatacaacaggatatactgttgagccgtaaaaaagaatgaaatgttggtacatgtagaaacatgaatgaaccttgaaaacatcatgctaaatgaaagaagccagacacaaacggccacatgttgtatcattcaatttatatggaacatgcagaacaggcaaatccatggatacagaaagtagattagtggtttcctagggctgagaggtgggaaggaaatagggtgactgctaaaggctatagggtctctcttggggataataaaaatgttctaaaatggattgtggtgaaggttgtacaactctgtgaagatattaaaaccgctgaattttaaatggaggaattgtatgataggtgaattgtatctcaagacagctgttacccgatcccccatctcacagatccctggtaaaagaaaaaaaccatttataaagtgtccctctgaatccacaaggaattgcttccagaacctcctctgccactggatactaaaatcggtggagggtgaagtcttttacataaaataatgttgtatgtggacataacctacacacatcctcctgtatactttgaatcatctctagaatacttctaacacctaatacaatataaatgctatggaaatagttgttatactgtattgttttttatttatatttttgttgttgttttgttatttttattgtgttttttccttgaatagtgtcgatccacggttggctcagtgggggctgactgtacatacatggactgacctttttctgcctgagtaaagccttttctgagagtcagtctgctgtgtggagtgcctcgtggtctttcctgcataagctgcatccataagacatgaatctaacaacccttttctgtgtttttaaagtggggctagagctgaaaggcacttgtcaagcaatgtgtatgtggactccctccagatttttttttaatttttttttttttttaagtctcaatctcgctctgtcgcccaggctgtagtgcaatggcacagtcttggctcactgcaacctccgcctcccaggttcaagccaatttcctgcctcagcctcccgagtagctgggattatcggcatgtgccaccatgcccggctaatttttgtatttttagtagagacggggtttcaccatgttgaccagggtggtcttgaactcctgacctcaggtgatctgccggcctcccaaagtgctgggattacaagcgtgagccaccaggcccggctcctctagatttttatcagcatttatcgcaaccgccatagttgtctcacttgcatctaatggacagcaatacattcagcagcaccccctttcaccgaacctttccaaagaactcgactgtgctgtaccagaaacaattatctttctgcactcatatttcatggctttacatagtactagaatatgtaattacaacaaatatcactggcataaactagttaggaatagctacaactgtcccttggaaagctcatggcccagcttcctggagcagaaatggcgcaggggtgaactgcggaagctactggtagggaatggttcgcacagccagcctggctcaagcctcggcccacatggcaagagccgacctccatgtggccaccacgttccttcaaatcccattcccacagatgagcggactcatcccatcagcagctctgtgaggacagcagggcacacgcttcatctttagagccgaggaaacggggtcccacaggcagtgatgtgcccaagattgtgccagtcccatagggcgccatggccaccctctgaatccacagggaagtgtggattcacccaccaccagctctcttttgcctcgcccatgactctcaagcccggcagcagagccgggggtctcatcacgagagcagagccttgggctcccgcggtacccgtcacagaccggaaaggatgtgctggcaggaagccggatatttctgcttccaagccagggtgtgaggcaaactcacccacaaagtactcagcgaggaaacaacagggcttctgacggcagccgctgtcgccgcagcctgcctttcccttgcacagtattttctgctggtaaagagcctcagcccaccgcgtctgcagacattgctgcgacgtcccagtgacagactgatattccctacacatttcaaatccaacacatcacacgtattagggatctccaggcatcccattcattccacttcacaggtgaggaaactgaggcacaggtaggttcagtgacacacccagagtcacctgcctcgaatgcagaagaggtgggactcagaccctggagcgcctggcttgagaagcacggctccacgcctgctcatgccccacccatcacaactacagagcgactctgcacactgctgttatactcgtatatgctcttataaagagaatttactttattcttatttagttggcaattttcattttaaagcataaaaccaggagaatgcaaacttttagcatttacatgcctttagttctgtaagtttggtcaaatggatgtgatatttacagatcaatagtaaaatctgctgaggtgaggagaagcccctggtacttaacctttcctttacagaacacgttggagaaaattgccaacatgaggccccgatgaacaagggcagaagttcaaggctaccttagaactgcttaattagatacctttcagaaagggcagcctggctgtgacagctgtgtggatatacaccgggagggagagactcccatggcatgcaattaggaccaaagaatttttaacgtcttggtaatgatgctctctggccctgtatcttgattaactggatgttgactgccacagggtgaatgacaaagaagagcacattaaaaaaacccactataagaaccagctgccttttcttgcataagatgcataaatcattgcgtgggaagcagcgtaggtctcaaaggggcaaattgagagacagagagacagaaagagaccgaggcagaaagacacacacagagacagagagagacagacacacactcatacacacacacacgcgtgcgcatagatattcctacccttaccatggaagaacaatattttttcatcaatttctctttgttgtactcagtagcattctgatcagtaggctgtgttccattcacattgaaacaggaagagcgttcattatttatgagatgtgtatttataaatgtgtattaataacccacatattataacatgtgttagtgaaccatgctccgggcctcctcgctgcccctgggagtgacaggtcttcttgtgtatgaccctgggcaaagggtcaaatgatggccagtgactggcctctggagtatgagctcagggttcattagcaaatcaaaaatgcacaggttagcaattttccaactggaaaagaactgatcttctaacacctctaaacttcccggattaaaagagaattctgaagcccgaggaaggcaccttgctttggaggtgctgggtccaggggatgtccagggctgcaggaatttcactacatgactcaagggcacatgccaggggccatcctagagaacacgacagtggcagaaccctgtcaatatggagctccaacaacacctaaaataaatacatcagcggcgccacgtgtgcagatgcttggtcttccagagggcaacacaaggtggcctccaggtgccatggactgtcaggggccgctgtcctcacagcatctggctgaagccagaagcgtccactcctacactggtttcaaaccgcgcagaggaggaggggatcaggccactcaccatctgcaggacatcggaggagaccatctgcatacagcacatggctgtggccagcgcacacacgatagtggacaggacgttgagggcacacacgctgaagaggagatcctgcgaggaaaggtgcaggagaatgtcagcctcatcccgaaatagatagcagaatccttagccctcctgccagggcccagaatgagccgaggtcgatgaccatccacttcatggaggttttgttttgtgtgtgtctgtgttttcctcataatcaaaattggcctttcatagaaacacattcgtttattccgttacaatgatgagcaaagtattcataatactcaacaatgtgttttacaattttgataattattaggtagtcagtaacatgtctaaggaaatcataaggtggccaacatttaaggaggtgggccatttttatcaaacacaacctataactcaagtgaaactttttatcttgagataattgtatattcacatgcaattgtaagaaatcctacagagagatcttgggtaccctttactcattctcccttaatggtaacatttggcaaatctatagtacaatatcacagccagatactgacattggtatagtcaggatgcagaatagtcccatcaccacacgggtccccccagtgttgaccttttatagacacactcacctccctttccctgctccccatttaacccccagttctgatcccctgtcaatcgctagtctgttctccattttttataattttgtcatttcaagaatgttgcataagtggattgcacagcatgtaacctttcagaattggctttttccactcagcataattccctttagactcatccaggttgttgcatgtatcagtagttgacttctttttattgctgagtggtattccaccatatggatgtaccacattggtttaatcctcaacaactgaagaatatctggttttttggtattccagttttccagttgtgggctattacaaataaagctgttgtgagcctttgtttataggtttttgtgtgaacataagtttttgtttctccgagataaatgtccaggagcacaattgctgatttgtacagtaattgcatgtttagttttattttaaaaactgaaaaaatgccttccagagtggctgaacaatttttaattcccaccagcagtgtatgagtgattgggtttctctgcatgattgccaacatttggtgtcactgtttgtgttttagctattctcataggtgcataatgatactcctttataaaatgttttattttgcatttccctgatgctaatgatgtcgaacatcttttcatgtgcttatttgccatctagagatcctctttggtaaaatgtctgttcatgttttttgcccattttctaattgattgtaatgtttacttttttttttttgtagtgttgagttatgagagttctttatgtattctaggtactagttctttgtcagataggtggtttgcaaatattttcccccagactgtagcttgtcttttcatgtttcacatagagtcttagtcagctcaggctgctattacaaaaataccatagaccaggtagctctaacaacagtcacttctcacagtcctgaagtctggaagtctgagatcagggtgccagcctgttggattctggtaagggcctgcttcctggttgaagatggctaatgtctcactgtgtccttgcttagtgaaaagagggcaggggagctctctggtgcctcttttaaaagtgtattaatcccatcatgtggaatctaccctcatgacctaacaacctcccaaaggccctgcctcctattaaataataacatattgggaattagaatttcaacatatgaattttggagggacacaagcattaagtccattatatctgagtttttaaagaacaaaaaattttaatgttcttgagatccaactgatcaacttttgttccatacttttggtgtcaagtctaaaactttgtcaagccccagattgtgaacagtttctcccatttttttctgaaagtttttatagtttcatagtttgcatttaagtctatgctccatttttgttctgagacagggtcttgctctgttgcccaggctggagtgcagtggcacagtcatggctcactgcagcctcgaccttctgggctcaagtgatcctcccacctcagcctcctcagtaactgagaccacacatgcataccactgtgcccagctaatatcatccattttaagttaaattttgaataagatgtgagttttaggtttaggttcctttttatgtttttaatttcattttccaaatgttgttagtacatagaaatgtgattgatttttgtatgtctatgtgatatcttgagactttgctgaaattgatatcttgggactttgctgaaattattagttctaacaattttttgaagatgccaggggattttctgtgtagacaatcaggccatctgcaagtgttttattgatttccttccattttattaccttttattattattattgttctttttttttgcctcgtggtgctagctagaaccttgagcattataaataaaaatataagatgactaagatcatgaaagcagacatctccatcttgtgctcttagagggtaaacttgatggagttttaacagtcgaagtgcaatatagccttcattgagaagcttactctcaaatccatgtcagaaatagaaaaaaaaaagatttagaatgatagtatgtccttcaattaaatcttttcatatacaagtgtacaaaatactggacacactcaaaaagctatcagaaaacatgaatctttcaccacaaaggctatggcattaatcagattagtttcagttatctaatcaaggggttggcaagtgctcaagaggagacggggaatgccaccctcactgacatgctctgtgcgtgtgctaggatgtgggcacacagagtctagcagcatcctcagggctcgttcatgtatacatgagcccatgtgttccaatctgtaacatcctctggacaattccctgttctcctacaaacatcactgcccaatccccttcctcagaagctgctcatcagttctcaagcccacactgtgaaacagtaaagaagtgtgattaggataatatcatggaaggtggttaacatacagtgtttaaacactttcccaagtttatagaaccccatgcacatgtgaaggcagaaaaatgagtcctgaacttaagaagcgttaggcagaaccggccgggcgtggtggctcatgcctgtaatcccagcactttgggaggccaaggtgggtggatcacaaggtcaggagatcgagaccatcctggctaacacggtgaaaccccgtctctactaaaaatacaaaaaattagtcgggcgtggtggccggcgcctgtagtcccagctacttgggaggctgaggcaggagaatggcgtgaacccaggaggtggagcttgcagtgagccaagatcgcgccactgcactccagcctgggcaacagaacgagactccatctcataaaaagaaaaaaaaaaaaaagaagaagcgttaggcagaaccaaggcaaggctcagtttagggctaactattccccactttggaggtaaggcctatccgagtccctgaatgatgtgggaacaggcactgttcctgtgtgagcaccaggcactgttatcactaatcctttcaggcagttcttttcccagactcaggtcgtttcttcatatgcacgtgctaaccagcatccaactgacaactccaggcagaccctctgaagacccccatgtttctctcctggtgcagctctgccctcgatggtgctctgtcctaagaactcttgtctccaggccttgatccccctcagactctcagccctctacgcccaccccagggagtctgcagggaccctgctgtgttccctttccagcactgaacctggaaactgtctcaaggcagtaagctggggcaatcgtagggctcacctcatttatcacccacccctcagggatcagggttcttcattgcctgatagtgtcttcctacactgtgttcattttggggggctgtttcaggcaggaggttaaatccaatgtcctgctactccatcttggccagaagctcttggtggcttttttgtttgcgttttctaatgtttgtagcaggactaggcggactgccttagggatcctactataggcatctccactgccctccctgctcctacagctgctagacatggagcaggatgggggcttagttgtggcaaacagcaggcacaggtggggctggagggaggctgaggagcctagattgtattttgcaggtaatggaatgccactgaagatgtgtgatgctgggaaagaggtcatacaacctgttttttgttgttgttgttgtttgtggtggtggtggcgtttttgttttgttttgttttgtttttgagatggagtcttgctccagtccatgctggagtgcagtagcgtgatcttggctcactgcaacttccatctcccaggttcaagcgattctcctgcctcagcctcctgagtagctgggtctacaggtgcccgccaccatggctggctaattttttttgtatttttagtagagatggggtttcaccatgttggccaggctggtctcgaactcctgacctcaggtgatccaccctcctcggcctcccaaagtgctgggattacaagtgcaagccacggtgcctagcccatgcaacctgttttgagaattgattgagaaagacacctttgcagggagggcctagcacagaactatagatggagtaaacatcggttgaagtgagactggacacagggcagtgacccgtgaggcggtaccggagaggagtcaagcagagcccaggaggaggcatgcagatgccggtctgagggtgactctgaagttcagaacaaaagggcgtggctgtttactggagtaggggagaccgggatgagggtgcagatatagtagaaagatgattctggtgagtggaaacatgagatgcctgcgcgtgggccagggactgtgggagagaagcagtcttaacgaacacctcagcaggccaggcgcagtggctcatgcgaggcgggaggatcacttgaggtcaggagttcgagaccagtctgaccaacatggtgaaaccccgtctccactaaaaatataaaaaaattagccgggagaggtggcacatgcctgtaatcccagctactcaggaggctgaggcaggagaatcggttgaacctgggaggtggaggtagccgtgagccgagatcatgccattgtattccagcctgggcgacaaagcgagactctgtctggaagaaaaaaaataaaaaataaaacacctgaagtggtctgggacatgtggaggctgagttaccagtgggcctgacccactgagatgttggcaaatggttggaaatttggggctggggctgacgatggagatcagaactggaggtgtggaccaggagtcatccctacagagttcaaatgtgccttcaccttgcggatgtccttgatgtatctgcgggcccctgtgtgtcctcattcccctctccagatccatcagacttcaggggcctgggggcctccgcaggctccctacagaagagggcatttctttgatgaaattaccattctcacctcaaagatacacctcagcatagttttcctctaagtgacatgaattttgtgctggattctagaaaactgacagatttatccatgtgcgcagtagctggctgagtgccttttctctcctgtgaggaagagcttctaaaatgtcttaaggctcagccagaagctttagcacatttttgagcaggaagttggactcactgtagtcttaaaacaatcctgctggtgaatgaagtcataattagaactcttaagtatgtattttatatatctcaggagaacaattcaaagttataactaaaatagcgacatcttttttttttttttttgagatggagtctcgctgtgtcgcccaggctggaatgcagtggcgcgatatcggctcactgcaacttccacctcccaacttcaagtgattctcctgcctcagcctcccgagtagctgggattacaggcatacgccaccacgcccagctgatttttgttatttttagtagagacggggtttcaccatgttggccaggatgacctgaggtgatccagccgccttggcctcccaaagtgctgggattatagacgtgagccactgctcccggccaatagcgacatctcttaatgtaccattgctaaaatataagcaatacctttactttgtcctcaatctagaaatttcaactttattgaccacataatccactgtcatttaaatgaatgcctttctacaaataatattaatttcgcatatgctaccaaatgaaactactcacagacagaaacaccaactctgacctctgtttgcatacgcatcatgaggcagcctgctttacgtctcatgaaaggtattcatttgaaatacatgccagaaagacttttcccctccagctgtttaaatacttgatgtttttctaagtaaccgcaaaccacctggtattgcgtttatgtgtttcttcagaattcttttttggcttaaatgacattatctctgccttttttttttttttttttgagatgtagtctcactctttcgcccaggctggagtgcagtggcgtgatctcggctcactgcaacctccacctcccgggttcaagggattctcctgcctcagcctcccaagtatctggactacaggagcacgccatcactcccgtctaattttgatgtatatttttttaagtagagatagggtttcaccatgttggctaggctatctctgctttttgaaagttttatcagagtcctttacaaatactgaaatccacattctataaaattcctttacaaggtgattcaaaacggcgaatatgagagagaggcgggtctttcattgctgatactgagttttgctactggatattctgatgttattagctttttgatgttattaatgttataaagttaaggaagttatgtatctaataaatgatgtatagaacaaaaacaagagaaaaaagttttagatacttgggcaaagctacagttgataaattattttgaaaatctctccagtctacgtaagttatggatattaataataagattaacagagaaaagcgacagcaatgacaatgtacatacatatagcctacacgttaaaaacattaaacagttcaggacattgagcgggtcgtggtagtgtatctggaattggtgggttattggtctcactgacttcaagaacgaagctgtggaccctcgcgctgagtgttacagctcttaaaggtggcgtgtctggagtctgttcgttctgatgtgtttggagttttttctggtgggtttgtggtctcgctggcctaggagtgaaaccacagacctccgcggtgagtgttacagctcttaaggcggcgtgtctgaagttgctcattcctcccgataggttcgtggtctcgctggctccaggagtgaagctgcagaccttcacggtgttacagctcataaaggcaaggtggaccgagagagtgagcagcagcaagatttattgcaaacagcataataacaaagcttccacagcatagaaaaggacagggccgggttgctactgctagcttgggcagcctgcttttattcttatctggccccacccacatcctgctgattggtccattttacagagagccgattggtccattttacagagagctgattggtccgttttgacagggtgctgattggtgcgtttataattcctgagctagacacaaaagttctccatgtcacaactagattagctagatacagtgtccacacaaaggctctccaagtccccaccagagtagctagatacagagtgtcgattggtgcattcacaaaccctgagttagacacagggtgctgattggtgtgtttacaaaccttgagctagacacagagtgccgactggtgtatttataatcccttagctagacataaaggttctccaagtccccaccagactcaggagcccagctggcttcacccggtggatcccgcaggtggagctgcctgccagtaccgcgctgtgcgcctgcactcctcagcccttgggtggtgtatgggattgggtgccatggagcaggaggcggcgctcgcccgggaggctcgggccgcacaggagcccacggagacgggggaggctcaggcatggtaggctgcaggtcctgagccttgcccagagggaaggcagctaaggcccggtgagaaattgagcacagcagctgctggcccaggtgctaagcccctcactgctccagcaggcagggccagctggccactcccagtgcggggccgcggagcccacgcccacttggaactcctgctggcctgcaagtaccacgcgcagccccggttcccgcccacgcgtctccctccacacctccctgcaaggtgagggaaccgactctggccttggcaaacccagaaaggggctcccacagtgcagcgtgggctgaagggctcctcaagtgccgccaaagtgggagcccaggcagaggaggcaccgagagccagggaaggctgcgaggactgccagcacgctgtcacctctcagtagctcacacctgtaatctcagcacttttggaggctaaggtcagatcatctgaggtcaggagtttgaaaccagcctggccaacatgatgaaaccctgcctctactaaaaatacaaaaattagccaggcgtggtggcaggcacctgtaatcccagctactcaggaggctgaggcaggagaatcactcaaacctgggaggcagaggttgcagtgagccaagatcacaccaccgcactccagcctgggtgacagagtgagactctgtctcaaaaaaaaaaaaaaaaaaaaaaaaaatcaggacgttgatacctttgcttgctggacaaaatgaggacaaactatcttacatttatttccgctagttcattcagtagtttttttcctatgtcttctctctttgaataggagagaggtctcatgggaacctattatcagtcaagatataatgatagaaggtatgatgataaggagagttccacagcataaaacacaagcggaagaaatatccagcaatagctgtatatgtggtaataattataagggatgggtgttgggctttatctgaattattatcttaaatgcccacaccatttattctttgttgccttgtgatggtagacattggtcatggacctgacgttccgtgcagatctatgttgggagaggcagtctgccatgggccctgagcatgccctgaagttcctgctgggtatgccaagaatgtaaggccttgactgctctttacctgacccatttcccagggctgtgtttgcaccaagaaaccttgaggaaggaggtaacgtctcccctagacaaagtgtaggttctctacaaagacagggattccccaagctcagtgtttctgccccataacgcagctcaccacacatgtgcaggcatccgtggtgggcccttagcatcaccctgagaccccagggcatggggaactgacacacactagcctagagctctggctactgcttttgccatgaataataaagtcccttgtctctgaaccaggaatctcatgtctttttgccaggaaagtaacagtaaacagtaacagactagtttgttagcttgaaagtaggttaaaagctcagaccctgcagttcctggcagtttatttccatctccatcttgtaagaacatcaagagcagagaccaagtcttttgctactctgtatggtagaatatcttattcaaaataggtggttgctaaatatttgaaattttacaggctcattgttctcttctgaattgtaagttcagactagaaggaaatgcataatttccaagcttctaaccacacacagaaaattcaccttcacctttaagtaaagtaatgcagcacacataggatcatggtggacgggaggcaggactagattgcagctctgaacagagcaatgtgcagaggcttgcattgtgaattttagctccagatcgactgcaagaacaaaccagcaaccccgagaggaccgacagacctctgaaggaagcagactgctcttgcaggacctggaagacaccccaaatactgtgagtgcccaaactgcggaagtgggaaagggagagcatcctctcccaaacacacacgcccactggagaaaaggaaggtctgtttgcaggagaagtttccgaccttacctggagctgagtcaatttagagagtcgagcgaaatacagaagtagaggaagcagcgggaaaggccctgggagctccctgggtccccaagcaggtcattcctgcctggcaccacagggatccaccaggagggcagccagaggagcgagggtaaaactcaacagggagaaggaaatctctagctgaaatttgtaacaatttgaacagggttagaagcctcctggccagaactcgggggagggcgcaaatctggtgtgcagattctccacaggtgggaagaacaagccctttcttttgcagctgggaggtgggtagcctgaggcaagttctcaagcctgtctcacccactgcccgaaaacagacttggggcggttggatgggggcatggtgggagtgagactggactttcagtttgcatgggagctgggtgaggcctgtgactgccagctttccaccacttctctgaaaacctgcatgactcagcagaggcagccataatcctcctaggtacataactccagtgacctgggaatctcacacccatcccccacaggagctgcagcaagaccggtccaaagagagtctgagctcagatacgcctggccccacccccacctgatcgtccttccctacccactctggtagcagaaaacaaaggacatataatcttgggagttctacagcccagcccacagccagtccctctcaaactactacagctgatgctttctggaaagcgccacctcacagcaggaggccaacccgcacaaaaatagagcattaaaccaccaaagctaagagccctcacgaagtccactgcacaccccccaccacctccactggaacaggtgctggtatccatggctgagagacccatagacggttcacatcacaggactctgtgcagacaaccctcagaaccagcccggagctgggcagacttactgcgtggccagacccagaagagagacaacaatcactgcagttgggctcacaggaagccacctccataggaaaagggggagattactccatgaagggagcactccatgggacaaaagaatctgaacaacagccttcagccctagaccttccctctgacagagcttaccctaatgagaaggaaccacaaaaccaatgctggtaatatgacaaaataaggctcttgaacagcaccccccaaaatcacactagtttaccagcaatggatccaacccaagaagaaatccctgatttacctgaaaaagaattcaggaggttagttattaagctaatcagggaggcaccagagaaaggtgaagctcaatgcaaggaaatccaaaaaacgatacaagaagtgacgggagaaatagccaagaaaatagatagcttaaagaaaaaaaaataaataaaaaatccaggaaaaattggacacacttatagtaatgcaaaatgctctggaaagtctcaggaatagaattgaaaaagtagaagaaattcagagctcaaagacaaggtctttgaattaacccaatcccacaaagacaaagaaaaaagaataagaaaatatgaacaaagcctccaagaagtctgggattatgttaaatgaccaaacctaagaataaccagttttcccgaggaagaagagaattataaaagcttggaaaacatatctttaggaataatagaggaaaacttccctggccttgctagagacctagctatccaagtgcaagaagaacaaagaacacctgggaaattcattgcaaaaagatcattgcctaggcatattgtcatcaggttatccaaagttaagacaaagtaaagaattttaagagctgtgagacagaagcaccaggtaacctataaaagaaaacctatcagattaacagcagatttctcagcagaaaccctacaagctagaagggattggggctctatcttcagcctcctcaaacaaaacgattatcagctaagaattttgtattcagcaaaactaagcatcatatatgaaagaagatacagtctttttcagacaaacaaatgctgagagaattcgtcactaacaagccaccattaaaagaactgctaaaaggagctctaaatcttgaaacaaatcctggaaacacatcaaaacagaacctctttaaagcataaatcacacaggacctataaaacaaaaatacaagttaaaaggcaaaaacaaaaaacaaaaaaccaaagtccacaggcaacaaatagcacaatgaatgcaatggtacctcacatctcaattccaacattgaatgtaaatggcctaaatgctctactttaaggatacagaactgcagaatggataagaactcgccaaccaactatctgctgccttcaggagactcacctaacacataaggactcacataaagtaaagaggtggaaaaaggcatttcacacaaatggacaagagagtaggggtagctattcttatatcagacaaaacaaactttaaagcaatatcagttaaaagagacaaagtgggacattatataatagtaaaaggccttgtccaacaggaaaatatcataatcctaaaaatatatgcatctaacactggagcgccaaaatttatacaacaattactaatagacctaagaaatgagatagacagcaacacaataatagtgggggacttcaatactccactgacagcactaggcaagtcatcaagacagaaagtcaacaaagaaacaatggatttaaactataccttggaacaaatggacttaaaagatatatacagaacatttcatccaacaacctcagaatacacattctattcaacagcacgtggaaatttctccaagatagactatatgataggccataaaacaagactcaataaatttaagaaaattgaaattatatcaagcactctctcagtggaatcaaactggaaatcaactccaaaaggaaccttcaaaaccatgctgatacatggaaattaaataacctactcctgaatgagcattgggtcaaaaacgaaatcaaggtggaaattaaaaaattcttcgaactgaacgacaataatgacacaacctaccaaaacctctgggatataagcagaggtggtgccaagaggaaagttcatagccctaaacgcctacatcaaaaagactgaaagggcacacactgacattctaaggtcacacctcaaggaactagagaaacaagaaaaaccaaacccaaacccagcagaagaaaggaaataaccaagatcagagcagaactaaatgaaattgaaacaaacaaacaaacaaaaatacaaaagataaatgaaacaaaaagatggttctttgaaaaggtaagtaaaactgatagaccattagtaagattaaccaagaaaagaagagagaaaatccaaataacctcattaagaaatgaaacaggagatattacagttgacaccactgaaatacaaaagatcattcaaggctactatgaacacctttacacacatcaactagaaaacctagaagagttggataaattctggaaagatataaccctcctagcttaaatcaggaagaattagataccttgaacagaccagtaacaagctgcaagactgaaatggtaattacaaaattaccaacaacaaaaaatgtccacgaccagacagattctaagaagactttctaagaagaattggtaccaatccttttgacactattccacaagataagagaaagaaggaactctctctaattcattctatgaagccagcatcaccctaataccaaaaccaggaaaggacctaaccaaaaaagaaaactacagaccgatatccttgatgaacatagatgccaaaatccttaacaaaatattagctaactgaatccaacaacatatcaaaaagacaatacatcatgatcaagtgagtttcataccagggatgcagggatggtttaacatatgcaagtcaataaatgtgacacatcacataaacagaattaaaaacaaaaatcacatgatcatctcaacagatgcagaaaaagcatttgataaaatccagcattgctttatggttacaattctcagcaaaattagcatacaagggacatacctcaatgtaataaaagccatctatgacaaaaccacaggcaacataatactgaatggggaaaaactgaaagcgttccctctgagaactgaaacaagacaaggatgcccactctgaccactcctcttcaacatactactgaagtcctagccagagtaatcagacaagagaaagaaatacagggcatccaagttggtaaaaaggaagtcaaactgtcactgtttgctgacgatatgatcatttaccttgaaaaccctgaagactcctccagaaagcttctataactgataaaagaattcagcaaaatttccagatacaagatgaatgtacagaagtcagtagctcttctatacaccaacagtgaccaagccaagaatcaaatcaagaactcaaccccttttacaatagctgcaaaaaaataaaatacttagaaatatacctaaccaaggagtcaaaagacatctacaagaaaaactacaaaacactgctgaaagtaatcataaacaacacaaataaattgaaacacatcccaggctcgtgaatgggtagaatcaatactgtgaaaatgaccataccagcaaaagcaatctacaaattcattgcaatccccatcaaaataccaccatcattcttcacagaattagaaaaaacaattctaaaattcatatggaaccaaaaaagagcccacatagccaaagcaagacgaagcaaaaagaaaaaatctggaggcatcgcactacctgatttcaaactatactataaggccaaagttgcaaaacagcatggtactagtataaaaataagcacatggaccaatggaacagaatacagaacccagaaataaaccaagtacttaaagccaaccgatctttgacaaagcaaacattaacataaagtggggaaaggacactcttttcaacaaatggtgttgggataatcggctagccacatgtaggagaatgaaactggatcctcatctgtcaccttatacaaaaatcaactcaagatggattaaagacttaaatctaagacctgaaactataaaaattctagaagataacatcggaaaaacccttctaggcattggcttaggcaaggatttcatgaccgagaacccaaaagcaaatacaataaaaacaaagatcaatagctgggatcaaattaaactaaagaggttttgcatggcaaaagaaacagtcagtagagtaaacagacaatccacagagtgggagaaaatcttcacaatctatacatctgacaaaggactaatatccagaatctacaacaaactgaaacaaatcaataagaaaaaaacaaagaatcccatcaaagagtgggctgacatgaacagacaattctcaaaagaagatatacaaatggccaacaaacatatgaaaaaatgctcaacatcactaatgatcagggaaatgcaaatcaaaaccacagtgtgataccacgttactcctgcaagaatggccataatcaaaaaatcaacaaacagtagatgttgacatggatgtggtgaacagggagcacttctacactgctggtgggaatgtaaactcgtgcagccactatggaaaacagtgtggagactccttaaagaactaaaagtagagctaccatttgatccagtaatcccactactgggtatctacccagaggaaaagaattcattatatgaggaagatacttgcacacgcatgtttatagcaacacaattcaattcacacttgcaaaattgtggaaccaacccaaatgcccatcaatcaatgagtggataaaggaacggtggtatatatatatgatggaatactacttagccataaaaaggaatgaagtaacagcatttgcagtgacctggataagattggagactcttattctaagtgaagtaactcaggaatggaaaaccaaacatcgtacgttctcattgatatgtgggagctaagctatgaggatgcaagggcataagaatgatacaaaagcataagaatgatacaatggggagaatagtgggaggcgggaaagggataaaagactacaaatagggtgcagtgtatactgctcgggtgttgagtgcaccaaaatctcacaaatcaccactaaagaacttactcatgtaaccaaataccacctgtaccccaataacttatggaaaaaaagaatttaaaaaaacctactacacatagttacaaacccaataaagaaagaaagtaatgcagagaaagactctgtacaaagactcttgttggtagcacaatcagcgtgtgtgtgtaaaatctgtaatttaaattttccacgaaatttctagagtgatgagacacatcctggggcagatctaggactgtttaatttgtctctgtagaaagcagttatagtctacagaggtctttgtggcgggcttaaatactgatcctacaaaaggagctaaaattaggctgtcatatggagaaggtaagtgattcatagagaaatctgtgaagctataatttcaagaggcaaacatccatttacaatccctaaaaatgtcgatggattttggccttgctttggccactcaggcaccaccagtaacacatgtgctgctctaagaaggcaggattgctccccacatggtgcctgctgtttgctcaatggcacttttaactctgggcaaggacccaggagggagttcacacactctccgcaagggttcagaactgcaccctatttgataattgaaaacctggcttttgtcatctgaaacaatagcttttactctttagtggatggctgtaaattgcctacatgatcatctgtgtaaataatcgtagactaattattttcttacagttctacgaagttttaagaagaaaactatttgccatttttctgatattcaaggcaaagtaatgaggcaaaaaaagtttctgtgtgtatacacacttttgtatctttgtgtgtgtatatatgagatagattatacacatacatgcatatatacatacagaaatctttcctataaattctggatttctgaagactcactgtgatcctaatgagcctctagctttaaaacaatgttgaacaaaacaccatttttaaatatttggctttaacctaaatttatgggaatgaagaaaataaacaagcattgtcaagaacattttgggaaaaaaaaggctttgcacacatcaaaatgtaccctaaatctacaataatagtatagggtggcatcaataagggacagaatagagatcctattataataaaagaagtacaccacattacttgtgttgggataattggctgtctttaaaaaacaagtaagacagatctagatgtgaaaagaagagaggaaaattcttcctcgtgaacctagatgcaaaagtcctaaataaaatattgaaaaattaaatacagtagcattttaaaaaacatattatgaccaaatgtggtttattcctatattacaaggatgttttaacataatgtaatttattaatggaattcactacattaaatgagaaaaactatatgacaatctcaatagatgcaaaatagcagttggtatttcaacactagtgtaaaagcctctaataaacttgaaatagacaggagctccctaaactcaagaaaccctacagcaaacatctggaaggagatggggattgctgccaatatcacttctgttctacacaggtcccagtcattggaagaagacaggcaaaagaagtaaagtgtgttcaaactgggaaggaagaaaaactgtccaagatgatacaattattcatacagaaaactcaataacatttccaaatatttagaactaaatataatagttgtgcaatgttgctgcatataaaatcaatatgcaggccgggtgcggtggctcatgcctgtaatcccagcactttggagggccgaggcagggggatcatgaggtcagaagattgagaccatcctggctaacatggtgaaacccccatctctactaaaaataaaaaaaattagccaggcgtggtggcgggtgcttgtagtcccagctactcaggaggctgaggcagaagaatggcgtgaacccgggaggtggagcttgcagtgagctgagatcgtgccactgcactccagcctgggtgacagagcgagactccatctcaaaaaaaaaaaaaaaaaaaaaaaaatcaatatgcaaaattcattcactagcaacaaacagcaagtataagttttttaaagatacgatttacaatagcaaaaaatgtaaagtagccaagaataaatatagaaaaaggtggaaaaatgtgttgagaacaaataaataatgagatcttgtagtcatgaataggaagattcaatactataaatacattaattctttccaaatcaacttataaatccaatggaattccaacaaagaccacaacaagactgtgtgtgtgtgtgtgtgagtgtgtgtgtgtgcatagtctgtgacaggatcattttaaattcctcatctcccttctctctcccacccctgctgccccacaccatgtgaggacacagtgacaaggcttgcctttgtaaaacaggaagagggcgcttgccagaactcgaccatgctggcactttgatctcagacttctagcctcctgactgtgagaaataaatgtctgctgtttataccaccccatctaaagcattctgttacagcaacctgtcttagtctattttctgctgctgtaacggaataacagactgggtaatttacaaagaatgtaagtctatttggcccacagttctggaggctgggaagtcctagagcatggggccagcatctggtgggggtcctcctgtggtggaaggtgaaaggcagaaagctgaagtgagtgtgtgagacagagagagaagccagatttcctttataacaacccactctcaccataactaacctctcccatgctaatgacaatccatacatgagtgctccactctcacgacccaatcacctattattaaattcgacctccaacactgactgtggcattgaggattatgtttccaacatatgaacttttgggggactattcaaaccacagcacagcctgaactgattaagacagtgggcttttctatcttctatcattaaaccatccgaaacaccattagtcctctgactgcaggtccagctgtcctgagcagttcaacatttcatatttcgaggaatgcaggttcactcataaacaacacctgtgacagagccaccctcactcacatcctggacactctactgtctgttcacccctgtgcattccaggatgtaacaggcaagatgatcccaactcaggcacagctgcagtgtctacagctgcaggaggtcctgtctccctcctgcccccagcaagaaaacccaagtaaggtatttttttttaaggtatagtttttttccttcaagtttctaattttgacacaatgaaaatattgtatttatattagcaatacccgattagcaatttcatgtaaaggcgattaggtactcataaaaggtctcaagtactccaactaaatcagtcactggttaataacaatgatccacgagctgttttcctggttttcatgtggaataattggcaaggaaaaccatacatgaaaaaagaaaaaagaaaaagatcagcaactttgcagctttagccactatgtgatgtgctatcaaaaagccacctagaatcttttttcatgagttaaaacactactgtcatctataatcctgaacggtaaggtctagaaaccaatactgacagaggtgtccaaacagctcctcttgcagtgctgtggggcacatttcttttaaccttaattgacttcaattactgtgcttcatctcccatggcaaaataattccccaaagaaacaaagagtattagagtgttttcactcatgaaacagcccgtaatgcacctcttttgcttaggaattggaagccaactagatttgagcctgcttgaaagaaaatctcatcactgaagaatccattagtgggccctccaaaatccacacagtcttaaggccagggaccaactggacttcaggaataggatcaaaaaagccaattccagttccatcgtgatgtactgatttaactttgattgtgaaggacagtaatttattgagtaatttatcttgctaaccaccatattaatccagtatccaatcagcacttctctcattcaattccaaggagcaggagtcctagatggttggaagtgtcagacaggaagggaagagtgtcttctagtgtcttgcccagtaattgtacggggctccaaactcctggggagggggaatgatgtctgacttggagcaggccagtggggatggacagagaaaaatttcagcaggtgcccattgctggagtgcaataagtagagcccggggtgatgagaggcctgggggagaagggagagggagggatgacagagaggacaataggaacacagggtcccttgcccttcataatgcccttgattcttgttaaagggaaatgccacggatgtggttggtggagccaacatctctgcctcatccttgatcatcccacacaccccacatccaaattctccctggcgtgttgacccggctaccaacctcacctgcaatcctccctgggctccagctccacctgccctggctgaacctccccctctcacctggactctgaggtggcctcccagtacctcaggtctactcttccctgtcaggacacctgttttagcctaagtcggctcctgtccctcccaggttacagtctgtggcgggaggcccaccagtgataaaatctccgcgccttcccccgtccctggctggcaccctctgcagcctatttctgcctcatttccacggaggctgtctcccattttctctgcagaccagcccccaagtacacatcgtgctaccatagttccacactggtctagctctctccgcttcccagtcccccgcccagggaaggggctcactgaaccagcctgggcacgtgtccactcccaggacagtccactgcaggaatgggcggggcagggtgcacaggagggtgctgtaagctgggcctgctttctaagccaacctgggtgattggggagccaactcaccatggggccgctgcctagcccctctgcttctacgtgactatgatagaagacggcactgaagccttccctctgagaaagttctcagatcttcttttggtcacttctggctcacaccccacaaaagatcccctggacggaagcctcagctctcttatttctggggatgtggctttgagggtttcctcatcgctctgagccttgatctcatctgtgaggggatgactggcttagactttaaactcaagtaggtgaaccccggggcacttggtaaagggaagccctcctgggaggattccgccagggtgtgcagagccacccgtgatagcaagtgatctcattactggaaggttctgaatcggggggagatggtcaccagcacctcggagggttggggcaccattcatcttctgattggttatcatatttggtttgatttcagtcaccccagaggaccaaaatgactaaaataagtaagttattcatctataaacattatgaagcattttcaggcatttaacagatgtaataattacctatatctaagtcatatttgaagggtaactaaattttaattgctttataatatgtcttataatctttttattagcaattatataagcaattgattgtaactatctgtaagtgaaaactaatatctggatagccaaaaaaaaaaaaaaagccaaaaaatcccactctttcatttagatgactggggaatattgaagagtcggggaaatagcaggctctattttaagcatcattttaaaggaaatataacacaatcttaatcgtaggtggaaaaaactccaaagagtacttgttatgattgcaaattcctaagtaaaagccatctacagatgtgacttgtttccaggtattactcttgattttggggacatgtctcttcccttgatgggagaccccctgggtcactgcatcccttgtacatcaaggtttctttcatggcagatgtcatgtcatttttttctccatgtatcagaacgacaactcattccttgcatgacaatggagtggaaatgcagggagacctcaatgacattttattcagctgacaaggaagagacaaactgccttgtcccaggagtctgtgaaaactagaaacacggccaggcacggtggctcacgcctgtaatcccagcactttgggaggccgaggcgggcagatcatgagatcaggagattgagaccatcctggctaacacggtgaaacctcgtctctactaaaaatacaaaaaaattagccgggcatggtggcgggcgcctgtattcccagctacttgggaggctgaggcaggagaatggcctgaacctgggaggcggggtcttgcagtgagctgagatcgcgccactgcgctctagcctgggcgacagagtgagactccaactaaacaaaacaaaacaaaacaacaaaaaaaaaaaagaaaactagaaacacctcatactgggaactataaagctttgccactgccactgctttgtaaaacaagaacttttccctgcctaaggtatctatttcataggtagaattcataacacactaaaacctttgacttggcctgcttggtatagaaaacttatgcatcacaaaatattctgctcagagtataagcacataggtaatgcatgaatttgtggtttatcaattttcaaagaaccttttacaaagacactgaatatatatgagagtaaacatgttgtgatttttggtagttcagacagtaatcagtttctcgctgggcctcagcttgttctgagcattcaggtccacagtcctgaagctaagctagtgtcccgggtagcagcctggtgtatgtatcactgcatatggcggtgagagccagggctccaaagccagactgccggcctgggattctggctccacctttacaatctgcatgaccttggggagttactaaatttcactgtgcctcagtatcctcacctgtaaaatgagaataaatgatacgtgtacctcaccgggttcttgtaagggtaagattagtttcacaaatgtgctgccggtaacgcttagcacacagcaaggctcaatcaacattagctatgactatcatacacgattaatcatctgagtgtctgatcggattgaaaacacaggctcctgcagacaaattcagcagaggactttcaggcctcatgcatgaatgcttaaggaaaagagccctaaagattatgagacgcccatccaagaacatccaagaatgcgttttgcagtctgaactgattctccagggtgctccttgtgttcaactgatgggacaggaacgctgatgtttgtccatctctctttttcttcctttttgagacggagtctcactctgtcacccaggctggagtgcagtggcacgatctcggctcacagcaacctccacctcccaggttcaagtgattctcctgcctcagcctgctgagtagctgagattacaggtgcccgccaccatgcccggctaatttcttttgtatttttagtagagacggggtttcaccatgttggtcaggctggtctcgaacccctgacctcgtgatccacccgccttggcctcccaaagtgctgggataacaggcgtgagccactgtacccagactgtccatctttcattgctctactttctgggtcttgatcgtcctctctcatgactacttcttttactcccatcaaggtaaagtgtgagtgaaagtagtttgattaaagcccaggcagattaaggacgaagctaaaaagaatgaagagacactggtaggaaatactggctgacatgcagaagtaatttcaacgatcttattagcctttcgcctcttgagtacttggttaatgttcataaccagaagtaatgtctctaatctgcatttaactgatattctaactcttccttaaagatacagacctcttttcctcaggcttcataggctagacaattctccttaaatgtcctgagagccgtggcacataggggatgagtggtgggggggcacattcatttgcctggagtgtgggaggagcccccacctttcctgattaatgcagctggtagttctcagtgtgtgcagctgggtgggcctccagaacagtcagtttgggggccatgaggggcaggctctcctggatggtgacaataattttaagagaggggaggtcagtagttggaagtgggaagaggccagaggagagaagagggtggaagagcagagaagcatccctcctcagctcaccagacaaaggataaaatggaggaagtcacaggaccctttgccagagaagcccccaggaagtgtggcacatgcagggcaggagccacgggccccacttcatgctgaggtccttgccaagcccatggcccgcagaccctgttggacggggcagcaccgtgcacctgaaggctgaggccgggccccaggaggggttagatctctttccctccttccctccaggtcgccaggctttgctaatttcatcttccaaatatttaccaagttaatgcccttctcctcctactctgatgtgcctctgcagttttggtcccattatctctgcccaggttggtgtctgtgccctctctgggcctggctctcagtcctgtcccctgctgctgctggatgatctatttctgtaatgcatctggccactgccctctcttccctgctaccccaaacaccccaattcagtgtctccacgttgcctgcagctctgatactgcagggcccaggactttcaagaggtagagccaagggtgggagaaggaagagttggagggacgcccagctctccacctgggagctgagcagctaggggtggtggtgataacatcgacaaggttggaaagagaagcagaagctgagccaatggattccctctgggagcggctgggggaggatggcagggagtgatccgaggggtcccgctctcgtgtatgggactctgtcatgtgagtacacatgtgatggctggcaaaaaagcaactgtatggcaggatcctcatccacgggaaggacagggcttctattttaaaatacactgaacagcaagactgcacatgctttctggaatagaacataaatgcatctatgaatcaaagtcagaaaatatattggtggttgttttcttgctttattttgcgctctcacaggtgtgactatcagttttcaggaatatattctttgctcaatatgtatcttcttcctgccctccttgcttcctttccttcctccagtgcacacagatcgagcccacaacgcagcaagcacagagatgaaaagaggaagatagacgcggggtctgcacccacgaaactcagtctagagggacacaggggtgccctggccagcatctggactcgtgaggctgatgcatcaagccacggcagagctgcctgggaaaggtgcatagggagcactctcaggggccagaggaagggacatccaggcggcaccgggcagtgaggcaagtcaagggtggcggaggttggtggggacagtgttactgggagagggaaggctgagtgcagaggtggagggtagggatgggcaggggcagaaagcactgtgaagggagcttagtggaagagggtgggcgaggggaggcagggcgggagggatacagggagaagggtggatgtgctgcagggacacccgggtggtgacaaaattaaagtgcctaaaaatactcaaggagaaatgaactttgttaacacagtttctttaagaatgtaacgtgcctgtaatcccaacacttagggaggttgaggcaggaggatcacttgagtccaggagttggggaccagcctgggcaacatagtcatgcctgtttctacaaatataaaaataaaattagctgcatatggtggtacgtgtctatggtcccagctactccagagactgaggcaggaggatggctggagcctgggaggtcaaggctgccgtgagctgtgattgtaccaccgcactccagcctgggcaacagagcaagaacctgtcttaaaaaaaaaaaaaaaaagaaagaaagaaagaaaaggaaaaagaaccggttaccatctcaatgaattagagaagacagaactaaagaatatttatatcctgcccaagtgttcacaatgcatctctccgttttcacaatgcacctttcttaccttctctctgttttttgttttttgtctggactaattgctagtcagactgttctcctctctgcagtcccctgaattctgcttgtccctggggcctgggcgagcgctagaaaggagaatgggccagtaatcagctcgtcccacagtgagacacatatcctggtcatcttcctttgctcacccaacttccccttaagtttctgctaagatttgctgacctccctgccctataaaagaaaagcccttttctgattgattttgagatgtttacagttcttgagttccaaggattctcccctgttagttgcaagagtctttttgaataaatcttctccttatctaagacaagattagttttgcttgacaatgcaaatgaccagagggacacagagaactaagaacattttttaaaagggaaaggtcttgttgaaattaaatctatacttaatcagtatcagatcatcttgtatttgagacttcctatcttgtgtcttgagaagggcaagaagcagtctggtgatactgagctataaactagaaaggttttgctatcatctttgcagaactgaactatttatgtggcctacaggcaggttttctgcaggatgttgtatttgttatatgtttatgggaaccattcttctctcgaaataacaggctaaatttgccattaggacattgaatttacccacaaactttgtaataaatactcttcaggctaggatggtaatggctttactttggtctaaccagtctctaagtaaatagtatgaatattcttgctggtttggaactgctctccgctcaatttcattttcctcctggacagtgcaagaacactaaatgtggtgagtataggagccatgtgcaaatgcacaatgcaaattcctttttttctgcaagagaagaggatgaatatgatagatatttaggaagacttagtgaataatggcacttgggagcaaaggagaggaaagagccattccatggtctgagcaatgggaagccattctctgagtgggatggctgaaggggcatggaattgccaggagctaaagggatactgaggatgagcttagtttgagtcatcggagtctgcgtggtgttccacagtaactgcgtggatcagggccggagtcgtcttttttttttttttttgagacggagtctcgctctgttgcccaggctggagtgcagtggtgcgatctcagctcactgcaagctccgcctcccgggttcacgccattctcctgcctcagcctcccgagtagctgggactacaggcgcccgccatcacgcccggctaatttttttttttgtatttttagtacagacggggtttcaccgtgttagccaggatggtctcgatctcctgatctcgtgagctgcccacctcggcctcccaaagcgctgcgattacaggcgtgagccaccgcgcccagccagggctggagtcttaaacttgggagtggccagtgcagagatgggactgatgctatggaagcagatgaatttgcccaaggatggtgtgctcaatacagagagaagggagtttggataaggacccagaatcaggagcaggaagaagagtctacagagacgatcatgatgagaatgaccagagagaaagacggaaaccaagaacaggaggacacatggacaaacccaccataggagtggaggaacacatttgtctcaatgtgtccagcagacaactagttagtaaggacatagaagagctgaacgtgccagatctaatggacatgtaccatatatacatttacctgtcctcaaaaagatatgtatgacttactacaaaaattcaccacaaagtcgtgcacaaagcaaaatctcaactaacaccaaagacttgttattagacacattgtaatcaggttacctgactacagtacaattaaatttgctataaataataaaaagtaggccaggcgcactggctcacgcctgtaatcccagcactttgggagtcgaggcaggcggatcacctgaggtcaggagttcaagaccagcctgaccaacatggtgaaaccctgtctctactaaaatacaaaaattagctgggtgtggtggcacacggctgtgatcccagctactcgggaggctgaggtaggagaatcgcttgaacccaggagacggaggttgcagtgagccgagatcacgccactgcattccagcctgggtgacagagcaagactccgtctcaaaaataaataaataaacaaaataaaataaaataaaaataaaaaagtaacggaaaaaccctccatatatctgcaaaatttaaaaaatactgctaaataacccagggactgaaaaataaatcataaggaaaattaaagaagtctcagaactgaataaaaaagttactagacatcaaaacttagcgtatgcagtttgcctgcttatatgaggaagaaagactgaatttagtaacagcatacatcgagagaagtgagaaaaagaaaaaggaatttggaaggaaggaaaaaatggagaagagagcagaaactaatgaaataagaaacaaagcaatgacaagatcaataaatattaagctggttctttgaaaaaaaactgacaaaaataggcaagtctctggcagaggctgattaacaaagaaagaaaaggaataaattaaaatattaaaaattaaaaaagacataactaggcatagcatatacatgaatttgaaaacctaaacaaaatggacaatttattccagaaaagcaaaacattctaacatagtctcaagaagaaggaggaaatccaagtaacctataatccactgaatcagtacttaactatctactgactgcaaaagaaattaccaagccctggtgattttgtaacttttaccaaacattcaattcaagaaataggtaagtttaatcttctgcaaactttgttttcagagggaaaaagaggggaacacctcccagctcatctttctaggctagtgtaaactaaaaaataaaataaaattaggcaattgcagtatgaacaagggaaagcttgattcatataatttatgaataatgatgaaaaatctttaataaaagaaaagcaaagtagattttcataattatatgaaaatattgtgcctaagttttatcccagaaatgcaagaacggttccacattagaaatccattctacatgaatatatattcatgtagtttcatgtatattcactatattaacagaatacagttatatgtgtatgaatgtgtatatacatatatacacacacatatacacatacaaatacacacatgcatatatacttatctcaatagatgcagcatttgctaaaatttaaaactcatggcaaactcttagcagactggtaacaaaatgggattcccttcatctggcaaataatatttagtattagaaattttcagcaaacattattcttaattattaaactctttcctttaaaatcgggaacaagacaaggatggctactggctcaacttccattccattgtgttgaaagtcctaaccagtgcaggaagatgggaaaaattaagaatcaatgtgaagactggaaaagaagaaacaaaactgtcgttattcccagatgatggaaccctctaaataaaaagtcctaaacaatctacaggcaaactgttagagaataaaaaatttaaagtaaaaaaaagaatttttttttttttttgagatggagtctcactttttcacccaggccagactgcagtggcgctatctcagctcactgcaagctccgcctcctgggttcatgccattctcctgcctcagcctcccaagtatctgggactacaggcgcccgccaccgcacccggctaattttttgtatttttagtagagacgggggtttcaccgtgttagccaggatggtctcgatctcctgacctcgtgatccgcctgcctcggcctccgaaagtgctgggattacaggcatggccactgcgcccggccaaactaaaaaaattttaaactccctacttttccaataaggacaaaatgatatgacacctaggaatatatatttaacgtaagttgatcgagactgtatattaaaaatggtaacatttttattgaaaaacagaaggctaaatgaaaagctgtaccaaaaatgataattctccccagattaacctaaaaatacaatacagttacaatgatggtgtgtgtgtatatatgagaaagaaagagagagagagagagaagggagagagaagagagctctctctccatctctcttggaggaatgagaatggccaagacagttctaaagaggggaagagtggggatttaccctattaactacaagacaaatacagaaccagtatttcccgtaatgtggtaacaagagagacaagccatagaccaataaaaaaaaagagccctcagaaatagacatcttcaaatatagaaacagattggtgctgtaataattgatgactatccatacacaaaaataaatacaactagatccgtatctcacaacacacaaaattaaaccccagggggattactgagctcagtgtgagaggcaaagttttaaaacttccatgaaaatacagaaaatttttatcacttggggatggaaaaatagttcttaaaatgcaacactaaaaggacacatcatccaggaaatgaatttgcctgcattaaaactgaaaacttctctatcacaaatgatgcccaaaacaactttgagtgatgagtcactgatcgtgagaagacttttatgacaaagggaaatcgtttagagtaaagagcaaataactcagcaggaaaagagaaaaaaccagggagttagcagatcaaaacaaatagccatcagtcacacagaaagcctgaggacatcgagaagcaaggctgccttttccactggccaggagagcggggatccctgccatcgctgtggagtgcggtgactaaagtcctgcagatgcacttcccctgtgagccagcaagtctgcaggctggagaaaatgcagcaggtgcacacacgctgccgagtgcacatcactccgcattctagcactgttagaataatgagaaactgggaacaacccagtgtccatgaacaggagatggagaagcaacctgtggaatactcgctcaatgcaagaccatgcagaagccccacgaagatgactaaggcaacccttatctacatggatcagtatcacaaacctgatgggggtgagaatagaaactggcttacggtaccaaatgcgtcaactttgatgtaaagtttcagtgaagcagacaactctgcaggggaatgaaaaattccctgatgcctcaggatagtggctgcttctggacaatctctaatttcagacagagggagggacagagagccgtggcagtggaggggactcagatgggtctgcaacaatgtatgataatatatttcttatttaaagaaaaagaatagaagcaaatattgtaaacatagtaagattgaataaatctggaaggtattatattattctcatacttttctgcacgttgaactagctagtaacttttttttttgagacagagtcttgttctgttgcccaggctggagtgcagtggcatcatcttggcttactgcatgcagcctcaacctctcaggctcaagtgattctcctgcctcagcctcctgagtagctggaactacagccacgcaccaccacatccagctaatttttgtatttttagtagacacggggttttgccatattggccaggctcgtctgaaactcctgagctcaagcgatccgccggcctcggcctcccaaagtgctgggattacaggtgtgggccactgcacccagccactgacaacttttttaagggtgcagtgctcaactttcagatgtgccaggagatgcacagaacaaggacctgctgagggcaccgctggtcatttgcacggaaatgacccattggctgtcccctgctctgctgcgattcttcaggcaccacctagtctccgtctcctactaagcggatcaggttggaagtggaggaagcaatggatctggcattaaagatggaaatctggatctaccaccagttgagtctgcagctcagcccctgcacatcctggggcctccattttcccatctcctcatggaaatcatgaagtccgcctcatggacttcactgcggttggggtggtggtggagaagacagctcatgggatttgaaagggctgcataaaccagttcccaaaggatgcctatgcagcgaaaccagcccgggaccagcgcaaaataatactagtaggttttatgtctcccatggatgctctgctcctttgtccagtgccctgtcctgtggcccctctcactttggggaccatgggacatggagcctacctggagatcagaggttatttttaaagcatttggttatttcagggctctaaatgagtatcagaatgagagagaggagaaggcagtattgaacggtatgagaccatgggtgtggtggtgtgtggccgtagttccagctactcaggaggctgaggcaggagaatcacttgagcctgagaggttgaggctgcatgcagtaagccaagatgatgccactgcactccagcctgggcaacagaacaagactctgtctcaaaaaaaaaaaaaaagttattagctagttcaacatacagaaaatatgagaataatataataccttccaggatattgtcccagcatgttggccaggctggtcttgaactcccgacctcagaatatcaaattgctcagaacaattgtgctccactcccctgtgattataggattccctgctcagcttcctggaaccagtgcctatcggtttcggaatcacacccaatgccctccatgcatctctgaattcatgcattattccagtcctatctttcctgcctttgcttttgtcctttgttcttcccctgctcacttacctgtcatgaaaacttccaacagcttcactgaggtaaaactggcacacaacgaagggcacccatttgaagcatgagtctgatgagttttcacacagtacacattctgtgctttcatttgccctgctgccatttttaggtattcttttccacggccccttcttcccatggtccctttttatttatttagagacagagtttcgctctgttccccaggctggagtgcagtggtgtgatttcagctcactgcaacctctgcctcccaggttcaagcgattctcctgcctcagcctcctgagtagctgggattacaggcgcccgccaccacacctggctaatttttgtatttttagtagagacagggttttgccgtgttggccaggctggtctcgaactcctgacctcaggtgatctgcccacctcggcctcccaaaatgcagggattacaggtgtgagccaccacggtctctttattctagaacatctcatatggttcaatattgccttctcctctctctcattctgatactcatttagagccctgaagttaccaaatgctttaaaaataacctctgatctccaggtaggctccatgctgtcctctcccgtttgtttactcatccatctgcagcactttctccagtctggtgtttggcccccgaatggggcggtggagctcctcccgtactttctgtttggacactagagtgactggggtactttagagtgtgaaaatgggtctactaatatctatgctggaccatcttcgaccatgtggtgtgtgctaaccctaaacagaaccctctcctgagatcctgacacccagcctgtgctggcatggcagagaccacacagctggaaggaaggagggactgtctctctgtagttccttttatctgaatgtgctccgaactgtgggtccctgcattgggggaaggagggagtctgtatggcatagccatctgggtcccagagtctcccaagaagctgccctaaatcctgccacatcacagctgccaaaaaactccaaaggcagcacctcccttagtggtggctccagaatttcaactctgggactgcaatctggaaggaggctgtgtgtgcaggggaaggagtggtatcttaaagctgtgtttgcacagcacattgcattagaccttaaaaatgtccaccatccatttcaaacagtgggagcactacttataaaaattataaaggcctttagaacccaccctccccataaattaccaccggcaccataggtgattccacatctgacccatcaaacacctatcagtccttgttcttcaaaatgagggcatatttgagacctagtatggcttccagtaacctcccagaaggcctcataaagctgagttgaaagttgttctttctctttctttgttctggtcttatatgcaatatgtctggcagaaaattctagaacattctagaaaaatgcaagtgatgcattggccattaaggaagggtacaggtcttcagccatttttgtgtaggttttctgtcatttcagctaggattagaggtgaggtatgtgtatacatggccaaccatctgtgttcccattaccacatacctagagctgtgtttggtatcattcagcaatagaatcccagatttttttcatatattcccacttcctcagcttcttagatgctaccgttcttttcctatagctaacctacccgtatatcacccatacacactgaaaactgcatccgtcatcctactcaacaaaataatggctctctttcaggacagagggaaggattgaaaaaatttctaagttaatattttaatttcctgtcatagtgaaaacacaacatattacactgtcactgtctgtttttctttctttcttttcttctttttttttctttttgggacagagtctcactctgtcatccaggctggagtgcagtggtgcgatctctgctcacttcagcctcctcctccagagttcaagcaattctcctgcctcagcctcccgagtagctgggattacaggcgtgtgccaccacgccaggctaatttttgtatttttagtagagatgaagtttcatcattttggccaggctggtctcgaactcttgacctcaggtgatccacccgcttcagcctcccaaagtgctgggattacagatggaaaccactgctcctggccaactgtctgtttttcttgtctgtttcccccagtagacttggagggcagagtcagtgtctcttatctctgtacatccagtggccaacccagacacagaagaggtgctcaaaaattttctctgaatgaataaattaaaaactcttattgatttcaaaaacagttactgggtataatttgtgccacgcccctcgctgtaagccagaaaaagacaggagaaatgccgggcagtgaggaggccaggtcaggctggtgaccacagacatataagctgctcacccacaggctgtgcggtatgctccactggtcttgttgctcaggatgcaaacaaagagatagcagatatttgggctcatccagggatgcctgctagccagggaggcaccacagaaaagcagtatgagaaggagctctcacatactggtccagggatggctgaacaggtggacatggctcatgcatagagagaggggcggtatcgcacagtggagtctggctgaagctggacagcactcaccatggggctgtgtgaaatattaataataagatatgtattatgtgtctttggtctctgctcctcagtccctgctaaagagctgctaaaatccttgtcacttcctgagtgacaggggcactaggtaatctttttgttgttgtttatagttagtttttctttctttttttaattatactttaagttttgggatacatgtgcagaacatgcaggtttgttacatgtgtatacatgtgccatggtggtttgctgcacccatcaacacatcatctaggttttaagccctgcatgcattaggtatttgtcctaatgctctccctccccttgcccccaccccctgacaggtcctggtgtgtgatgttcccctctgtgtccatgtgttctcactgttcaactcccacttatgagtaagaacatatggtgttgggttttctgttcctgtgttagttttctgagaatgatggtttccagcttcatccatgtccctgcaaaggacatgaactcattctttttttatggctgcatagtagagaatcttctgttttagtatttggtgtttgaccccagctcctaaatcctttggaatttcctgggtgataggagtgtcttttgttctaatgaagcgactcttgatggaattctagatgggtgctgggtcaccagaatgaccaagccatgatgacgagcttggggctttcagccccactccccattctccagagaagggacagaggctggaaacggagttaaaaatcgatcctgcctacatgatgcagcttaaataaaagtccctgaacggaggggttcagagagcttctgcgtcagcgaacacatccccatgccaggagggtggcgtaccctcgctcctcggggacaggggctcttgtgctcaggactcccccaacctcgccacatgcatctctccacctggctgtgcacctgcatcctgcctcatatcctttataatcaacaagggcatggaagtaaagcctttccgtgggttctgtgagccactctagcaattcaatcaaacccaagtagggggttgtggaagccccagtttataccccattggccagaagtacaggtcacaacctggggcttgtgactggcatgagaagtgagtgtggtcttgtggggctgagcccttaacatgtgggatccaacgctgtctccaggtaaagagtgtcagaattgagttgaactgagcacacccagctggtgtctgctggagaatggtttggtgtatgggggaaatgaatacatctggtgtcagaagtctcgtgctgagtggtgtgtgagagtagagcactggaggctggaaattgtcttgctttttttttttttttaactttcttagagacaaagataagaaagcacataaactcaataactgattgatttcttgggaaacttttatctccttgtccattgataaggtttctctgggtaatttggtttattgtggctcagtaaattaaaccaggtacatgaaagaagaataagatctttaactttgatttgaattaggtcactataataaaagcataaggacattgttgaatacagcaaagcactaaaggtggctagatgcagtgtcaacatgttacgaagcatatttcaccagttaacagttctgatttttgtaacttaaaaaaaaatactgtgaatactggtccaaaaatatgtcacagtcttgcgctgggtttgacttggcaaaaatggccatcaatctacctaaacatctttttattgtttaagcatttattatgtcattttttgttacaaaagccgagacactgtttcatcaggaacgggggtctgtagccttgctttttcagtagcacttgtccatcactgtcaaaggctttgagaaggcagatactgaaatcctaatttttagaccctatttcctgactattcataatgagatgcccagaggcaggccctgtcatcgggaagcagggacatgggtcctggagggctgagacactcagatggtccctgccctccaccaggacctgctcaggaacccaggaggagccacctgccctctctctgggctgcagccttcacacctgcaccatcggtcaatggaccccaggatgcaccctccctctggctctacaattctgtgaatccctgtgtggtgtggtggagttccaggtcccctctgtgccctctgccctgctcctcgctcagccccataaggaggtaagaaaccatcaatatcctcaagagagaggcttgttggcccccaggggttctctgctaaaaaaaaaaaacagagaatctaggagcagggccagtcaggaagggcagaacagagatccaggggtttcggggcctccaaaccaacaaaagacaatccgagggatgagtgaagcaacatctgcatgctcttctggattccaaatttattcctcctcggccatgaagaaagttggtttctgcttttttccctgaggatgggctgtgcctgtacagccttccaggtatgggaggggaggaaggaggggagggtgcctgacaggaagcaagtagttggacaaatctcattaagtcagtatcagttaattcaaacacaactaaaatcaaagtgctttgattcccaagccaattatataggatttcccccacataaattgagttcattacatagtaagtatagataatccataatttaatatggaaaattcagacatggagtgttactaatcagataaacagagcctcaaattagactatggaaaagatcaatggacctgctctaattgccaaccaaaaagaagcaagcaaaagggaaattaatcaaaggaacattctcctttgctccttctttagctaagcgtcaagaacattttgcaggtgataggaaggggctgtcctggatatccgtgcaaaagagtagagcagcctcttcccagagtggctccatttccaatggcccatatttgttctgctgcccaagagttttaataaagcaacaccggatccctgcagaagatcctttcactgcagtcaaagtcatcaggcacagcttggcttggatgacttttcaagagtaaggattatattaaaaatgactgcaccactaattatgagaaaactagataatgtggcacatgactctcagaggaagaagtatctataattatgggaaggaagtacaaaatcttaattatgctaactatttaaatagagcataaggcttgagatagaatttaagggttaggaatctgccttagtgctttgaagtatccatatacttcagaaaagggatctgaaaaagatataaaatacactgaaaactccactgtaattaactagctagagacatccatgggtgcaaaccgtaaccaaggagagaaggctgctgcaatctcagggataaaaacgaagacacaagggctcatggaaaaaaaagacaaagacagaaggagccgaggagggagttgccaagactcaagatcacatcgcaagcagaggaaaaaggtaatgcctgctgcagaaaacagccaggaagagaagctttacaaaaaccgaacagggataggggcagtggctcatgcccataatcccagcactttgggaggtcaaggcagcaggatcacttgagcccaggagttcgagaccagcctgggccagtgagatcctatctctacaaacaataaaaaattagctgggcatggtggcatatgcctacagtcccagctacttgggaggctaaggtgggaggatctcttgggcccgggagtttgaggctgcagtgagccgtgatcacgccactgcactcaacctgggcaacagagtgagaccctgtctcaaaagagtttgttaagtcattcatgctacatttccaatgtgggtagggtgcaggacgctctgttcattgtagtgacccaggctgatggcactgccatcacctctactctgccaattactgtgccagtgggaaagagagctctggaagacctcaaaccacatttaaacattctgacttgaaagtggtacatataagctttgcttacatggcccccagcaatcatgaggggacagggaagtacaatcttaccatgtaaaaggaagttggagagctagacatgttttaaaacagcattaatgaccatcacatacctaaaggggagaaagcatttggctgactttcagatttttccctatacagatattcaatgcaaaagagaataacatatcatctataaacccctaagagaaagtttcctcaagaattctgcacccagggggaaaaatgatgtagaacattattccagaacattattccagattctgctgaggatggagaaagctggaaagaacattgccccaccattacaacaacaagaagaagacattgggttctgcaaattcccaacttaaggtgaacccatcagacagctgaggtcacaggacagcaaattctaaggaaaagacagagtctccaaggagagacatgagcacttacctggggcgtatgcagtcagataccagctctagtggaaaaggtggacaagatggaagatcactgaggtaaggtagcagagaggtggaagcaatgaggaagagtcaaatgcaaatactaggaattaaaaacaggcacagagatgaagaatgcctttgatagacagggtcggcagtggactggacacagttgaggaaaaaatgaccaagtggggtttatcttgggaatgcaaggctggcttaccactcaaaagtcagtgttattcaccatttgagtggactgaagaagataatgtatagcaacatctaagcagacgtagtaaaagactgataaaattcaacagccattcgtggtattaaaaacaaaacaaaaaccactctcagcaaactaggaataggagggtacttctacaacctgataataaacatctatgaaaaacttagcgctaacattatacttaatccctaaaagcaggaacaagagaaggacatctgttctcaccatatctattcaacactctacggggcggtctagtcagtgtaataaaacagggaaaagaagtaaggggcatccagattgcaatgtgtgctgatttattttaggtgtcaacttgactggatgaaggatactcgagaactggcaaagcattgtttctgggtgtgtctgtgagggtgtttccagaggagattggtgtgtgagtctgtgaactgagtggggaagatccaccctcaatgttggggggcaacatctgatcgtctggggacctggatagaacaaaaaggcagaggaaaagcgaattattttcttttgctcttctggagctgagacaccctttcctgcccttggacatcagaacttcaggctctctggcctttggaccctgggactcacactggtgcaaccactccccgcaggttcttggccttggactgagagttccaccattggtttccctggttctgaggccttttgacttcgactgagccaaactcccagctttccagggtctccagcttgcagatgggactgtcataggacttcttagtctccatggtaatgtgagcaattctttcaataaattccctctcacctatctgtatctgtcctattggctctgtctggagaatggaagacgtaaaattgcctctctttgcatagcacatgactgtctacataagaaaacccaaagaatctgcaaaagagctaccagaactgagtttagtcaagaccacaggatacaagattggtaacaaaaatcaaatttctatgtgctagcagtgaataagagaccattaaaaaataccattaggatagcaccaataaatgtggaatactttaagcataactattacaaaatatgttaagatctatatactgaaatttacacaagactgatgaaaaaaagaaacactgaagaaatgaagtatgacttaaataaatgaagaactagatcatgaatatgtcaagtctcttcaaagtgacatgtggactccatgcaatctcaattaaaatcccagcaggattctagtagaaaatgcacaagtggattctaaaatttatatggaattacaaaggaaatgatagctaagacaattctgaaaagcaacaaaattggacgacagcaataaacagatactcgcttccaatagtccctggtcctcttgatctcagatgaaagtcagtccctgccaaggctgttgctccttgcataggccctcaggtgggggacaggggcaggctgcctcttctcctagcacctaagccactgctgccacttccagaccattggcctcacaccttaatcacaactcctgcctcctttgagcctcctgccaccagttttgatagttcctatctctaagtaggctttgtacacaaattcatgagggagtttaaaatagtgtagtctttcctttgctttcaactcttaccagtgtcctgggcaatctgaatacccatggggatgtgccatgcattcagctaggctcccagccttccctggaacttcttgacttcagtggcctttactctatgccgtttttgccacctcataccaagggcttttctcaccaatgtaccagaacagtgaataagagtgagactgcaaggtcaccagctccccctagacctgagactgcattcttagagacagtgttgttttttcaccagcattacctttcaagccacagtcactgctgcaggggctggagagtcatgaaaaccgggtcctgcatcccatgagtgaaggcgttcaagggggacgccaggaccttagaggagcctgttgaacaccccaaccagccaactgaggaacgggaggtaacgtgaggcccaaatgcatccccatactcaagaaaacattcccaggttgaagaagtgacttagcagttgtcagaatgagatcgcagagtgagcaacggctgcccgtgtcccctcccaggagggctgtgaaaggccacagcagacctcaggcactgacccaggcaggctccaggatgcagtgaggtagaatgtgggcgtaggtaatgtgggcagcatgaaatacctggtcccatgatgggatgggccctggagtgctgcagttcttgattcctccaaccccgctgcatctgtcactctggtgagctgctgggaccatccaacttggaccattcctccgtgcaaaacatgacaggcgctgtgagccaggcgtagtcctaccatggagatgagccgcatcctctctctctgtacatctttgcttgtctaccagccggagaccacccatggaggactaatcacaagcactcaaggtcaacgctttcctcctctccccagatccgaggtggctctctgcagtttcccatcccctgcatactgcattccctacacacatgctagaaccccctccatactgcaaacacaattttaccaccaactaagagttccttggactgtgccacatctttttatatttatttatccatttttttcttttgagatgaagccttgctctgtcaccaggctggagtgcagtggcacaatctcggctcactgcaacctctgtctcccaggttccaatgattctcctgcctcagcctcccaagtagctgggactacaggcgcccaccaccacacctggctaatttttgtatttttagtagagagggggtttcaccatgttggccagactggtctcgaactcctgacctcaagtggtccggctgcctcagcctcccaaagtgctgggattacaggcgtgagccactgcgcccggcttgtgccacatctttttaaaaagttttggcacagttttattcaggggaaacagaagaattgggttcactcttcttatgtatttttaagtagccaattttgcttttcagaataaaacactcggaagaaaaaataaaataatataaacaatttttccaaatcactttttttttaaacatcaaatgctacacataagaatagactcccaggggagactgtctgatttttttcctccaaatatcttttaaaaagcaaaataaatccccatttgttccctgatggtataacagccaaaaatgtcagaaaagccgtagaatgatcccatcatcatttgtaaagacctctttcaaccatttgcatccgaatttgcagatgtcagaggtaggacaatgaaatggcaaaaatgcaaagtgagatccagaaagcaacactttcaaaatcaaaatatataatcctttcaaatgttctctggaaagatattccctcttgcactgaacctaccccgggaagttaagagctgaaaggaatctatatgttaataaggcttcctaaactgtctgtaaggcatggaatgaaatgcatgcacaagcagcgcccagcggggtcaccttcaaggtcagcctcacagcgttgcagttctcctgcagcgggttcagcttcagcgtctccccgaggttgctgcagccggacgactggtgctgcagctcacagcagacacacacctccacactgtcaaacttaatctagacagaggaacacagacagacctcaccgttaacaggcattcgacccccgagggtacgcgtgagtgacacagttcagaacacaggaaaatggctcagttcaaaggagcctgtttcagtgtgtttaagtagtacagcaaaaacaatttctattgacccaggccatcaggaggacttcaaattcctatcttaacagcaatgtatagaaaaagcaaaagtacatttgaagaaacttaagctatacattagagaaaatggcaggtggattacaaaatgagataaaggtaaatagattgaaagtcactcatgctgatgtatgcacggagatgtgctatcctagctctgtgccttggctcattctccttccacagtcagaaatttcctgcctcacttcatggcctatcaaactcctgctcatccatcaagacccaactccagcgccaccctcgaggccttgtctggttttcctgcctcactgctactgaagactgactttatccagctacaggtgcatcttatcaccacagtattgacaatggcaacaagttgtaggtgttcaataaatgctgaatgaataaaaacggcttggaaaatggaaaaccatggaagaaaaaaatgcatttcaagtattttaaaaagcagtgttagacgaagagagagtatgagagtctcagtgagagggaagagaacagagttaccagtgcctaggagaaaagcagctttaaaaaagtaaagtcctagccaggtgtggtggtacaccacctgcatttgcagctactcggcaggccagggcaggaggattgcttgagcctaggagtttgagaccagcctggctgggtaacatactgagactctgtctcaaaaatacgtaaataaaaaataataaagtcctagatgtaaaactactaaaaaagaaaatcaggccaggcgcggtggctcacacctgtaatcccagcactttgggaggctgaggcgggcagatcacaaggttaggagttcaagaccagtctgaccaacacagtgaaaccccgtctctactaaaaatacaaaaattagctcggcgtggtgctatgcacctgtaatcccagctactcaagaggctgaggcaggagaatcgcttgaacccaggatgcggaggttgcagtgagctgagatcatgccattgcactccagcctggatgacagagcaagactccatctcaaaaaaaaaaaaaaatcagtaaaatctatgcaattttattcaaaataacactgaacatgaaacaagttattttccttagactaagaagtgccctgctttccaatagataatatgtttacagcagccaactcgaagtacaaatacttttcagacaaatattggccatttataaccataacaaataatttttcattgcatgaatattgctgagactgaggccatacttataaaacctccaggtatcaacatgtccgcctctcctaaatactgggggaggggtaatggagcatcctcagagccaagaaatgtgctgatattcaccagaggaactcagcttagcttaagacttagcccctgccaccccctgctccatgtcaggtgggctttgcgagtggctttcagcaggagaatatgggtagaggtgtcagcttgcagcttctgaacttaagacctccacaggcttcatgtttctgcaccctctccctggaacttccaatatacagcaggaaaagaacagattccagggagctgccagctctccagtcccagcaggaaacccgtggagcacccctgcagaactgttctgccctatggtacatgcacacacaacattactaggtaagatcaaaccatttttcaaataattcaaacaaattatactcccaccaatagggtgtgaattcaggctaatccacatcctcaccaatgcttgctaatgttggacttagacatttttgtccatgcagtaactaatataatagtatctaatttgggggtgggtgggtttgttttcatctttcctcattttcttaaccgttcatattgtgaaacctaacacacatacacaaaaagtgcacaaagcaaacatattcagttcaatgatttatcattaagcaagcacccaccggcccatggccatgttcctaaaaggccttccatgcctcattccctgtcattcctcccacttgctgcaccaaaagctcaccacattccttactttttaaataatcacttctaggcttccacctttatacatttaccactatagtttagtttcacctggttttctaacttgatacaaatagaatcatacaatatttttagtatttggcatctttcattcaaaattacaagattcatctaccttactgcatataaatatagttgatcatgttcactgttgtatattacattgtgtgaatatgctgccatttatatatctattctcttgtcacgggacgtttggattgttgctaatttttttgcaataagattaatgctgtttgatattctgtactagtctgctggtacatacatgtgcatatttcttttgggtacaaaatacctattgatcagagctgctgggtccctggggattttcagctttagcagagaatacaaagccactttccaaagtggctgtaccaatttacacactcaccagcactgttcgagggtccccattactccacatcctggcttgtgcttgttttagtctttttaattttagataagaaagtactggaagaggtacttcttccttgaaatgagggactaagccaagaaaaaaagggaagatgggatctaacacagaaaagagatagaggaagttctaagagaatgggaaaaggatgtcctagcatggtaaatatatagactgcctataggctgacttgttcagactgaagcaggaaacaggctcaatggaaacgtctctaagaaaatgaagctgacagaacgcttgatgggtaggactgtattcagaggagattttcagttctcctgggaagtttgagagtaaattaggaacagagacactaaacaaataataaaacaattttaactcagcataaaagacaaatcatatatagtacatggttttgttatatatgcggcttgtaaatattttctcagtctatagtttatctttttatcctctcaaaaggatcattcattgagtaaacgttttaaattttgatgaaggccaacttacatatttttgctcctacacttttggtgttgatctaagaactctgcctagccctagatctttctcctatgttttttctaaatgttttataattttatttttacatttgattgcatgacccattttcagtcacttttagtgaaagatatgagacttgggatgaggttgactatttttgcctatagatgtccaattgttccaacatttgttgaaaaatctatcttttctttgcttaattccttttgacttttgtcaaaaattagtcgggcatatttgtgtgtctctatctggattctctctttgttccattgatctatctttccaccaaccaccaagtcttgattactgtggctataagtctggaaatcaaaaaattaattcctcccatttaattcttatttttcaaaattatttgtctctccatatacattttttttttgagacaggtcttgctctgtcacccaggctggagtgcagtggcaccatctcagctcactgcaacctccgcctcccgggttcaagcgattctcatggctcagcctcccagatagttggaattacaggagcacgccaccatgcctagctaatttttgtatttttagtagagacaaggttttgccatgttggccaggctggtctcgaattcctggcctcaagtgatcctctcacctcagacttccaaagtgctgggtgtacaggcgtgagccaccacacctcgtctccatatacattttagaataagactgtcattgtctccaaaaaaagtgttgctgggattttgatagggattgaatcaaacccagtttcttttttttttttgagatggaatttttgctcttgttgcccaggctggtgtgcaattgcgtgatctcacctcactgaaacttctgccttctggattcaagcaattctcctgcctcagcctcctgagtagctgggattacaggtgcccgccaccaggcccagctaattttttttgtatttttagtagagatggggtttcgccatattggccaggctggtcttggactcctgacctcaggtgatctgcctgccttggcctcctgaagtgctgggattgattacaggtgtgagccactgtgcccagcccaaacccacatattaactggggggaaatggacatatttactacattgaattttccaatttatttatttcctcattgttaacgcagttttcagtgtatgttttgttagatttacacttatgtatctttttaagcgatttttaatttcagtgtccatatgctattaatatgcagtattactgttactatacagttcactattaatacacaagaaatacaattgaattttgtatgtttatcttgtatcctacaactttgctgaactcacttattaattctaagaggcttgtttgttctgtttgttttttaaagattctttgggattttctacatagatactcatgtcatccacaaacagagttagttatatttgttcttttctaatctttatgccttttattttattttcttgccatactacattggcttgaaattacagcattatgttctatattgaaaaaaatggtacgaatgagcatgcttgccttgttcctgatcttaggggaaaagcattcagtctccattaagtgtgttagctgtaggtcttttgtagatgctctttttcaagttgaggacgttctctatgcctatttttctaagtttcctttttagttatgaaaaggtgcttgagtttgtcaaatgctttttctccaacaattgatacagccatgcagtttctcttctttagcctgttgatatgatagaataaattgactgatttttgaatatcaaaccagttttgaatccctggaataatccctcttggcaatgatgtatataactcctttcagatatgttgaattttattcgttattattttgttaaggatttttgtatctatattacattaataagggatattggcctgtaattttatttttctatactgtctttgtctggattttggtagcatggcaatattactttcacaaaaatcaatttggaaatgttccttctattttttcagagaaattgtgtagaaatggtattaattctataaatgcttaatagaattctccagtgaaaccatctggacctggagattttgtttttggaagttttagaattataaattcaatttccttaataattatagggctattcaaattctctacttcatagtgtacgagttgtgttagttcgtgttttccaagaaattgatctatttcatctaagttgtgaagttcatttgtgtaaagccattcctattattcccttattatccttttgatgtctgctgggtctgtagttatatcccggtttcttcccagacattgggaatttgtgtcttctaactttttttcttgctagagttttgtcaatgttgttgatgttgtcaaagtatcagctcctttttcattggtttttctccattggttttctgttgtccatttcattgatttctgctctttcatttatgatttcctgacacctatttgctttgggttgattatgctgctctttatctagtttctttttttaattttatttttagttgagaaataattctatattacatatttatggggtacagtgtgatgtcttagtaatgtttacattgcagaatgattgaatcaagctaattcacaaatcacctcccattttaaaaattttttttattttactttaagttctgggatacaggtgcagaatgtacaggtttgttacataggtatatatgtgccatagtggtctgctgcacccgtcaacccatcatctaggttttaagccctgcatgcattaggtatttgtcctaatgttctccctccccttgcccccaacccctgacaggccctggtatgtgatattcccctccctgtgtccatgtgttctcactgttctactcctacttatgagtgagaacatgcagtgtttggttttctgttcctgtgttagttttctgagaaagatggcttccagcttcatctacatccctgcaaaaggcatgaacttattctcttttatggctgcatagtattccatggtgtatatgtgctacattttctttatccagtctatcattgatgggcatttgggttggttccaagtctttgctattgtaaatagtgctgcaataaacatacatgtgcatgtgtctttgtggcagaatgatttataatcctttgggtatacacccagtaatgggattgctgggtcaaatggtatttctggttctagatccttgaggaattgccacactgtcttccacaatggttgaactaatttacactcccacaacagtataaaaccgttcctaggccgggcacggtggctcacgcctataatcccggtactttgggaggccgaggcaggcggatcacgaggacaggagatcgagaccatcctggctaacatggcgaaaccccgtctctactaaaaatacaaaaaattagccaggcgttttggcaggtgcctgcagttccagctactggggaggctgaggcaggagaatggcgtgaacccgggaggcagagcttgcagtgagctgagatcgcgccactgcactccagcctgtgtgacagagcgagactctgtcttgaaaacaacaacaacaacaaaattgttcctgtttctccacagcctcaccagcatctgttgtttcctgcctttttaataattgccattctaactggcatgagatggtatctcattgtggtttttgatttgcatttctctaatgatcagtgatgatgagctttttttcatgtttgttggctgatatatttatctttttgtggtgaaaacatttaaaatctactcttaagcaattttgaaatatacgaggcattatttattttagtcatcattttgtgaaatagatcactaaaacttactccaatctaactgaaattttgtaccctttgatctatatcctctttggcttcaactgtttccctttgctgtgatcaactggacaggagtccagctctcctgaaacagttcactctcccacgtctcaaaaacattcaaggaattatctcatatgatcacatctctaggctaggcattaagattgaagtagctatcataaatggcaagacattttcctcagtctgaaggatcatccggggaaagggaggggagatcagcttgtctggaaagcatgatttatcaaataaaataacccttcaatgaccccagggaatagacatccaaataaatcttttccatcagttatttcactgagtttgtgattaattcttaggaaaattctgaaaacctcctggttagttccctgacctcgacatctgggtgtgcaggcggctgacagatttattttaagagtacccctcagtgttcgggtcattgggaacgacaccgcagagctttgcaaatgaggccacagtaatttttcacaaatctctttggggcacttaacagctagcctgccccccttatttatggtctatcagcctgtctgggagtagaaagggcttatacaacaaaaagagggggatgcccccacgattctcttacagaagtacaaatgggatgggtatgtgaccttcagatattctcaaagggaaggcagtgtgggaaggctgagcatgtaggcagagcagggcagagggctgggaagaggctggcatgtgtcaagcccgagaacttacagtgggcacaccaaggccagtatccttggatgtgaggagcctgtttcgaggaggaaggaggcgcagcacgggtgacagagtcagactactcacagtcctaactgccatggagtgacccaggacaagccatgtgacctctctgggcttcaggttcccggaccccagtgaggatcaaatgagattagacaggtaaaaatgcagagtgccaacgctatttgccggtgttattgatgttgctattatttacattaaagaaaaaatttgtagaaactagaccctaagttttcttcccaaaggttcaaacaaagctacaaaaactagaccctaatttttaaattgtggtaaaatacacacaacataaaatttaccatcttcaccatttgtcggcatacagttcagtggcattaaacatattcacctcgttgtgctaccatcaccaccatccacctccacaactttttcatctttccaaactgaaactctgtcaccactaaacaaatccccattccctctcccacaggcccccaacaactcccattctactttctctctctgtggattcactactccaggtacctcctgcaagtggaatcaggcagtatttgtccttttgtggctggcctatttcactcagcatgtcttcaaggttcatccatgtggtagcacgtgtcgagatttccttcctttttaaggctgaagaatgttctatcagatgcatctaccatattttcttgataattcatctgtagatggacacctgggatgttttcagctcttggctgctgtgaataatgctgctatgaacatgggtgtgcacatatctatttgagtccctgctttcaattatttgggtaaattcccagaaggggaattgctggatcatgtggcaattctctgtttaatgatttaagaaaatgtcataatgttttccacagcagctgtgccattttacgttccaccaagagtgtacaaggcttccaacttctctacatcctcaccaacacttattttctgggttttcaaaaaatcatagtcattgcagtgggtgtcaggtggtatctcactctggtttcgagttgcatttccctaaccattagtgatgttgtgcaccttttcatgtgcttactggccatttgtatatattatttggagaaatatctattcaaatcctttgcctgttttcaaattgggttgtttgtgttcttgttgagctgtaggagttctttatacattccggatagtaacctcttatcaactatacaattggtaaatattttcacccacggagcctcttctgttgattgtgttctgtgatgaacagaagtcaattcaactttttgaatacttgtaggtttccatcactttcacaaaaactgtcagtaacctgttgatttctccctaacccagtaatttttgcttcctttgtctcaagaatgagccaccttaagtcttgctgcagaggtaagcatctcacttgcctcactcagtccttgtcctgctttctgagcaatgccactgtcctgcagcatccctgctggtggtgggagagggtccccacaacaccagccccaatgacacaggacgacataactgcctttctctggactactattaacaaataccacagacggggtggcttataaacagtagaaatttatttctcagagttctggaggctgggaagcccaggattaaaacaccagcagatttggtgtatggtgacatcctggttcacagatggatcactgtgtcctcacctggcagaagagacaaggcagttttctgggacttctattataaaggcactaacccactcatgcgggctccacccacatgacctaatcacctcccaaggaccccacctcctaataccatcaccatggaggttagaatttcaacatagaaattcgggggtgggggacacaaacattcagaccacagcaaaaacccttatgctggtgatgctcaaggcacttaaaggcactggtaagaccccaaaaactccagtaatcacagtgcaacatgggtggaccctgatgacattatgctaagtcaaagaggccagataccacagatcacaccccgcatgattccattcaacatccagaacagaaaaacccacagggacagaaaccagcttagcagttgtctgggactcagtcggggacaggggccaatccggggtgcgacataaagggtatggtatgtttttttgaggtgatgaaaatgctctaaaattgactggggtggtgacgcacatacggtaaatatactaagaaaacactgaattttacactttaagtgggtgaattgtatgatacgtgaattatatcacaataaaggtgtttcagaaaaaaattaccaccacacgtaattactaactcatttagtttggttttaatcccttccgtgttctgcctaaacgttttatattcacacacgtgtcaccaacatcgacagtttgggaccaatcaaaactaccttcaccactgtctccccggcataaactcagggccaacatagacatgctccgtaggttggatgacacggagccactttcccgcgagtggctcaaagctactcgccaagcagctcctgcagcagtgccctcagccagcccctccagctcttccttactccagagcatcaaggactgggcacctttttgttcctggagagatgctgaatgcagtccctgccagacctgaggacaaagccggcccattattggggtgtttcccctgtgctacacactaggcgtggaagcatttggactggcattgtgtccagaattggttcccgcccgtggcttcctggtctcaccgacttcaagaatgaggccgcagacgttcccagcgagtgttacagctcttaaagattgcacgaacccaaagagtgagtgataacaaagtttattacgaagagcaagagaacagatcttccacctcctacgagcggtgtgccgctgccggttggggggcggggggggtggccagcttttattcccttatttgtccccgcccatgttctgtttctgtcctatcagaatgcccttttctcaatcctcccccacgattggctacttttagaatcctgctgattggtgcattttacagagcgctgattagtgcattttacagagcgctgattggtgcattttacaaacctagctatagggtgctgattggtgcgttttacaatcccctggtaagtcagaaaagttctccaagtccccactccacccaggaagtccagctggcttcacctctctcttccttactccagagcacgagggactgggcacctgtttgttcctggagaggtgctaaatccagtccctgccaggcctggggacaaagccagctcatcactggagggtttccctgttctgcacaatgggcgtggaatcatgtggatgggcgtgtcactgagggatccccccagcctccccactaggttgggaatgcagccatcagtgggggtcaccccaccttccctgccaagctagggacacaaacccccacgctggcccctcctagcctgtagcccccctgtcccctggggggcttacaaatgccgggacttctgagaactgagactgccttttgtgtcccctacagcagggatggcaaacacagaccacacatcccaccatttccctcttttgctttcaccctcccctccccccaccctgagtccagataacagccttagaatcctactcaacacactgttctgggcacttaatgccaggcagaggaagctggcacacaacgtgaaacctacttgccatccctgtcctacctataagtagatagggccaaaaataggagaaaataaaatgtttatgaccaaatacataaagacattgtaaaatgttgatgcttgctaggagggaattagctgactccttaaaaacatgtgtcatctactttgaaatgatcgagaaatgctggcaaatagggcagcctcagagtgctctcaagcctctgcccagtggcaggggaagcaattctctctgtgcttctgcaggaagcgacagctgaggtttgagggaggcgccagcacaccacagatatcagattcctcagtaaacagaactcacatacacccctggtgggagtgaaaattaatacgaacaacttcggaaaacacacagtttggcagtatctaccaaagctaaacatacctatacctatatacctataggtataccctacatcctataacctacagacttcccctctggtgtaaccaacagatggatgttcatccaaagcaatacacgagaatagccatgcctgtgtatccacaatagcctcacactgggaggagagtggggaaaacaaaactgcgaggtactcacacaatggaaaattggaaaccagagctacttgcaacaagatgagtgaatctaaccgacatgttgaatgaaaaaagcaagaaataaaagggtcaattacatatgattctatttataaagctgaaagccaggaagaattcttttgtgacattagaagttaggatagcaggtgcccatgaggagtgtggtatgagtgactgggagaaggaggggcggggctcccggggatgctggagatgttttacttctgatctaagtgttggttccatgggtttgttcacctgtcaagagttactaggttcagtacttacaatgtgtgctttcttctctggctatgtctgagctaacacagaggattaatttttaaaaaatacacaaatctgtctggtcgtggtggctcatgcctgtaatcccagcactttgggaggccaaggtgggcagactgcctgaggtcaggagttggagaccagcctggctaacatcgtgaaaccccgtctctactaaaaatacaaagattagctgggcgtggtggtgggcacctgtaatcccagctacttgggaggctaaggcagggatatcacttcaacccaggagtgagaggttgctgtgggccggtatcaccccactgcactccagcctgggcaacagggagagactccgtctcaaaacaaaaacaaaaacaaataaaaaatacacagtagtccaggggagagtctgttgcttatgactgagtggacctcaaggcctgcctcagtttcccacagagagagaaggaccatggtcatgaggagaccttccagggatggtggaagcaaaagagaaagttgcattttgattttggttcctccgcctggaaagtgcgggtctcacacagggaaaaggtgggcttcttccaagactcagcctgagcatctccctctgctctcggggactgagtttccctcttcctgtgagtctctctgtgccctggtacccctgcagggtcactctacccagctgtcaccccctcagagcacaaactgctccctggcatcgggtggctgctcacaactgactctgaaattagtggaaggatgtaaaagtaaaaagttggatgcaaaagtgtcacctgggttaattcaactggattgtaaaggtttcaagaaggttttgtataatgctttttactttctgcattttaagatgctttgacatcttggggtctactaatccaggagagactgccctcccagggctagctaattccttcagataataagaaactcacctgcaagcccacttttcctatgcagaccaaccaatccacagcccacacctcgaactacacccttcatttaactctcacaactaagccactatttcccctgccctaaatcatcccagggccaggtaaggtactagacaactgggggctactcctacagccaacaggtcaaaccagccaattctcacctgggtcaaacgtgcctgcacattcttccccacaaaaaccacaataaaggatctggcccatgctgtcccctagatcaggggtccccaagccctgggccacagaccagtactggtccttgacctgttaggaactgggtctcacagcaggaggcaagcagtgggtgagcattattgcctgagctccgcctcctgtcagatcatcagcagcattatattctcataggagcgcgattcctattgtgaactgtgcatgcaagggatctaggttgcacgctccttataagaatctaatgcctgatgatctgaggtggaacagtttcatctgaaaccatccctgacctggaccctcccccagttcatggaaaaattgtcttccacaaaactggtccatggtgccaatatggttggggactgctgccctagatccctctgagcttctctgtgtggtcttgcctgggtagcatggcccttcctcttggaaactgcgagtaataaactcttctttcaaagcagtggtctctgtgtctggcatcccaccgtaatggactacaacaaatcccaggtaccttttaagataggcttgcaacttaaagatgatacagccttctctaactatctcttatcccaattcatctctttcctatgtatattttcaatagacacctgtgcttcaaatgcattaagatacgtcccagaatgcaatccatgggtatgaactgtgcaggtaccacatgttactcctaacacttaggatcagatgattaatagaaggggattgtctgtaaaatatgcagttattcaggttactacataataatggaaagagtaaaaaatcaaattatttcttcagtcttttactacgaagatttctgcattttgtttttgctactgctataaatgagggaggcctcatttgtcctatagtaaaatgatgaaaatctgcccatcatcccctctacgatgaagccagtggagagtcatggtgttctgtgaccgtggtgctgtgtggcagagtgcactcaaccacctctcagacacactcgatgtgtgccctgcagccctgaggctgctccacaagcccctcccagcatgacccagcccctgttccagtgacttcagatctatgtctcacttcacttcagaattctttaggacaaatcgttttcagaatatgggaaattactttcccttgtctgattgccctggctaggacttcagtagtgtgttgaagaggagtggtcagagtgggcatccttgtcttgttccagttctcagaggggatgctttcaacttttccccattcggtattatattggctgcgggtttgtcatagatggcttttattacagtgagatatgtcctttgtatcccgattttgccgagagttttaatcataaagggatgctggattttgttgaatgctttttctgcatctgttgagatgatcatgtgatttttgtatttaattctgtttatgtggtgtatcacatttattgacttgcatatgttaaaccatttctgcatccctggtatgaaacccacttggtcatggtggattatcttttgatatgttgttggatttggttagctaatattttgttaaggatttagcatctatgttcatcaagaatataggtctgtagttttcttttttggttatgtcctttcctggttttggtattagggtgatgctggcttcacagaatgaattagggagggtctcttctttctctatcttgtggaacagtttcaaaaggattggtaccaattcctttttgaatatctggtagaattctgctgtgaatccgtctggtcctggacttttttttgttggtaatttttaaattgtcatttcaatcttactgctggttactgttctgttcagggtatctaattcttcctgccttacgctaggagggttgtatttttccaggaatttatccgtctcttctaggttttctagtttatgtgtgtaaagttattcacagtagccttgaatgatcttttgtgtttcagtggtgtcagttgtaatacctcccccgtttcatttcttattgagcttatttgggttttctctcttgttttcttggttaatcttgctaatggtctatcaattttacttatcttttcaaagaaccggctttttgtttcatttatcttttgtatttttttgtttcaatttcatttagttctgctctcatcttggttatttcctttctttttctgggtttgttatttcctttcttttgctggttcttgtttctctagttccttgagatgtgaccctagagtgtcagtttgtgctctttcagtctttttgatgcaggcgtttagggctatgaacttgcctcttagcaccgcctttgctgtatcccagaggttttgacagtttgtgtcattattgtctttcagttcgaagaattttttaatttccatcttgatttcatttttgacccaatgctcattcaggagcaagttattctgtgcagaagctctttagtttaattagatcccatttgtcagttttggcttctgttgccattacttttggtgttttagatgtgaagtcctggcccatgcctatgtcctgaatagtattgtctaggttttcttctagggtttttatggttttaggtctaacatttaagtctttaatccatcttgaattagattttgtataaggtgtaaggaagggatccagtttcagctttctacatatggctagccagtttaccctgcaccatttattaaatagggaatcctttccccatttcttgtttttgtcaggtttgtcaaagatcagatggttgtagacgtgtggtattatttctgagggctctgttctgttccgttggtctacatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcttatccatgagcatggaatgttcttccatttgtttgtatctcttttatttctttgagcagtggtttgtagttgtccttgaagaggtccttcacatcccttgtaagttggattcctaggtattttattctctttgaagcaattgtgaatgggagttcactcatgatttggctctctgcttgtctgttattggtgtataagaatgcttgtatttttgcacattgattttgtatcctgagactttgctgaatttgcttatcagcttaaggagattttgggctgagatgatggggttttctagatatactatcacagcaaaagaaactaccatcagagtgaacaggcaacctacagaatgggagaaaatttttgcaatctactcatctgacaaagggctaatatccagaatctacaaagaactccaacaaatttacaagaaaaaaacaaccctatctaaaagtgggtgaggatatgaacagacacttctcaaaagaagacatttatgcagccaacagacacatgaaaaaatgctcaacatcactggccatcagagaaatgcaaatcaaaaccacaatgagataccatctcatgccagttagaatggcgatcattaaaaattcaggaaacaataggtgctggagaggatgtggagaaataggaacacttttacactgttggtgggactgtaaaccagttcaaccattgtggaagacagtgtggcaattcctcaaggatctagaactagaaataccatttgacccagccatcccattactgggtatatacccaaaggattataaatcatgctgctataaagacacatgcacacatatgtttactgcggcactattcacaatagcaaaggcttggaaccaaccccaatgtccaacaatgacagactggattaagaaaatgtggcacatatacaccatgcaatactatgcagccataaaaaaggatgaattcatgtcctttgtagggacatggatgaagctggaaaccatcatctcagcaaactatcgcaaggacaaaaaaacaaacaccgcatgttctcacatataggtaggaactgaacaatgagaacacttggacacaggaaggggaatatcacacaccagggcctgttgtggggtgggaggaggtgggagggatagcattaggagatatacctaatgtaaatgacgagttaatgggtgcagcacaccaacatggcacatgtatacatatgtaacaaaccagcacgttgtgcacatgtaccctagaacttaaagtataataataaaaaaaaaaaatgtaaaaaaaaaaggagcaagttatttaatttccatgtatttgcatggttttgaaggttccttttggagttgatttccagttttattgtactgtggtctaagtgcttgatacaattttaattttcttaaatttattgaggctcgttttatggcctatcgggctatcttggagaaagttccacttgctgttgaatagaatgtgtattctgtggttcttggatgaaatgttctgcatatatttgttaagtccatttgttccaaggtatagttcaaatccattgtttctttgctgactttttgtcttgatgaccttgtcttgtgctgtcagtagagtactgaagtccctcacgattactgtgttgctgtctatctcatttctttggtctgttagtaattgttttatgaattttggagctccagtgttaggtgcatatatgtttaggactgtgatattttccggttggacaaggccttttatcatttgtgatgattaataccaagtgtcaacttgattgaattgaaggatacaaagtattgatcctgagtgtgtctgtgagggtgttgccaaaggagattagcatttgagtcagtgggctgggaaaggcagacccaccctcaacctgggtgggaacactctaatcagctgctagtgcagataagactataagcaggcagaaaaatgtgaaaaggagagactggcctagcctcccagcctacatctttctcccatgctggatgcttcctgccctcaaacattggactccaagttcttcagttttggaacttggactggctctccttgctcctcagcctgcagacagcctattgtgagaccttgtaataatgtgaattaataataaactcaaatatatataatatatatatatatatatattccattagttctgtccctctagagaacctagactaacacaccattatacaaatgtcccactttgtctcttttaactgctgctgctttaaagtttgttttgtctgatataagaatagctacccctgctcccttttggtgtcaatttgcgtgaaatgcctttttccacctctttaagtttatgtgagtccttatgtgttgggtgagtctcctgaaggcagcagatggttgttgagttctgatgctcctgaagcatggagttctgagtttcctgagggcagcagtgggttggtgagttcttatctattctgtggttctgtatcttttaaggggagcatttaggctatttacattcaatgttagtattgagatgtgaggtaccattgcattcattgtgctatttgttgcctgagtactttggtttttttgtttttgctttttaacttgtatttttgttttataggtcctgtgtgatttatgctttaaagaggttctgttttgatgtgtttccaagatttgtttcaagatttagagctccttttagcagttcttgtaatggtggcttggcagtggcgaattctctcagcatttgtttgtctgaaaaagatggtatctttccttcatatatgctgcttagtttcactggatacaaaattcttggctgataattgttttgtttcaagaggctgaagatagggccctgatccgttttagcttgtagggtttctgctgagaaatctgctgttaatctgataggttttcatttataggttacctagtgcttctgtgtcacagctcttaagattctttcctttgtctaactttggataacctgatgacaatgtacctaggtgatgatctttttgtgatggatttcccaggtgttctttgtgtttcttgtacttggatatctaggtctctagcaaggctggggaaaattttctctattactcccccaaatatgttttccaagcttttagaattctcttctttctcagggacactgatcattcttagggttggtcattttgttacacccgagcgagttccatggtttgcaaacatttaaaaatgaacttatgtttctaaacattctgtagctttcttcttcctattgactcattagcaatatttgttttttcctgattataaaagtaacaaatactcaatgtagacattttataaaacatacaaaagtaaaaagatgtaaattaaaatcatccataataaaaatggcttaatactgtgaaccattgtttaaaaaaaagaaaagaaaagaaaagaaaaacaccacactttgagacaaattaagagtcctttatttaagccggcggccaagagagggattgacgctccaaaattctctcagccccaaagaaggggctcgatttaacttttatatcttggtttaggaagggggggtctagttaaaacaattttacagaagtaaagtaggcaaaagttaaaaggataaatggttacaggcaagtaaacagttctaggtgcaggggctttaagacaattacaaggtgataggcccggggcttggggcgttatcaatcagaggaattcctaggaattgtggatacagcttgccacagtatcttatcagttaattgcattcttggatgtgctgggagtcagcttgcagaagttaagtccttgaggaaggggctgccagtgaaagagccaagatagaatctgtctggttctcttagctaaggaagagtccattcagatggaaacaaggctaggtgattaaaggaaaaagggagagtctaaaaacatggttagtaaaaacgaggttgggcattacaatttaacatagtcccagacttcttggaggcttcgttcatattttttcttttttctttatctttgttggattgggttaatttgaagaccttgtcttcaagctctgaatttctttcttctacttgttgaattctattcctgagactttccagagcactttgcatttctataagtgtgtccagtgtttcctgaattttttattgttttttccttatgctgtctatttccatgaatatttctcccttcacttcttgtatcatttttggatttccttgcattgggctttgcctttctctggtgcctccctgatttgtttaataactaacctcctgaattctttttcaggtagatcagggacttcttggtttggatccattgttggtaaactagtgtgattttttgggggtgttaaagttttgtcatattaccagggttggttttctgattccttctcatttgggtaggctctgtcagagggaaggtctagggctgaaggctgttgttcagattctttttttcccatggggtgttcccttggtgtggtaatctccctctttgcctatggatgtggcttcctatgagcggaactgcagtgattgttgtctgtcttctgggtctggccacccagcaagttctatcaggctccaggctggtactcagggtggtctgcacagagtcctgtgatgtgaaccgtcaatgggtctctcagcgtggatatcagtgcctgttccggtagaggtggcagcggggtgcaatggactatgtgagggttcttagctttggtggtttaatgctctatttttgtgctggttggcctcctgacgggaggtggcactttccagaaagcattggctgtggtgggtgtggagaggaacctacggtgggcagggccctagaactcctaagagtatatgccctttgtcttcataccccacgctcatggatgggtagaatcaatattgtgaaaacgatcatacggccaaaagcaatctacaaattcaatgcaatccccatcaaaataccaccaccattcttcataggattagaaaaaacaattctaaaattcatacaaaaccaaaaaagagcccaggtagccaaagcaagactaagcaaaaagaacaaatctggagtcatcacattacctgttttcaaactatactataaagccacagtcaccaaaacagcataatactggtataaaaataggcacacagaccaatggaatagaatagagaacccagaaataagcccaaatatttacagccaactgatcttcgacaaagcaaacaaaaacataaagtggggaaaggacaccctcttcaataaatggtgttgggataactggctagccacatgtaggagaatgaaactggatcctcatctctcaacttacacaaaagtcaactcaagatggattaaagacttaaatctaagacctgaaactataaaaattatagaagataactttggagaaacccttctagatgttggcttaggcaaggatttcatgaccaggaacccaaaaacaaatgcaataaaaacaaagatagtcgggacttcaactaaagagcttttgcatggccaaaggaacagttatcagagtaaacagacaacccacagggtggcagaacatcttcacaatctatacatctgacaaagaactaatttccagaatctacaatgaactcaaacaaatcagtaagaaaaaaaaaacaaacaatcccatcaaaaagtgggctaaggacatgaatagagaattctcaaaagaagatatacaaatggccaagaaacatatgaaaaaatgctcaacatcattagtcatcaggaaaaggcaaatcaaaaccataatgcaataccatcttactcctgcaagaatggccataatcaaaaaatcaaaaaatcaaaaaatagtagatgttgccgtggatgcagtaaacagggaacacttctatgctgctggtgggaatgtaaactaatgcaatcactatggaaaacagtgtggagcttccttaaagaagtaaaatagaactaccatttgatccagcaatcccactactggttatctatgcagaggaaaagaagtgattatatgaaaaggatacttcacacgcatgtttatagcagcacagttcgcaattgcaaaactgtggaaacaatccaaatgcccatcagtcaatgagtgtacaaaggaactgtggtgcataaatatatatatatatatatatatatatatatatatatatatatatatatatgatggaatactactcagccataaaaaggaatgaattaatggcatttgcagtgacctggatgagattggagactactattctaagtgaagtaaatcaagaatggaaaaccaaacatcgtatgttctcactaatatgtgggagctaagctatgaggatgcaaaggtgtaagagtaatacaatggactgtgggtacttgaggggaaaagtaggaagggggtgagggataaaggactacaaataggatgcagttatgctgctctggtgatgggtgcaccaaaatctcacaagtcaccactaaagatcctacgcatgcaaccaaataccacctgttcgccaataacttatggaaaaataaaaaataaaaataaaaaagaaaattggaaattaaagctttaagtagagaggcgagacagtaggccagaagtcgctgtgcttaatggcagcagccctggccacctgcctgatttctagggcttatttgaggctgtgggctggggagacccgctgggctggctcaggggtctgcgtgggctggctccagtgcccagcctagaaccttcagggacttggcctacgcaaagcctggcctactagttttcatttagcgcatgtgaattcagagaaaccaggatcagaaaggttcctattaggtctgttatgattctgtccaagctcattagaatttaaatttttacctttaaacgcacgttatttttggctctgcattgcatttattattatattttatgcaaagaagcctggcctttatgaccgatcagtatttgtgatttttcacttttcatgcaattaaagcccattagaacacagccacgtggcacaggaaatgcactcatgtggctgaggaaggagaggagctgccgcattctttgtttctaattgtgctttatctgctaattgcgtttctacctgctccacaggaacggtgggaaacttacatcgaaaaatatatatctaaaggaatttagaactcctttaaaatctcaaatctgatgagaatctagggttttctttggtgcatgaacgtgtatacacaaaacatttaggaaaaagttatttaattccagaaaatagaacctttattatataaattatacaattaagtcttataacattcgttgaccttttagggaaaaaaaaaaactacctgcttttcatttctagcatcagatatttcacctttattttggtcttcatttcgtcatattccgtttgctaattcatctcttgctctgcaacagatgttcaaattatttgtgaaatagtagatctgagtcacaggcttttaatttttcatttcatgtgtgccatcgtgaagagggagagagagacaggatgagaataaatctgaggactgtgggaatctgcgatgccagttggaactcctgccaagaaggaaattgtcaagtgagagcaccaagccagaatctggagttctctttgaaagcatgtcttcctaggacacagcaaccgttcctacagccctgggaatttttacaccaccttttaatgcaaatgacactttttttttttttttgagacggagtctagctctgtcgcccaggctgcagtgcagtggcacaatcttggctcactgcaacctctgcctcctgggttcaagtgattctcctgcctcagcctcccaagtagctgggattataggtgcccaccaccacgcccagctaatttttgtatttttagtagagacagggtttcactgtgttggccaggctggtctcgaactcctgacctcatgatctgcccacctcggcctctcaaagtgctgggattacaagtgtgagccaccacgaccgacactttcaaggacagcttagcttgctgagttagtaacgttcacacaagcctcctcttgaacaggaaaataagactggcactcctgaggcactcttatcacacgagagacatggaataagttagagattcctcctccctgtcttgccttcgtctccttctgaggctcttctgttaataatgtagacttgcacttttaggcccgactcagaaatttcattaattagcacggtcatcaaagtagagctccactttgctgacagaaagggagaaagggctaaagagaatcgtgctgggtaacaggaaaataaggaacactgcacgattttccaccacagagacccaagcaagaatgttcgcagcagcagtgcttggaataacaaaagattggaaagaatcgacatgaggttctgtcaagttaacttgggaaaacagtgtttcaaaaacattaaattaggagctctcctgcatgacttctccaacttgtaacatttcagtgtgtgttgttgtcagaggtgtttgaaccagagtaactccatcttggataggggctgggtaaaataaggctgagacctactgggctgcattcccagatggttaggcattctaatgaggtaggaggtcagcacaagatacaggtcataaagaccttgctgataaaacagtttgcagtaaagaagctggccaaatcccatcaaaaccaagatggtgacaagagtgatctctgggtcatcctcactgctacactcccatcagcgccatgagtttacaaatcccatgacaatgtcaggaagttaccctatatggtcaaaaagaaaaggcatgaataatcctccccttgtttagcatatcatcacgaaattaccatgaaaatgggcaaccagcatcccttagggctgctctgcctatggagagccattctttattcctttacttaataaactttcactttactctatgggctcgcctctaattctttcttgcgcaagatccaatagccctctcttggggtctggattgggaccccttttcggtaacactgtcaccctccaagaagagaggctgagcatgctgagtggaccacgttttcctcctcctcttccttcttacatttaaaataacacccatttgcatctcccgtcactcatgctcaggagaatgtgctgtgagaagtgcagaatgagatgttcaggagaggttcaggggcctgcttcagtctccagacattccagcttccgagggggccctgcagggccaccagctccctcacgctcaccccactaggaattactctatttacagacaaaaatgcctgccagttggtatttgtcctttcctagaacataccataaatacaaagcaataaagaataacgtttttatgagtttaagtttttgtctggtctctaatccagcagaatagcatgtgatacaatctcatgactttcagagctatacaggagaaaactgctcatagcagtgtcgtgtgtttccaggcaaaactgaaaacatgaatacagcactggacacctggtcagtccttaacaaattactctccgttgctcaacttcaatgacaagaacaaatcaaacaaagaagctgggcagggctgctgctgactggtcacctgacggccaatggacagtgacttttaaagtttactttcttttattcttgggggagatcatatagtatttgagggtatagttggggaacaccacattaaaaaatcgcaattcttagcttctcttgaaaagtttcgagttccaggttcactaggccgtgggtggcagccgctccctccagacaagtcctcctggttctgggctggagagagtttgtctggcttggctcccggcagcctctgggattctgtttcttcctctctgcaaagaaaggtgcccagctccaatggctctctatcttccatgtggggacacctcttctgctgtcatatctgcacctgtgagcctgttccttcgtagacatgctagcggggagtccagtggacacagacacacatacatgggttgactcagctacgtgtaactggatatcagtttagccactaataccccctaaaaatgagctataaatccgagaaacagttcggatggtcttttttcccactggagaccacacttcttgcagacactaaagccctgctaaacacaatgcgggcccagtagaactcctgtagtggcgctcctggccagggtgggggtggagggaatggaaaggtagccagagaggctggttctggagcccctgcgcctgcagccctttccccagtccctgcaacaggaaggcctcatccttctacactgcaggtatcccagcagacgaaaagcaggcactctctggagagggctcagctgacagaggactgacagacgtcccagtgcacatgaagtaaagtctgaagcttgcccgcccccagctcgcgcccagctctgcctgtgaacacagatagctccacctctgtactcagaagtgtgtccagaattgatgggttcttggtcgcactgacttccagaacgaagccgtggaccctcacactgagtgttacagttcttaaagacaccgtgtccagactttgttccttctggtgttcggatgcgttcacagtttcttccttctggtgggttcgtggtctcgctggctcagcagtgaagctacagaccttcgtggtgagtgttacagctctcaaatcggcgcgtctggagttgttcgttcctcccggtgggttcgtggtctcactggcttcaggagtgaagctgcagaccttcgcagtgagtgttacaggtgataaaggcagtttggacccaaagagtgagcagcagcaacttattgcaaacattgaaagaacaaagcttccacacttgtggaagggaactgcgccgggttgccactgctggctcgggcagcccgcttttagtcttatttggccccacccacatcctgctgattggtccattttacagagagccgattggtctgttttacagagagctgattggtccgctttgacaggatgctgattggtgcatttacaatccctgagctagacacaaaagttctccacctcctcactagattagctagatacagagtgtccactggtgtatttacaaaccctgagctagacacagggtgttgattggtgtatttacaatcccttagctagacataaaggttctccaagtccccaccagactcaggagcccagctggcttcacccagtggatccggcaccgggccgcaggtggagctgcctgccagtcccctgctgggcacccacactccttagcccttgggtggtccatgggactgggcaccgtggagcagggggcggtgcacactggggaggctcccgcagcacaggagcccacggaagttggggaggctcaggcatggcgggctgcaggtccggagccctgccccgcgggaaggcagctaaggcctggtgagaaactgagcacagcagctactggcccacatgctaagcccctcactgcccgggccggcgggctggccggccgctctgagtgcggggccgctgagcccatgcccacccagaactcacgctggcccgcaagcaccaggcacagccccggttcctgctcacgcctctccctccacacctccctgcaagctaagggaacaggctccagccttggccagcccagaaaggggctcccacagtgcagcagcgggctgaagggctcctcaagcacagccagagtgggcaccaaggccgaggaggcgcccagagccagagagggctgtgagggctgccagcatgctgtcacctctcagaagcaggagaagtcccgcccaagagaaaacaaaaactatacacactgactttcggggatctcccaagaaatgctagatgattagatgatccacccgagtccatatagctgtgacagatgatgaaccttgaagatcttgttgcattttggtggggaactgtgggaatcgggcagggaatcactttcacccgcagcttaccaggacctatctacagggatgacaaaagcatcccctaacaggtggctggagacctgaggctcaccaagtgccccagtcatgaaatcacagaaaaaaactaccagaggccagtgcattgctctccctgcctggcaggtgcaaagtcagtggagagaagtagtatcacggtcgagcatgcggtgagaacaacgcccacggaaccgggggacacatggcaagggctgaagctgcaagttctgagcacgtcagcccctgcgcctcacccccaccttcctgttctccaaactgaaatgagcctccgggccttgtccccaaccacttccctgcatcctttaggcctcggcttgcaggccaggtgctcagagaggtattggccacgtccaccacacctccccacgtctttcctcggaggacttcctgttgtctgaaactgtccaccgcagctccccgtgtctttccttggagcacttcctgttgtctgacactgtccaccacagccccccacgtctttctttggagcccgagctgctcaccagaagggagcggagccaggatttggcttgtctccaggacttgtcttgacactgccgtgttcctagcactcagaacatgccggacacggggcgctccctctgtaaaatgtattaatccactgaatcaaagaatgactgaatgtacaccatggacagatagatatttctatggaaccactgttaccttaaaacataccaatttttattttgctgggaatgtttactttgctaggaaagtttactttgctaggaaactttgggggtttggaatcaactttcaaattgcagcttttgcatggaatctctttatctataataatagcaaattcacatgaagaagaatgaaaacagaatgatgttcctacaaacggaaaaattctgggccatcatgacaacgcacaaatagctgtcaaatgctaaatttctcatgaagccaagagaggccaaaactatccctgacctgtgattagtacaataaaggctgtgcctttgggcaacaatgggaacagagatgaagacttcaagccagacagtccagcagccccagcctaaggctatgttctcctgtaatttattactcaggatgaggaagctaaatcagggttgccctggttactatggggctcttccgaggaccctggcgacataattggtgttggcttggagactgaggctttcaattctgagattagagtgctggtaatagaggtggctaccccctcaagaagaaattcaaacaggctttggaaaaaatgagatagtctcaaaattaaggtcctcctccaaaatgtgccactgactgtcttaacctgtggtcctgacagattcagcaacaatacataattggctcattcaaataataattgccttttaaaaatagtaacaaacagaatcatgaaacgcttaaccagatgatgtcagctaactgaactaggttgtcacacacagagagagcagcgtctgctgtgaatatcctgctcagatcacccttcggcagacatttcccgagttactgccacagccccgtgctggacactcagaggaggaagaactctggggatagcggcttggaggactggctggagggggaatgacatgggatgtggcccaagaaacagattttccaaagagaaagggacagtaatacagagaacaggcaggaagagggagataggactggaatatagttcattaaaatggaattcagccaggggcccttctcaggcacccagaaccctcatggctctgccaccaggctgagaatagcaaacaaaggtgatcgggtcccagaaatctgaaacacgtttttgagcatctggggatctgtgccctgtgtttgcaggctggtcttaaaggcgcctggagtttacagggggcggtgagcaaggcaggaaaagcggaggagcggcctgcatatttagggtgcaagggtctgcgatgtcaccctcacacctacacccacagtccataagggtcatcaggctcatcagctgggtggtcgctgcaggccagaaagggctgggaggacaaagcacagaacagggatgcccacccctcctgctgtcatgaggctaaatctgcttcccccacacccagccgccaccagggagagaaggagaagacggaaggaaagaggataggaggggctgaataccttctggaaagagacaaagttaatcctggggagactgttttaaactggtaaagggggaaccactctgcagtggtaagagttgaattcaatttttctaaatcagtggccacagaagtaactcacttctacatgccaagtagaaatcagttacagaaaatgaagaacacatttctgcagttctgagccaagatatgagaattttaatcacaccacatataacagaagtcaacaggattgagactaaacatctctcataaacataagtagacaaaacttgccgatgagaaaaaaaaaagaaacttgaaaacatgatgctaagtgaaagatgccagacacaaaaggacaaacactgtgccgggcatggtggctcacacctgtaatcccaacactttgggaggctgaggcgggtggatcagtttgagaccagcctggccaacattgtgaaaccccgtctctactaaaaatacaaaaattagctgggcatggtggcgggcgcctgtaatcccagctactcaggaggctgaggcaggagaatcgcttgaactagagaggtggaggttgcagtgagccaagatcacgccactgcactctagcctgggcaacacagcaagactccgtctcaaacaaaaacaaaaacaaaaacaaaacaaaacaaaatactgtatgcttccacttacatgagtgacctagaatgggataaattcatagagacagaaagtagaatattggttatcaggggctggggaagcagagaaatgaaaagttattgtttgatgggtataaagtttctattagggatgatgaaaaagttctggaaatggatgttggtcatggtttcacacaatgtgaatgtacttaatgccactgaattgcacacttaacatggttaatttagtaaactttatactgtgtatattttaccataaccaaaaagaaaaaggactctcactttcataagtagaataatatactgtttaattattaatttagaagcccaatcaaaaaaggaaaaaaagtcaaaaggtacaaattatcagtgagataacagaccttgcacacagaggaacttaacatattagaaatgtacaaaaatattgtaaaatatttactaaataatactatgaactattttatgctcatgacttaaatgatgattcaaagcccaaatagatcacaaatgtaaaaaaatgcaaaaattgccaaataactatatccttagctatcatcagtctgacagtttaattggtgaatcttttcttttcttttttaaattaaaaaatttttattaggaacatttttgtccttggtaatacttccgaataaagaaatctatgaaaatgctatggaaaattaaattaaacaacatataaaatcacctgggcacctggaagatggtgaagaaatattttgtgacataaatataaaactgaactatcaatttttaaaaagctttagtgtttcgttaaaagtatgaaaaagaaatttaaaatatgcttaaataatcattagagatatattcagaaaggaaacttattaaatgtactacttttttcattctccatggtaaaactgagaatgagaatcttggtaaaggttaaaattttgaaataatagcgtatctggggacatcaactattccttacatcttgaacacacaatctttctatttacactgtaaacatgctcagttttgaacctaccaccccctatacctgacattatctttgctctatctttcaattcttaattgagcttatggaaagagacataccaatgtctctacctttttttccccaaacctttctcctcaaaccactactatctggtttctgcttccactacatcatatctgaaactaaaatgtcaaagcaatcacgttgccaaatgtgaaaaaggatttcccagaccttttgggagttggtatcattgcttcacatggcattactaacctgtcccttcttgtacttgttttctcctggctttggatatggcattctttctgccctgcatacttctctatcattcctgtttggtctcattagctagatccttttctctacttgctcctgtagtgcagactctgctcttctcattttatcctctttttctagacaatctcatccactcccatggtttcagttgctatctataaactatctttatctctatctcagaccactttggtgacttccagcatcatacagccatccaaccatctgtgagatttctccatgtggatatccaaagacacttcaaacttaacattaaaaaaaaaatctcacataccttcttctcccctcaaatcagctgttcctcctaaaatctctaccttggctgatggttcattatcaccctgtcaagacacctggatatcatactctcattcatttctaacttagtctcaaagtcccatgaattcaacctttcaactatttttaaaatctgtccattcccacttctcaccactattgccttaggttggatccttcataatctcttaggtggactatagcaatggcctcttagatgttcttggcgtttccaatcttatttcttccaatcaatcatttataatgttgccaaaatgatctttccaatacgtaaatctgatcacatttctcccaagctgaagtaatccctacagctcttaaataattagttgcttaaagaattcatttactcactcatttaacaaatattatttaccacataacgtatgattttaggcagagaggaaattatagtaaatgaaaatatttagagaatatgcagaaaggtagatattaaacaatcccctaaataaatgtatgattacaaatttgacaaatgcaatgaagaaaaataataagtcacaaaggaagaaaaagaggagacctactagagattgtgaagttatattatttttgagagaataatatctcggtaagtttaaaaaatgagtagaagtcgctcaacaaagaagtagttttggtagagggaacagcacgtacaagggatctgaaagggaaaggagattagagtgttaaaagaaatgaaggtaagcctatttggcaagagcttagtgaaggatgggatagtggcctgagacaagattattgacatagaaaccaagtcatgtagggtttgtaagccaaggtatggatttgggttcttttgaaaggctatgggaagcaattaaaaagttttaggcagatgaatcacatggttatatttacatcttaaagtttcactctggctgctggtagagaatagattatagcctgagtggatgtgagaagactagtaaagggattattccattagtctaggagagaaaaatggtggtgggcagtctctattaacttttagaagttatctttaggtaatgtgagcctgcaacgtgaagttcctagtactttaaaagttataatgctgatgaacaaaaaggtatgtaaaaactcaggatttaatctaattagatacattttccaccattagaacatttctgctcagagatcttattacaaagctacatttctgatagtctactacgatgcagcttctgccaaagccactcagtactaacctcttacacagcatctctacttacatgattaaaatgcatatcatacttgacatagtcaaaagataaagaaccacttgatttctacttccaagctactcaactccctagtaaatggccttaccatttaccctacccaggcactgatgtaaaaaatctgagagttaatcataatttttctcttcctctcatatcccatatcatatgtaaattaagtatcaacttaaattgaatataatattcaatgtaatgctatgaaaattattgtatgtgattaatgagaatataaatctggctataaaatctctgatagtgatatagtatttatatccatatatccttaggaaaaaattccctttaattatagagtagttataaacagtagtctaatatagtatgctatagttgtgttttgccttaattattcttcattgttaatacctctataataaacatataaaataaaacgcttaatttcttagtttgcaaattaatttaccaattcgttcattctttctttgtcaagaatggaaaaccttatagcaatacaggtcatctcaggtccataaagagtaatttaagatcagaaattcatgtcaggtccatgaggaataagttttcttttcttttctttcttttttttttttttgagacggagtctcactctgctgcccaggccggagtgagtggcgcaatcttggctcacagtaacctccgcctcccaggttcaagcgattctcccgcttcagcctcctgagtagctgggattacaggcgtgggccaccacgtctggctaatttttgtgtttactagtagagatggggtttcgccatgttgtccaggctggtctcgaacccctgacctcaggtgatctgcctgcctcagtctccaaaagtgctgggattacaggtgtgagccaccgctcctggccccataaggaataatttaagatcagaagtacaaagaaagttttctaattgattttaaaattagtttctgaatatttctctaagactatagtttaaattcgatctatttcacaccaaataagtactacagcaatatttaatttctgcgttactattgacatatgagtcatctaacatgtaaactttcagccaaccaaatattatggctttagtgctaatttaaaaaaaagtttttgaaaggaacatttgtaaaatatataaaggcattcatctgccttctttttttttttaaagagatggggggtctcattttttttaaagagatggggggtctcactctgtcacccacactggagtgcagtggtacaatcatagctcactggagccttgaactcctgggctcaagcaatcctcctgcctcagccttcttagtagctgggactacaggtatgcaccaccacacccgcctaattaaattgtttgtttgtttgtttgtttgtttaagagacagggtctcgctatattgaccaggctggtctcaaacttctgggctcaagcgatcctcctgccccagcttcccaagtagctgggattacaggcggtgtgccaccacgtccagctatctgcttttttaaatagaggaagtgaatatcatgttaagttattcttaaagacttaactaagattacttatcatactttgtcacaatatatttaaaatacttcattaaattctgaggtgagatagtaaaccatttgtgctaaccctaaatagcctttttagtttttgaatagtcttcctatctccaaccttttcagatgtcccttcatgtcagaatgtcttcctctgctaatccttctctgtgctgtatttgatctgctagtaataaagcttgataaacaagtaatctgtttatttcatcaggctctattcaaggcttggagattgactctataactttcccacattgaaaagtgcaagtggaagtgggagcttctgattgatagcttttgagcttacctccgggtttgtaactgtattctttagttaaagctatcaggaatttggctaccagataagtgagacataaaaccaagtatcattactaaagcaatctagtgatacagaatattactgtgtttaaataacttatcctacataaacaacaaggtagtgttaacctcacactcacaattctgcatgattttatgacagatatctaggatttaaaaaatggatatagcttatatccattataattttgttatactgagagagttcaaagttggcatcaagggtcaaaggtagaaattagcttacatagaaaataatttgtataggccaaacagaccttttgtatacaataccacctactgtaatttagtccacaaaatactgactataagaccataatcaaaatgaaatgctatgaaaggtgtgcgagagcttagtttatgcactgtaataaagctatggatggatgggcatagcgcatctcctgttgcacgcactctgttgctcatcaagttacatggatctgagctgtttgttaaccacagaagaaggtgaatcagtctgatgatgtgtgtggtgtccagatgcctcaacagactgcctttgttcactgtctggcgaagattaaaaaggagtagaatgagggctttctgtgggagatgatgtcaaatgagcctgagctgacattgtagaggatgtagatggctgaagaaactgttcagctggagtatctacttccattgcagtttcactcacttccaaatcaggacttgatgggaccataggaagagttgaaatatctgattgacttgttccacctctgggtcaagatcttcctcatcctctattgctttgtgcaacctcacttgcttcttcgaaccgtcttgataacatatcagacattctctgcatcaatgacacattgggactctgctctccatgtcattctcgttcactctcaggccttgatctgggtccagtatctgaccaatcaccacgaaggctcaaacgcttaactggtggttgtcgtaactcttctcttctctcttccgcagaaggagttttaagttctcgtgctgtatcatctttcgggtcaaaaagatatatgtaatctgaagagtaactaatgagaatctcttgaccatcttcactgtaacacagaaatgtcactctgcaggacttattattaagatgggaagcaataaaatgggcaaccattccagtagtccctcgacctgcataattccctgtagctcttgtgcccagcattcgcctatcatatatttgtactgagctataagaacaaccaacggcaaggtaatatggtattggtgggcaaatagcaacagatgtggcagcacgtcgacagctaattaaaatatcatcttcacaatcttcttttgtgcagctagttttgatgcgtgtatcaaaccacctaccagttctatcttcaccacaagagagaaaagtgtaagggtcattgggtacagtcataatctcataagtagttccattgtggcaagtaaattggcattgtctgttggtttctgcatcttgctcaacattggtataaaatattactccatctccagagcaggatacaatctgtttatcatttgtgcaaggtaagaactttgcattagatatgtttgcttggtgccccgaacgaattgttgtcaaaacctttctgctgtagggattactaattactaatttggtgtcatctgagccagataaaatatattctccagtgtcattccaacagattgtattaacacagccatcatgcacatttagggttgcttgaagtttcaatctttagataaattctcttcttcccaggtagtggccccacagccaggacaggtcctccagcccgagggaccttttcctcatgtcccacaacagatgtgggcaggagccaccccgagacatggctctgcctgagcgaggtgggaggggagaccctacctgaatcttttcaaagtgtcataaaacagatagttctatagtcttgatatcattatagaacatttaaaaaaataaggaaagcttctgttttccaaaagcacttaataatgattggtcctgtttacaggttgtgatattttgtatactccttcttttacctttttttgctgtaagatatctgcgtggttgccttctattgtcttttcatcttgcttgtccttaacatgaaagtcctggccacaccttagcttttctttgctaccttaaagagagtctctaaacatgtgaaaattaaacaccacagttctaaataattcatggatcaaagagaaagcctcaaagaaaaaatcaagagaactgaatggacacaaaacatatcaaaatatgtggagtgcagctaaagcaatactgagagggaaatttatagcactagatgcttacataagaaacaaggaaagctcttaaaacagtaagctaattcctacctcaggaaactagataaagaagagcggctgggcgtgttagctcacgcctgtaaacccagcactttgggaggccaaggtgggtggatcacgaggtcaggaattcaagaccagcatggccaagatggtgaaaccctgtctctaccaaaaatacaaacattagctgggcatggtggcgggtgcctgtaataccagctacttgggaggctgaggcaaaaaactgcttgaacccgtgaggcagaggttgcagtgagccgagattgagccactgcactccagcctgggcgacagagtgagactccatctcaaaaaaaacaaaacaaaacaaaaaaaaacccaaagcaaacagaagaaaagaaatcataaagacaaaagtacaaatcaatgaaataaaaaacagaaaaacaattgatatgaaaacttttaacaggagttggtactttaataagatcaacaacactgacagaagtttagcaagaaaaatgctagaaaacaaaaattatcaatatctggaatgaaacaaaaatataactacagaccctgcagacatccaaaggataataaaggagtaatatgaacaactcttcacaagtaaatttcacaacttagataaaatgcatcaattccttgaaaaacacaaactaccataattcacataatatgaaacagataatttgaatagccctgtaaccattaaggaaattgggaagccaggcacaatggctcattcctgtaatcctagcacttttggaggctgagatgggaggatcgctggattccaggagttcaagaccagcctgggcaacatagtgagacttctctctataaaacataaaaaaaaaaagtagccaggcattatggcatgcacctgtagtcctacctactcaggaggctgaggcaggaggattgcttgagctcaggagttcaaggttgcattgagctatgattgtgccactgcactctactctgggtgacagagcaagatcctgtctcaaaaatttaaaataaaaaaagagaaattgaattcatagcattaaaattctccaaaataaaacctccaggcctagatagtttcactggagaattctaccaaatgcctaaagaataattaacatcaattctacataatcccttccagaaactagaagtgaagacttcacaacacattttctgaagctagtattactctgatactgaaaccagacaaagatagttgaaataaaaaaaagaaggaaggaaggaaggaaagaagggaggaaaaaagaaaagaaaaacaaccataaaccaatacctctcgtgaacttagagcaaaaaatccacaataaaatatgtacaaaccaaatccaacaatgtgtaaagattactacatgccatggccaagtgatatttgttttaggtatataaaactgattaacatttgaaaatcaatgaaatccaccagatcaacaagccaaagaagaaaaattacatgattatattaattgacaaggaagaagcttttgacaaaatgaaatgtgttttgcccattttctaattggcttgtttttcactgttgaattttgaaagttcttcatatattttagatactagtcctttggcatacatgtggctcactaatattttctccctgtctgtagcttgtcttttcaacctcttcaggtggattttcggagacctggtttttaatttttcttaacattttccttttataggtgatgattttggagtcaagtctcagaattctttgcctagcactagataccaacattttttctcctatgttttttctaaaagttttgtagttttgcattttatatttaatcccattaggttggtttttataaaagggatgaggtttaggttgaggttcactgttttgcctatgattgatgagcacatgaaaagatgcttggaatcattagtaatcagggaaatgcaattcaaaaccatcatgagatactactttgtacccactaggatggcttaaaacaaagtcagaaaagaaacgttggcaaggatgtagagaaactggaaccctcacgcgttgctgctggaaatgtacaatggtgcagctgctccgtaaaatggtctggcactttcttaaatgattcaactagagttaccaagtaacctggcaattctattccgaggtattaggttgacgcaaaagcaattgtggtttttgccattaaaagtgatatacccaagagaaatgaaaatatatgcacataaaaacttgtatataaatgtttatagcagcactgttcataatagccaaaaggtggaaacaacccaaatgtccactgatggatgagcggataaacaaaatgtgcttaatccacactatggaatattattcagacataaaaaagaatgaagtactgatacatgctgcaatatgtatgaaccttgaaaacattatgctaagaaagaagccagtcataaaagactacatattatgtgattccattcatatgaaagtccagaacagggaaatttataaagacagaaagtagactagtggtagcccagggatgggggcaaggaaggagagtgagagctaaaggtacagggttgctttttaaggtgaaattgacttcaatgatgtttacatacatctgtggatatattagaaaccactgaatattataccttaaatgggtgaattatatgatacatgagtgtattagtctggagctaggcgcggtagctcacgcctgtaatcccagcactttgggaggccgaggtgggcagatcacaaggtcagaagattgagaccatcctggctaacacagtgaaatcccatctctactaaaaaaaaatacaaaaaattattcagcttggtgggacgtgcctgtagtcccagctactcgggaggctgaggcaggagaatcgcttgaacctggaaggcggaggttgcaatgagccaagatcatgccactgcagtccagcctgggtgacagagtgagactccatctcagaaaaaaaaaaagaggtttaattggctcacagttccacaggctatacaagaagcatggcagcatctgctgccggggaggcctcagggagcttccaatcatggcagaaggtgaagggaagcaggcacgtcttacatggccagagcaggagccagacagagaggagcgaggtgctacacacttttaaacaactagatctcatgagaattcactatcatgatgacagctccaagaagcatggtgttaaaccatgagaaaccaccccatgatccaatcacctcccaccaggccccatctccaacactggggattacaattgaatatgagattcgggtggggacatatatccaaaccacatcaatgacttacatgtcaataaagagatataaaattgttttgttttttgaaaaaaatctaatattttaataagccactctctcaagccaatacaaggcagctccagcacacccctgcttcaggagatgtttatgccacatgaagggaggaaaccataatcctttccacatccctcaggtagacgtggaaataaggataaggtgaaaattacaaaaaccaagctcatcatgcctccttcccttgccaccaaatgcttgtatttctttttaacacctgttccccgggttgtataaaaagtcctttgctaattacttttaggaaaagggcgacattctggccttcacctcccagaaaccacgcatcatacttgaggcacacaccagggaagaggctgaggtcaagttcaccaatcagaaacacaaacagacaaggaaaaagaaggcagcaatcagtttccatcaaagccctcagccaggtgtcagatctcccagggacacccctctttaatttgggggggacataggtaaatatgtgtatccagaaagcctggagcaagtcgagagaggcatttgattagtatgcagatcacaggcacagctgggatcagggctaaccagactttcaaggataaacagctgacaaggatatgtcatgttgtccctgcagtgtgttgaatctaattaaaaaggacttagggtcagaaaaacactggtgtaataatgggtaagcacaacagaaatcattttattgtttacttacaggaaacaatacttttcccgtttacatgcttgacgtggccagcaaggaagagctcacacttcgtacaaaactacacactagttttgcatctctttgttgtgacacacaacctctggtttagattctttaaaattatctgtatgggacagtttctctcattattcaaagaatgacttttccccaaaataaataagatatattccttccctccgctgtcgggtgtttctcatgctctcctcttttaattgtcagtataattctagagtaaaagtcctatgtgctatggtttgaataagctccccaaaaagcatgtgttgaaaacttaatgtttggctggacatggtggctcacgcctgtaatcccaacactttgggaggccgaggcgggcggatcacctgaggtcgggagttcgagaccagcctgaccaacatgtagaaaccctgtctctactaaaaatacaaaaaattagctgggcgtggaggcacatgcctgtaatcccagatactcaggaggccgaggcaggagaatcgcttgaacccgggaggcggaggttgcagtgagcagagattgcaccattcactccagcctgagcgacagagcgagactccgtctcagaaaaaaaaaaaaaaagaaagaaagaaaaggaaaacttaatcctcaatgcaacagcgttgggaggcgggggcctatgggaggtgctttggtcagcagggctccaccatcaggaatggattaatgctgattataaaagggcttgaggctgtgagttcaatatcttgctctttctttggccctctcttgccctttcaccttctgccatgggatattgcagcaaaaaggcccaggctagatgctggcccctcaatcttggacttcccagcctcccaaaatgtgagaaataaattacccagtctgtggtattctgctatagcagcacacaacagactaagatgcactgtcaagccaaaatataatgatttgtgaacggctaacagcacaggttggaatctgatgccagctaactcccaaggtctcagattccctacctgtctcccatgcatagttgtcagaagtaaatgaatgaacgtacagaatgtgctcaagcagtgccctgcacacagcaagggctcaggaaagttagcgaccatcatatcatcatcatcatcatgatcatcatgcagtcagtattaggtttgtataaaaatatcaaagagcacattttaagcttatgtccaaacatatactaaaatgtgttaaatacgtatcttttatgtaattttccacctaaatttctagtttctgtgacaatgctaagtaggaaaaatattttaattcattcaatgctatcataatgaagattttgtttgttttctttataatgaaattagtgcctgactatatctaaatttacagaagaaaaagaacgtatattcactgaggtcaggcctgcgatagcaaaacagaggggatgggctaaccgcttctcagcaggggtaaagtactctctgctgcctttcaaagatgaagcagccccctagatatacagcaatgtatgaaatggaactttgagtagggaaaacattgcagacaaatgcatacagtataagcatatttgcttaaaaataaaactatacagttggatgactgtgtacatatacatgtacataaatatatatgtgcatacacaaaaatggatacatcataaagcaattgcctgtgtggtagggagtaggaggcagagagaggagggagactttgttttgctccagtttgtgtacttcttgcatcttttacaatgagaatctattactatttcatttcatatttaaaaagaaagggaaaatagttctattcatttaaaaccaaatattcatcaagccatataatgcattatattacattaaattgcatttcaaaagcatcctctgttatgctttcatttaaaaatacagtaagaaaagtatgatgggaaatcccaaacttctgcagaatgaattgaaataactgagtcattaaaaatcagtttatttcccagtgctttgggaggctaaggccggaggatcagttgaggccaggagttcaagactagcctatgcaatacagtgagacccccccccaccaccacccttacaaaaaattaaaaaattagctgggtgtggtggtgcatacctgtagtgccagctgcctggaagagtgaggtgggaggatcacttgagcccaggagtatgaagctacagtgagctatgattgcaccactgcactccagcctgggcaataggtgagaccctggaccctgtctctaaaaaattgttttatttgtatttttatgatttatttatttgaagacatgttctcactttgacacccaggctggagtgcagtggcacgatcttggctcactgcaacctccactgcaccccctgcgtccccctgcccccggttcaagtagctgggattacaggtgcatgccaccattcacacttaatttttgtattttttggtagagatgggatttcaccaggttgtccaggctggtctcgaactcttgacctcaagtaatctgtctgccttggcctcccaaagtgctgggattacaggcgtgagccactgcacctggccaaaagaattttttaaattaaaaaacgtgtatattttttaaaaatccattttttaaataaagttttgttgctgtcatattttaatgtgcatggagcctcaaattaaaacataatgaggcattttaaggggcatttgaaaatcaataatgctcttttctaattaatttaagtgaaacagcatgtttgcttgaaatcccaaaatgcctttttaatttcctaaggggctcttcagacaggaacagttgggaggcactcagtggttcactcacatgctcccctccaggaatggtgccaggccctggatgtgggacaaggcgcagcacagacatggccttctcccttgtgctgctttgccatgtagcgaatgatggggaaatgtcagggcttggagaaaaagagacagaatgctcagagaaccgcagagctggggagccccttggacgagggctgagggaaggcccttgcatcgatgtcccaccgactctggaatctagaggtccagaaggagccacctagagaccagctgggaggaagaacagctgtggtgcagcgtgcaggggcagcctgaagtagaaagaccctgagattctagcacagctggcaaggcagggacgtggtgcccaggagtaccactgcaggctagcgaagctggaggagccagatgaaagcaggcactcacacgccacggcgaggatgctggacagcgctccgagtccagtgggaagcacgtggctgagtttatgttgtaagaagctctctcgccatgaacacacacacacagacacacaaatatgtgaatacattttgatcacaacaagctgggaatccatgttttgttgtatttaacaaaaacccacaaaatacatccaaaaactattcctatacaaagttacagaaaattttagtggattgtaaaaagtagaaattaggggccacatgttctcatgcaatgacgttagaaattaacagtaaaaggaaagcaaaaaaccaaaaagtctaactacctaaaaagttaaggacatcaatctgagcgatgattaggttaaagagaaaagcaaaaatgaaaattacaaaccaagtggaactaagtccacaagagcactgtgtatcaacaatgccaatctatacagtattattactgttactcaactataaaagggggaaaattaacaatatgtgaattaagaaagtagaaggggttaataaaataaaaacatacatagtcaacccttccctcaaattccccatttcctcccgagacccccggctctagggaactattaatctactttgaatctctaaagatttgctaaaatgtttatttttgaactgtaaaagaatattatctgtagctttataacaataaattggaaaaaacagatgaaatatacaatgttcgaaagacattaacaaaaatgatccccaaaaagaaagaaaacacgaataacataatgaacatgggaaaatacgttaaaagtagtcaaattacctcccccaaattaaaataaacctagataattcccaggttatataaactgtttcagagcataagtcaaatcaaattcttccactttcattttaaagtatgcataattctaagatgaaactggacaaggagggcacctcaaggtaaactgtaggttatctcatttctgaatgttgatgcaaaactcttaaataatatattaacaaagtgaatgcagcctaatgtataccttctcagcaccaggaccattgcctatttctgcaatgcaaaagtgattctgcattaggaaatccattaatgcaaatcactacattaataaactaaaggaggaaagccatatgatcatcttcagagatgttaaaaggatggtgataaaatttacatgcatcttgattaaaaaaaatcttagaaagccaggatggaagcgaatacctcccattaataaaggcatctctcagaagctgatggcagacattactctacatggtaacccattaggagcaatcctgtgaaagccaggaataaaacaagggtgttaaaaaattccagtgttagtcaacctttttccctgtaaatcctcactgtgagtgaagggtcacatcgggtctgggctgacgcatgtgcgccaggaaaaatgacccaaaagttctgtcctctcaggtcactgcttccttttctcggacactgcagcgttgagatggatatggaaggctgtggtcatctcatgtgctgggaaggacgcctggatcagggaagcagcgtggtggcctgcaggccttgggcctccgtgaagacaaaagtgttataaaaacaactgatggaaaagtgaactgtggcttctcagtgagagtctcccccacgcaggcagtgaacaccgcatgtgggtgagagggaaatggagctgcgggacctcccagtgatgtgaagatgctgtccctgctgtgtctcctgtcctgtgtcctatgaagctcagcaaatggggagatttgctaatagaaaccatctctcagcagcatgcttggtggtgggtcactaagagcttctcattaaattcaggagcaagaggtggatgatgaaataccatcatctaatgttattttaacaaaacatcattatccaatgttatttgaacagttttagccacagcaactacacagaaaagcaaaacaagatgtacagatactggaaagcagaagaaaatgtaatcatttcctctgacaaactatgggatcaaagattcaggtgtacattcaactgcttgtacagttcaatgcaagtaataaaaaactgcaaaaagtcttacatgcggcgagtagcctcttcagtataaaataataactaaaacaggcatccaccagagcaagaaaatatttacaatacctaggactaaatttgaaacatggaaagttcatatgtatattttagaaaactataaaagtgtagtaacatttataacaaaataaatcctagatcgataaaacacataaatatttaaaaaataaaacccgaaaatactgaggggatagtagaaaattatttataatcttggagtgggaaaggcttttctaggaaaaacacataacccagcaatcaaaagggttaaaatacgtaaatgaataaaaccaatgtgagtacagaaaatacccacacaaagaatgccattcaaaaagtcaaaagatgcataacaaactattaaaaatatatgtttgcaaccaatataacaatagccagtttccttaacataaggaagtatatatatgtatataatatatataatatgtaaattataaaaacaacaatataacagtaaaataggtaacaaacgtgaagtggcagttaacagataaagaaatataagcaacttataaacaaatataaagatgctcaacttcacttttaattaaagaaatgaaaattacataataaaattgtacaattttgtcagattggtgaagacaaaaacaattctgacaacacacaagtttggatctgggtaaccaggcacaggctcagactgctggcaaaggtgtgaaggggtgccttgtgtttggagagcaatttaggaataagattctaaatttaaagtgcactcatgctctgactgcagggacggtcttagtgatttttttctctagatctgtttgcattccttccttgttcactgctacacccccagcacctaggccagttccccaagcagcagcaatagccactcagtatctgttgagtaatgaatatgtacaaagaatactattcaatcgggcacagtggcttacgcctgtaaacccagcactttgggaggccaaggcaggtagatagtttgagttcaggagtttgagaccagcctggccaacacggtgaaactctctacaaaaaatacaaaaaaagttagctggttgtggtggcacatgcctgtagtcccagctaattgggaggctgtgacgggaggatcacctgagcccagggaggttgaggctgcagtgagccgtgatggcaccactgcactccagcctaagcaacagagtgaaaccctgtttccaaaaaaaaaaaaaaaaaaaaggctgggcgcagtggctcatgcctgtaataccagcactctgggaggctgaggcaggtggatcgcctgaggtcaggagtttgagaccagcctggccaacatagtgaaactccatctctacaaaaaaataccaaaaaaatgtatctgggcatggtggcgggcgcctgtaatcccagctactcaggaggctgaggcaggagaatcgcttgaacccaggaggtggaggttgcagtgagctgagattgcgccattgcactcctccagcctgggcaacaagagcaaaactccatctcaaaaaaaaaaaattatttgcatgttcattttagcaaaagactagaaacatcttttaacttatccttcattaaggggtggttatatgaattatcacacatccatccagtggaattatccgctactccctgtttaacagcagagaagacctccaagtgctgatgtgaaaatgtcccaggctacatggttgactacaaaatccatgttgagtagcccacgtgtgtaaaaaaaaatccataaacaaaaatatgtgcagatgatgactggaaaggcacacacacacacacacacacacacacacacacacacacacgcaaaaccctgtagcaggaaggggaggtgctaggagcccagaataaaagattgactttagtttagatatcctttttatgcagagaacactagctagtcttaaattatgcagagaaaaaaacacaatcaccacacaaacatatggaaatgtagtaggtatcctaaagaaaaacaaaaactggagtgaagaagttgaaaagaatttggataaatcaaagcatacactgtatgttctggaatggaaagacatggtattgtttagatgttttaattttccctcaaagtaatctacaaatttaatatgatgccaattcaaatctcaaatccattctttccaagtcttggcaaaagaaaatcaaagtgcatctagaagactaaacatttaaaaccaggcaagaacattttaaagaaatagattaaaagtccgggatggggtaagcggtagaacttgtcctaccatgtataaaaatagattataaagtcaaggtaatttaagtggtattgctctggaatatgaataaacagacatatgaatgttgaatgaatatgaataaaaagtccagaaatagacaaatgggcactactatctgtgtgcgcatgtgtgcatgcaatgataacactggcagagttgatattggttgtttcttcaccacccagcatacatgtccagcttccctcccccaaccctgcttaatagcagccaactttgtttccggtatgtctgtaaaaaaaaagtagcccatgtgtgactgaattcagtctggtaggacaggtaagcaaattatcatcctcctgtatccaattaaacactccctcccagctctttgactctaatgcaaacagacccagaggtaaagaaccataggaattgtccactcctgcagaactgcaccctggcaagttcagggttcccactgtaggccccagtctcagtcagatttctgagccaacagaagaagcttccttagaaccagccagttttcaagcctgatctctagcctccttgatgattcaataggccccactatcctcacaataaatggcccgtggctttcttagtaattgtaacttgctgcaaatgatttttaatgatctgggtgacatttcaaatcagcagggaaatactagagtattcagaaaatggtttcaggtaaactactaaactgtttagagagaaaaagttcaattcatcgagtagactgtaaaatactaaagagttaactatattaaaaaaaagcacaccataaccaggaagttattggggtagcataatcttggaaaggagacaatctttttaagcatgattctaaggtaagattacaaagagaaacattggtaaatttgaatatataaaaattaaaaagttttctacttttctgacaaaaattaaaaggcaaataacaatccagggaatatatttgcccaatataagtcaaaggattcaaaactataatatataaagagctcttataaatcattgataaatatttaaatctataactgagtacagaacacatacagacaaaacagagaagaaaataaaatataaatggtgcataaacatgaatatatgacataattacacatatatgtataaatacatataagcttatgtatatgcaattataaatgactaaaaagtttaatcttactagtactcaaagaaattcaaattaaacaatgaaatcatcttatatctttcaaattagcatggattaaaaagaataacaactttcagtgctggcaaaggtgtaggggaagagcattatcatatattgggaatataaatgggtaaacttccctaaaaggcactatgtcaatatgcaccaaatactctaaagatacattcatttttatcatgtatatctaattttaggagctgtaaaaaggattcaatttgtataagaataatggccatctctctaattgcaaaaagcagagatatggttaaataaacaatgttacattcatacatatagagtagtcactaccaataaagttgtagaatattttaaaacatggaacaggccgggcgtggtggctcatgcctgtaatcccaccaaggcaggcggatcacctgaggtcaggagttcgagaccagtctggccaacatagtgaaaccttgtctctactacagtataaaagttagctgggcgtggtggcccatgcctatagtcccagctacttgggaggctgaggcagaagaatcgcttgaacccaggaggtagaggttgcagtgagctgagattgtgccactgcacaccagcctgggtgactgagcaagacttcatctcaaaaaataaataaataaaacatggaacaatgtgatcagttaaaaaagaaatcacaaggcagcatgaagtggatagcacatttaaatacattaaatatatatgtatacatacatgcatgcatacccatacatccatatacacacacattatgcacagaaaagactggaaggacataatcaactgggtggtaggactgtgaagtgttttgttttttgaatttctatagtaaatgtataatttttatatatgaaattttgttttttgaatttctatagtaaatgtataatttttatatatgaaattttatatatgaaaggagcataccttttatgtgttgtataggttttgcaatattctatgaagaactcagggtaggtcatgtccacactgaacaggtgtattagtccattcttgcattgctagaatgaaatatctgagactgggtaatttataaagaggtttaactggctcatgcaggctgtacaggaagcatgatgccagcatctgcttgacttctggggaggcttcaggaaacttacaatcatggtggaaagtgaagggggagccagaaagtcacgtggccagagcaggagccagagagaaagcaaggaagggaggtgccacacactttaaacaaccagctctcgtgagaactcactccctcactatcatgagggcagcaccgagggaatggtgctaaccactcatgagaatctgcccccatgatccaatcacctcccagcagtctccacctccaacgctcgggattgcaactgaacatgagatttgggcagggacacaaatccaaaccatatcaataggaaagggaagcaaggccgagaaacagtgagtgacttgtcctaagtcacataaccaggaggtggtgaagcatggctttgatcctggattgctgactccaaatccagtactgtttgtgctgcacacattgcccccaagcaaatgaacacactggtttgtagctctgagatttctggccttgtatgagccaaggcagagggacacctaggatcaagttctaaagtgagggaaatattgatgattctgtggtaccatcaaccaaacagatgtatgtgagagtacatatctgtggtacatgatgttctttttatgtatccgtggaggtatagaaagcggtaagaaatagaggagaccaaatctccctttcctatacttccatgcagtctgcgatgtgggaaaacggtctgagattaagaccaggaggggtcagcccttcaagcttgggcaatgtgtgtgggctttctttttggtgtgaacctccagacactgagtttcccttcacccaatcactctgtctcccccacacagagccctgcactggaaaatgagagtctaagaaaaaaatggccagttccttgtaggtcaccagattttgctatactcatagcacctagtatttaggaataaaaaggctggccaagttatgaatacaagatggcaagttatcctttcagatggagatggggatccaggttgtgtcaattgtcaatcttaagggggtctacaccataccgagaatacttctgtgcacatcatatagggatgaaatctgatcaatgttctctaggccacattcaacagacaataacaagatgaagccccaacaattcatttttgtaactcagtgggcagcttcagcatcgaaactgtgccagcgacactggtcctgctggccttcgtagataagaatgcagagagcagcaggctttccagtggctgcccctgtgaatccaaacaacatggtcccaagccaagcaggcatggtcccacagcagaaaagcttctggtaattcagcaatcacttctcagaatcatagccacaggtagagcaggcagagggcaactgtggagggacatggctctgaaaggtagcctgctattgcttccaagacaaagaaacgaaggcccatgtccccatacccagggaaccacagtcctatcaggagtttaagtatattcataccagaatgcaaccaaacacactgcaatttctgtcacagccagatgtacctattacagtaccatgagctaagttattttgaaatgatcgttctatccaacaaacaagttgttgatcttctacaacaagctcgtccaacccaccacgctgcatgcagcccaggacggcttcgaatgaggcccaacacaaattcgtaaacttccttaaaacattatgagatattttttgtgacttatttttttttagctcatcagctgtcgctaatattagtgtattttatatgtggcccaagacaattcttctaacgtggcccgaggaagccaaaagactgaatacctctgttctacaatgtacacagcacactgtctacaattttctgaatgtggcccaacacaaattcgtaaactttcttaaaacattatgagttttttttgtgactttttttttttttttttttagctcatcagctatcgctagttttagtgtattttatgtgtggcccaagacaatgcttcttctaacgtggcccaaggaagccaaaagattgaatacctctgttctacaatgtacatagcacactgtctacaattttcctggatctgaaagaaaattctttttaattgagaaatgctaactatattgttttgatatattcgtcatccagcataatatgtacatcagcacttaaaactgacttgcaaactgatttttaaaaattcaatacaaataagaatcaatgcaacaaatgctaaaatataatagttactaaggatatttattccaaaatagcactacgttgtgatccttaaaaatatactactagtagctgatttacaagaagaaaaagttttaattgttctacttataaatcagtaagtgaattgttatctaacttatagaaataaatcagcttaacctaaataccctaaactagaaaacatcagaatgaattgaaagtgtacatgagaacctaagaatacagtaaaattatttttaaaattgctcttgtacaaaatcaaatcctatgacctttatgaaagggtttgcatttcattacttaccaactggcagccttctagggagttgactagctgagcattctgacaagagagaattgaaccagccaaattcagcattacacacactgcagaaagcagcatgaaaaaggttatctggaaacaaaccaaacataaaattgattattcacttggagaggctcaaaggaaaaatgacatggctttacaacagctttcatttattatacaacagttgatcacataattacatgaataacatgtatgtgttttaaaggaaagtggtaggttatttctcaaacttccaaattcatatgatctgaaatagaaaaagtaagatctgtaggaagccatagcaagctaccatgattttgtttaaaacctatgatgataaaatatttaaggagttaaacttgaaagactgtgcattatatactcttaacagtgacaagttacacattattaaaggaaatcaagtgaaagaagtatatttattagaaggcctttaggtttaatttttattacagaaaatttcatacacatgcaaaaccaaagaaaacagcataatgaaggcacatgtgtccatcacccaacatcaataattaatccacttacggccaactgtgtttcatttacagcccctaccatctgaattattgtgcaaccaataccaggcatcatataattttacccttaaatctttctaaaggaattgagaagctttctgaaaacatagccaaaatagtcatcatatctataataaataaaaattcattaatatcatcagatactgagttcacatttccctaattgtctaaattttttcacactttgaatcaggccacacaggatacaaagcaggtccatgtggtacaactggctgttaggaatcttagacagtctatgggtttcccatccactttttcctctgtgaaatttactgaagaaaccagttcatttgtcctaaagagtttcttacagtctaaactttctgattgtagtcctctatcattaaacatttctctagcctctgtatttcttgtaatttggtgattaaatacagaggtttggccaaattcagatcaataaaaggcaaatattgtctctctctcttttttttttttttgtgatggagtctcactctgtcgctggagtgcagtggcacaatctcggctcattgcaacctctgcctcccgggttcaagcgattatcttgcctcagcctcctgagtagctgggactacaggtgcgcacaaccacacccagctaatttttgtatttttagtagagacggggtttcaccatgttggccaggacggtctcgatctcttgacctcatgatctgccctccttggcctcccaaagtgctgggattacaggcatgagccaccacgcccggccaatattgtctctctttttgtgatgttagcggccatttttaatgatgacagactcattaatttattagggtttccaaaatagtgctagtctcactctgtcattttttctttatgaataagaatacatatagagacacagacttttcctcatcaactgttttgttaccctgaggtatagttcatatatgaaaagcaggatatatacttgactctttctgttcattttccaggctttaaaataattttaaattttgcaaaatgaactcaaggaagtctgtatgcttaattagcactctttctgcacctatgtaaataattaggccaaatctaatgaagaaagaccctttttgtgatggagaataacctttaagattaatctgatcaagaggcggggagactggcattaaaacttgttaaagagcaaaaaaaaaaaaaaaaaaaaaaaaaaaaattcactggatattctgtctaatgcacacttcagggttatttctgcctttcaatgtctttatgctatttcaaaactctgcataaaactgataaaactgatagtttatcaactgatagttgtataaaactgatagtagtgcaaatgattcttgacgatacaaatgtaaaggaattttgtccagtagaacgtaactgattattgccccactgatattggccacttttacatttatttgtaaatttatttcagcattcctgattgcttatatgtgtgcagtgtttgaattaacctttgaactgcttgtaacatcttactgatttcctcattaaataatgagttagacatagtctttgacacatgtctatttttttaaaaagctgattcccggccaggcgcagtggctcatgcctgtaatcccagcactttgggaggccaaggtgggtggatcatgagatcaggagttcgagaccagcctgaccaacatggtgaaagcccatctctactaaaaatataaaaattagccgggcatggtgctgcgcgcctgtaatcccagctactcaggagcctgaggcaggagaattgcttgaacccaggaggtggaggttgcagtgagccgagatctccagcctgggtaacaaagcgagactccgtcaaaacaaacaaacaaacaaaccaacaaacaaaaacctggttccctagcatcctccaaaattaacaatatcatgaaatagtattttgtctgtttggtggagaggggagtgagtttgagtcattatgagccaagaacttaaacacatttgatagttttaatcatctgcatcattagacagagtccactcaagttgacacctgggtcctttcaacacaactccagtagaccttgacagctatctggctttctgtatgagaagatagtacaggatcatcttacagttttctacccaagagacctataatcagccatttctccagtaagtccaggttccattcaatgagaatggtattcagataccataatttttgtgctacaggtgctgtttgctacttggagcttcattgttttcagttgtcagacatatcatgagttcacaattatgtttctgatttaaattcaacactactaagttttcacaatgagataccatctcacaccaggctattactaaaaagtaaaaaataacatgttagcaaggatgtggagaaaagggaacacttatacactgttggtggaaatgtaaattagttcagccactgtggaaagcaatgtggagatttctcaaataactaaaagcagaacgaccattcgacccagcaatcccattactaggtatatacccaaaggaaaatacattgttttgccaaaaaataaaaaaccccaccttcacccatatgttcaccacagcattattcacaatagcaaagtcatagaaccaacccaggtgcccatcaatagtggcttggataaggaaaattccatggtacatatacaccatggaatactacgcaaccataaaaaagaacacaatcatggccaggcgcggtggctcatgcctgtaatcccagcactttggggggtcgaggcgggcggatcaaaaggtcaggagattgagaccatcctggctaacacggtgaaaccctgtctctactaaaaatacaaaaagttagccaggcatggtggtgggcgcctgtagtaccagctactcgggatgctgaggcaggagaatagcatgaacccgggaggcggagcttgcagtgagccaagatcacgctactgcactccagcctgagcgacagagcgagagtccgtctcaaaaaaaaaaaaaaaaaaggaacacaatcatgttctttgtagtaacatggatgtagctggagtccatattatatgaattaacacaaacaaaaccaaatactatatattctcacttatagggtaggagctaaactttgggtacacacagacacaaagatggggacaacaggcactgaggactccaaccggaggttggggggaagagctgaaaaaccacctattggggtactgtgctcactaactgggtgatgggattatgagaagcctaaacttcagcaccatgcaacacacccaggtaacaaacctgcacatgtacctcctgaatctaaaatttaaaataaatatagtcatacataacaaaaaaaccgcaaacaaaactataaggtttttatgtaaccatattaattttacatctgtatctcctttcaaccatgccaaaaactatttctcaacataattaatctgttggatttaatttcacaatatccacacaacagtctcaaaataacaccaatacaactgccgaaaaaaatgactgaaaatagtttaacatttatatttctttttattcttacattacattctaccagaaatagtcaaattatggtgttttaaactcacatggttcctttatatgtggttacgctactgatcaggaacccaggttcattccttttatttcattttttcttgtttaagaattgtttctaaaactgagtttcatttctaattacataaaatgattccaaagtcaggtccataaatgaagtttcacataagtctggcatttattctgttcctccactctatttcctcccatttattaataggcaagcatttattttttaattttatattttatcctcccatcattttttagtaaaagtatataatagtagcataatacacacattttctttacttactttttttgcacttaatatggtgaagatcactcgaaataagaacacacaaataaccctattcccttctacaactgcctaatacttcatggcacagatgaatcacagtttatttttttattatttatttatttatttatttatttatttatttatttatttatcttgagatggagtttcactcttgttgtgcaggctggagtgcaatgcagcgatctcgactcaccgcagtctccacctcccaggttcaagcgattctcctgcctcagcctctcaagtagctgggattacaggcatgcgccaccacaccggggtaattttgtatttttagtagagacggggtttctccatgttggtcaggctggtctggaacacctgacctcaggtggtccacccgcctcggcctcccaaagtgctgggattacaggcgtgagccaccgcgccaggccaaatcacaatttattaagccagatccctactgatgaacatttgggttatttttagtcctttgctatttattataagtagtgttgcaacgaactgccttgttcatatatctttttataggtttcccagcatggctttgggatatattcttagaagtggcattgctggatcaacggataaatgtttgtttaatgtgctagacattaccacattcctcatcatacgactggtactatttttcattcccactaacaatgtatgagaaggataagatcttactttttctgttaataccttaaaaatgtaagctaaattaaatttaggaaaataactggtattaccattctctaccgtaactataatgtatacccctcagctgtagttaaatttattttccttaaaaatgtacatgggagacagaattcataagaggatattttgttcatttaggaactatttcaagttcataatgttagcagtatctcagcaatggttttaataactgcagagtctgacagcatcccttgggaaagttaggtcacatagaaagggccaactttgctgggcgcggtggctcacacctgtaatcccagcactttgggaggctgaggcgggtgaatcatgaggtcaggagatcgagaccatcctggctaacacggtgaaacccctgtctctactaaaaatacaaaaaaattagccgggcgtgctggcacgcgcctgtaatcccagctactcaggaggctgaggcagaagaatcgcttgaactcgggagatggaggttgcagggagccgagattgcaccactgcactctagcctgggtgacagagcaaggctcagtctcaaaaaaaaaaaaaaaaaaaaagaaagaaagaaaaaagaaagggccaacttaaatttttcatattagaagttacggcagtcccatatcattcaaatgatatgtaaataaactggcctgcacagctttgaaattgaggtcaaaaaatagttgctgaaaacatcacgaaagcaaacctacacagaagccaacaagagactaccctgagacttagtaagtgctgaacaacacagatgctacgaaagtcaaggaggtaagagacaataagatctttttgcctgtttattgtttttttttaattgtggtaaaatatccataataaaaacgtacttgcattttctaatttgttttttaaactgtggtaaaatattcataacatgaagtttacctttattcccatttttatgtgtgcagtttaatgacattaagtatgttcacactgttgtggaatgatcatcactatccatttccagagaatgttttgtcttctcaaactgaaactccatacccattaaacaatcattccttatcctccctcctcctagcccctagcaatcaccaccattctactttctgtcccttgaaatttgattactctagatatgttacatacgggaaatcatacagtactcttcctttggtgactggctgatttcacttatagcataatgtcttcaaggttcatccatattgtagcatgtgtcagaatttccttccttttcaaggctattcgaataatattccattgttccagaaattggtcctgccaatgaaacaacttttctgagtgggcaagaactttgaatcaactatttcataactctggaagctggctgaacacttgtagcatccagagggataatctgataaagaaagaggttggcattcaaggaaatctccatcaggtctttggctgaccatggatataatggaatagagactttagtgatcacacacaatgaggaataaaatctgctcaaaattagtttggaaaagtcactaaagaaatggatggctacagctctcaaaaagcagttatcaggcatcattaaggagggaagataatctgatttcagagtcaccacattacaatattcaaaatgtccaattctcaaatatttccttcttgaccaatctctagcacttgaacaaaatattaacatagattctaacagctcaaggccacatccctaggatggctctagctccccctaaagtacctgcctgagaaaattcaaggctgccaaaagagtttactgttagttccagccgacacttgaagacaccctgtgtcccagcatctgtgggagggtaggagcctaactttgataagcactagctaacaatcccagatgggtttcacacaggccaatccctactttccacttttggtaatttttcacttccttgactttactaaccaccccctacaccctgctcaccctccctcctgattcttcattcttcctttaaaacacctagtgaagcctggcacagtggctcacacctacaatcccagcacttcaggaggccaaggcaggcagatcacttgagcccaggagttagataccagcctgagcaacatggtgaaatcccatttacatatatatatatatgaagaaaaaaatgcaattattaaaaaatcaaaacaaaacaaaagcccagaaacctctgtacaaattgaagttgagttcagttaacaccgggctcttttccatagtgtaacagtttattactcattaaaatctgccctttccgttttaactggtgtccagctttgtgtatctctggcagaaacacatgaattaacaaaagtgattcaagacaaaatagaaattctcaatatctgtataacaaggaaggagactgaatcaggaatcaaaaatcctcccaacaaagaaacgtctgggcctatttggggtctctggtgaatactctcaaacatctaaggaattaacaccagtcttatgcaaactctctcaaaaactgaaggagagggagcacttcctaactcatttcatgaggcaggattaccctggtaccgaagtcagacaaagacactacaagaaaagtaaaccatagactaacatcacttatgaatatacacagaaaatcctcaatacatttcagaagattaaatcatacaaagtacctactctgaccaaaataaagtgaagttaaaaatcagtaacagaaagaaaactggaaggaaacaaaaggaaattggattctactccgtgaccaagtgggatttacttcaggaatgcaagaaagtcgatcaatgtaatacacaacatcaatacattgaagaagaaaaaaaagcacatcatcatctcaacacagaaaaaccatttgacccaatttgagaattcttatctttcagagacacgtgccaaaatatttacaggtaaaatcatatatggcatttgtttctaagtaatctggactagggaggaatacaaagtagttgaactgggtggggatacagacgaaataagattatccacatattgaatcttgtacctcatctttctactttcacgtttgaaattttctaaaataaaaaatttaaaaacagatgaaaagacattttaagagaatacttttaaaataaggcaggaaggaaactggaaatatgttaatataatactaaaaagcattattaggaataaagagagtctaaaagcaacaattctccaggaggagataatgatgctaaacctgtttcgcctttacaaatacagcctgaaaatatataaaataaaaaacaagacttaacaaaatcataatgagagatctttcccattgcttagaaatagattacgcaataaaaatagactatataatatttgaacaacacaattaacaagctttaggtaataaacatactgtgaacatatcaaaaacacgtacacagctgcttgggaggctagcgggggaggactgcttgtggtaaggagctcaagaccagcctgagatacatggcaagatcccatctctaaaaaaatagttttaaaaattagctaggcatggtggtgctcgcctgtaatcccagctgatcaggaggctgaggaaggaggatcgcttgagcccaagagttggaggctgccgtgagctatgattgtgccactgcattctagcctgggcaacaagcaagatcctatctctaaaaagttttttaaaaattagccaggcatggtggcgcttgactgtagtctgagctaattaggaggctgtagcaggaggctcacttgagcctgcttctactgcactctagcctgggcaacaagcaaacttctatctctaaaaaggaaaagacaaaaagaaaacatactgaattcacttcttttttaaaggacacttggaacataccaaaagctaaccacatattaggccaaagaccatgttaaaatattttaaaaactgattttatacgcaacattttatctcactcaaagcaattttttaaaaaatcaaagaccaacaacaaaaagcatagttcaaatccaaatattggaaaatttaaaaagatcactcacttgcaattagaatcaaagacaaatcaaaacagatattaggaaatatttagcattgaatataacaaaaatacatctgagaatttatcaaatatgagcaatattgtaaagataaatatattgccttaaatgaattagaaatgaaaatcaattgactaagtatctactccagaaataaaaaaaaaaagaaccactaagtaaacccaaggaaagtaaaaagaaaggaaacataaagtaattaaatcaaaaagggaaacaataaaaaagatcaatacaacaaaagtttcttgaaaatactgataaaataaataaactcccagcacaaatggctccagaaaaaaaaaaaaaaagggcgaaggcaaaaaataattctgggagtacaaaaagaaagagaatctataagtaaagatgcatggtgttatgatatatacatattggtttccttccatggttcctgtttcctaactcccataatcttcgttatactgttggggttctttaggcctcaggcaacagaatctctctctctgaccttctcctgtctttctttcatctgccccagtcaggcctctgattgtgggtcaaaagaccctcatttcagaaaagagtcctgccccaaaccctagaggaaggaatgctacacagagaggccaagaaaactctgagcagacaggccttgctggctttagctcgtgtgcgtttttgtccaatcacatttctgcacagttgtcaatcatgcctatgtaatgaagcttccataaaaacccaaaaggacagggttcagagagcttccagactgctcaacatgcggtggttccggtagggtggcgtgcccagggaaggcatggaagctccacacaccttccccataccttgccctatgcatctcttcatctgtgtcttttgcaataccctttataataaaccagtaaacgtaagtgtttccctgagttgtgtggactgctcttgcaaattatttgaacccaaagaggacatcatcagaaccccaacttgaagaccattggtcaaaagttccagaggcctggacttgtgactagtgtcctgagagtgggcagtcttggggactaagccctcatcctgtgggatctgacactatctccaggtagatagtgttggaactgaattggaggacacccagctggtatctgctgcttcctccgtaggggaaaccccctacacatttgatcacagaagtcttcttctgtgttgatgattgttgtggtgtgagagcagaggaaaaacgaagtttgagagttttttctctaaaaaagatgtaaaagaattatttttaaatcaaaggacaatactaagaaatgctttctactaattatatcagaaaatatatgaaaacatcttctagaaaatacaagtgaccaaaaccaatttcaaaagaagagaaaacctgaacataatcttgagaaaaatatcagtaaaaatctacccacaaaaaacaccaggcccacagcctttcacatgtagatttgttccaaactttcgaaaacatctaatcttctgataacagggcaaaaggcaagcttcccaatgcatttataagaccaaaaggttttctatttcctgaacaattcagtgcaatagctgttaagtgggacagaacaagttccatgtcctgggagaggccaaggtcacctgagtggggttagagctctagcaatgggtggagggtgactgcacagaaaagccagttatgtgggacattggagcccacgtgggaagctaagcgcacccatgtggatggtgtggcagagaggatagtggattggttatttataagaggaattaatcaaataagtaaatatggtaaagataataggtgctaagtttctcaaaccagaatacacacagcggtgctgtattgcaaatggcagtatcagtgtaatctcatagtcttcagtgctgtgtagatgactgatagataaatatcctataacttcatcacctagagggctggaagcaatgatatttcccataggcatgagcaaacctagcaaccttgtttctgaattccattctccaccaaaagaaaccggagctctttaggaaaaggattaattccaggcctagggcagggagagttaaagtctgaactcctgggtgggcgcggtggctcacgcctacaatcccagcactttgggaggccgaagtggatcacgaggtcaggagattgagaccatcctggctaacacggtgaaatccccgtctctactaaaaacacaaaaaattagctgggcatggtggcgggtgcctgtagtcccagctactcgggaggctgaggcaggagaatcgcttgaacccaggaggcggagattgcagtgagctgagattgcaccaatccactacagcctgggcgacagagcgagactccgtctcaaaaaaaaaaagaactccctctctttttgtgccaacaagcaaggaaatgctcaataaatgatgttggggcatgttaaagatgcaaaagccagctttaaggggctcccactggccaaatcagggacaatttgagtattgaaatatgtaatgataataaaagattagataataagttaatgataataagagacccatgggtctatacaaagtctcaaagtgtctccacacaagttatttgtttaccttaaaggagaaaactctgcagtggaggcacatgacagaaatccaccttaaccaaagtgatcaaggtttcaaaataacaggacaaattgaaattttgtgccacctgataggatccaaaaataacacagcattgcttctgtgatattcttcccaaagatgcataattcaaatccaatcatgaagaaacagcagacaaaccccagctgaaggatgttctacagaaaacaggcccgtattcttcaagtgaaggtcataatagtcaaggaaagacttaggaactactggcaataggaaggagactaaagaaacataactaaatagttcagggaacaaattattttgcactgggcttgcaacttttctgtaaatttgaggttatctctaagtaaattagcataacctcaaaaataatgataatataggaaaattaaagactaacccccccttatgtcaaaagatgcaaaattatacattttgagctatatgtatttaaaaattttatcaacaactgtttgtctccaaaatgcaagaatgtttagatatcagaaaactgtatgttattacaccaaattatatgccccaaaaaacaaatttacagagtaaataagacattttaatcatattagcaggtaaataaagagcatatatacatccaaagtcattcatagttttttttctgaacatctctaagcaagctaggactgaaggggtaactaaatagcccaataaaaggtatttataggggaaaaaaactcttaacagcaaacatcacactctatggcaaaacttaaaattatttcctttaaaatcaagaataaggaatcagaaacatccttagagcctgctgtaactgcttcttttcaataatatattgcattttcagccaatgcaaaaaagactaaaataaaaggctttaagaattgaaaaagaagacaggcatatgatgctaaagaattataggctgggcgaggtggctcatgcctgtaatcctagcactttaggaggccgaggcgggcagattacctaaagtcaggagtttgagaccaccctggccaacatggcaaaaccccgtctctactaaaagtacaaaaattagccggacgtggtggcgggcacctgtaatcccagctactcaggaggctgaggcaggagaatcgcttgaatccaggaggcagagattgcactgagccaagattgtgccaatgcactccagcctgggcgacaagagcaagactccgtctcaaaaagaaaaaaagaattacagtatggtatttgcaaatggatagcaaataaaccaattcagtcctagccataaatttatctatacatgggacattgctacaaaatactgagtgtcataaatcagtgtggaaagtataaatgatgaaaaactggtgctaggctatccatataggaaaaatacaaaaactatttccatacctcacatcatacacaaaagcagattaaaagcataaaatgtgaagatcaaaactttgaacacttagggaaaaaaggcagaaaacatatttacaattttaggattaggggaattttttaaagcactatacacaaatgtagctcttataaacactaatgatcgtaacacatttaggtcaaatgatctgtatgaccaaaagaagtgaaaatgtgggagaaggtatttgcactagatagatagagcagaccatggattaacatgtagaacatataaagatgtcttacaaatcaatagaaataggtctaagacatgaaatctgacactcaaaaaggagtgagagcaaaagataggcagatacttaacattactagtaagcaacaggtataagttaataccgtaataaattatcatttcacactgtaccagaatggctgaaaagatactgaaaaggccaagtgttcacagggggtgaaggtggagggattggtaaacaaaaacaaaacaaaactgtataaaatgttgatgggagtgtaacttgacacaagctcaagagcagcttggcaatagtccttgattgctccatttgtttctggctggagaaactcacacatgtgcctaaagaagtactgtacaatgcctgcaaatctcaaagaactggaaagaccttaaatgtccagacattaaggaatggatagttatttttcccccataaaagaacaattaaaatgagtgaatcaggtctacatatatccacatggctgaatctcaaatacataatggtgagtgagtacagcaagttgcataaggacacacgtaacaccgcttatataaatcatgaaagcccacaaaataaaactctatattggttatgtatatatacatgtatagtaaaattataaagtcatacaacagcccgatagccacagacttttgttacctctggggagggtgagaaggaaaagatataaggccttgatgtggcctctgatgtttcatattttaaaatttgaaacaagattatcgatggtaaattgctaacacctctgagaaaagcggggggaattttgcctcagatataactggtggtgactgctgggtaataatttttattatacaggtgagaatgcgagtatcagagggcatgaggaggagaaagctgagtcagggaggtaaggggaccaggaggcaggaaggagtttatacactgaaataaaatgcagatcaagaagaaatgcctgtaagggccaaacatattccactgatgaaacaaatgcaaatcccaattcaacagaatgaaataaaacccagtaacctatcacattcctccatactcactatagactcttttaaatgacattccgtccagtgttgatgaagttcacttttttccccgagttaaaaatatttgccttatttcaaggttaatttgcagcacctccccctaaaacaattaacttatttgcccactgaataaaacgtgttgaatctctgcattaaaaacagcatctgctacacgtaatggaggaacacaatgggactatgaactcttctagttcatttagtgcataaaactattatatagctattatttttctcattttacagataaattgagattcagagagcttaaaacctacccccacaaccaccatgctgacaagttagcatgagccgtaattcaaattcagtttgccagacagccccaagacccatacccttttccctatacctaactccctaggaggtagatcttatgtcctgctcttatgttctatgtggggcacactcaccatacacgttatatttccccatacaatagagtgagactagaggactatcttttgaaccaggaattgctctcctaggaatgatttggaaaaaaagataaagaaaagttatatttaaaaagtggcagctccagaccaaggagaataaaaaataaaaacattaaagaataacaaataaaattctccacatcacggactaaaaccattttacaggtcaagaaacatctgcatacaaactaaggaacctatgtaaattcatatactagttatggtggggccaggatctcaacccagacagtccgattcccaaacaggcatggttaatggttacgctattgttttataagcctttttgagatccacagtgagaaatatatttcacctcatgatcctgattttgtttcacacaaaagtgaaacaacttctacaaaacagcattgaccttaatatgtagcaaaaactttaagatgttgatttccagtcatgaaattctctcatgacccacgatttaaaaaacacacaatgcttaagtgcttcaaaaatacagtatttattgtaataactacagtagcaagaagaaaaaaacgaagtggaactacgtgtttagcagcagagctgaataattatgaatataaacaattactattgggagaaaatacattacactcattgcttggaaccatgaataatacttatatatgtacgaaatatagaaaaataaaataggttaacataataaggatataggcaattattttttttaattttataaaaacttttatttttccttacaaactggggtagttaggagacctgataatagcttttttattttcttggcaccaaagcaacttacttatgtgttccttcttgcattatctgttccagatcatagtcaagttttccaattcgttttactaagctagcaaaattttttataccaaaaagagtaaaatcaaaacaaatgctcctttgtttatagatgaaaatctggagcaaaataacacaacattaaaaaaacaaaactttgcaaacacatcctaaagctacacacattgaagcgtttacagcaatatgctccctgggttcgttctcccttcccccaatcctctaaactgtgcctttgggtctcagacccttgtcccgggggtccctctgaatccacctttcaagaggatggagctgggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttggtggggtagacccctaagcgccgcagaaagtcccaggcttcagtttccttgatggtgttgcccttcataaagatgagccctaagacgatcatcaggaggcccgtagtgggcgtgccttggtcacccctcatctcggcatcctcctccacaggctccagggtgttgatgaggatgtaagtgttgctcttgggttcaagttccaccagcttatacccgaagacgtactggaggcgctcggcggcccgtttgaagaggtcggggaagatgtccttgtagtccccgatgacgtgcttcagtatgtcggcccgcttgatcggaatcttcttctggtctttaatcagcaagaactgcaccagctcggacactttcagctccagctgcttctggctcctgggccccacggcgggggcggcctgggcccggcgggcgccctgaggcgaggggccctgcgacccctgcgagccgcccggcccgcgggacgtgctcggggcctcctcggcaaagccgtctctgagaacccgggcgtcttccccggcccgcgaagccccggggtttccgctatggctccagtctctgtccctctcggcctggccgccagagcggccccggttcctcggtttttgcaacatgtctccggcggcaggtgccggcgcacactccggtaggcaagcagccgcggcggggattgcgggtcggcgacccgctaacgccggtgcctggaggcgcgcgcagtgtcggctgagactgcgtgctgcgtcatgaagcctgcgccttgcgtcagggcggctgggcggtgcgcctgcgcggctgcggcgggtaccaaaaggaacagcgttttccgtgcagccctgcaggtccgggcgatgatttttagtatagtgaagtgttgttaccaaaccatgcaaacagagagcgagaaccgaaactcctaaacaagtgtgtcgctaaattcagaccacacaggctcaggcaagttttacagacagtattatgagtttctaaatcgggagcatttgtaaacggaaagaattcagaggatgaacgtgtgagaaaaaaaaaaggtgaagaggaagggccgaccgtggaagtaaagtaaaaacatttatttctacacaaaatgtagaaggacataaaagacccagagggctcttagttttcgtccctccacccaatttcataccctccatcccactgcccccagttactttctctaatgccccgtggagtctgttaaaaaccaaagtcggctgcaggctttctgcgcaagcaggacttcagtttcactatttccgtatttatattctctgcattaaactcctttagctagacaactatgagaagaccacaaaaaacgtgtcagtattaggtaaatgttttagcttggtcacatgggtttatcttttggaaaacaactgctttcgtcacaaccacaattttagcagaaatgggtaagaggaatgctgcaaacaaacgtgcactctcaagagattactacttaatttggggcatcactgatcaagaattgcaataatgtggagctcttaaatttcttaattcataatatattagctttgaggaaaaaaaagagaacactgggggatttatctctcatctatgatgtgatatacagtctctactgtatattttaattgtgcaactcaagtagccaaaatgagtcatttcattaactcaaaccatcagcagtctgctgccatgacttctacagatcttagcaaatttgtttcttctctatttacttgcaaagaagaaactgaatttccctgtgtctttttaaagctacccagaaagtggataaactcttcaaagaaccaaattgagttcctctttaatgcaaatatattcaaaggaaagcaatttagaacacattatctgagtaatagcatcaaacacaaccttattaaaattttgttaattgttagtagcataacacttttgtttgtaattcagtaggaaaatgcaatctgataatggcactggaactgcaatagtaaatgtaaaatcatattccatgaactaatgcaagtatgctaaaatctggtatgcaatgagtaataacttactgttccacacaagatgcaactatatcctcaggcatcaattttaatgacaaaggcctactatgaaaaacaaatatattatcaaggcattcatttttttacaatgagaaaattcatctgcttcagtttccttgcaaattaaaatctggacttaggttcatagaagcttcctgccatctagaattctgcaaaaggtccctactgcaggatgtggatgttgtattgagggaatagagagaccgtctcatattgttttatattgttttatactcagtacctgttttaagaaaaaacaacaaggaagtaaaaccaaatacaggcagcccagcgccaggcccaaaaccaggcctgggcctgcctggcctaaacccagtagttaaaaatcaactcataacttagaaaccgatgttattcatagattccagacattgtatagaagaacattgtataaagaacagaactgccctgttctgtttctctctgaccaccggtgcatgtagcccctgtcacataccgcctgcttgctctgatcaatcacgaccctttcatgtaaaatctttagtgttgtgagctctttaaagggacagaaattgtgcatttggggagctcggattttaaggcagtagcttgccgatgctcccagctgaataaagcccttccttgtgcaactcggtgtctgagagattttgtctgcggctcgtcctgctacagtgccttgagtcaaaaaagttcagtgaccgagatataaggggaaagtggaaaattagataaaagctattgtcaacagttgggctggtttttcagtgctctttcttgctaaggtattcatgtacgttaccaagcagcccaccagtcagactacccctgtcactgtgaaaatcagcagtgtcctccagcagcacgcttacctagatagcagactgtcattactcaagatagaggagaagagataccagtttttaagtctcaaaacatctctctacactctttccagaagaatgcaggtgagaaaatgcagacataaaataagagtattagaatgaagttttaggccctgcatggagaagtcatccagacccacattccaccttggattgatactggaagccatggatgtctggggagaaactgtggtgataacaatactaacattagtaacaataaatataaccgacaacagccaatgattatagtagttgctgctccatctccatgtctgcagttttactttctgtggtttcagttacctgcagtcaaccacagtccgaaaatattaggatattttcaaagagaaaccacaatataacttattacactatatttgttctactttattgttagtgtcaactgaaggatgacgaggttcataaatttggaaagagctttatttctcataaagggttgcagtctgcggggcggccattccaacaggctaggaagacaacctcatgctagaagccagaaacagacacttcaagggagggcaaagggagcaggaatctatgcagaatggggtggccaaatatacatatttaataagctataggaggagtcatgaacatttatgcaaggagaaatgtgcatatgcgcaattgcacttcatgtctctccctgggacccatattccaaaattggcagtgttagcatgatccagggtaggagttttcagccctctgacatcaaaaggtgaagtagaggacatgaaaaccctgactgcatgtcttccatagactggccagaactactccatggttggtggtcttttaccaggaagaactgctggtcaattgtgccaaaactgcaaaagggaggggcagcatcaggtggttggtttataccagcagtggagtcttttgaaagggctgatttctgtttagctcttagggaagaaagcctaatggcatttagagcgggtgagggtttccaaggttattcggggtccccttggccaagagggggtctgttcagtcagctggagggcttaagatttcatttttctcatcaattattgttaatctctattatgactaatttataaattaaactttttttttttttttttgagatggagttgcgctctgtcgcccaggctggagtgcagtgtcacgatcttggctcactgcaacctccgcctcctgggttcaagagatcctcacatctcagcctcccgagtagctaggattacaggtgtgtaccaccacgtctggctttttttgtatttttaatagagatggggtttcaccatgttagccaggctggtctcgaactcctgacctcaagtgatccatccacctcagcctcccaaagtgttaggattacaggtgtgagccaccgctcctggcgtaaattaaattttatcataggttcgtgtgatgattaatgtggagtgtcaacttgattgaaggaagcaaagtattgttcctgggtgtgtcagtgagggtgttgccaaaggagattaacatttcagtaagtggactaggagaggcagacccacgttcaatctgggtgggcaccatctaatcagctgccagtgcggctagaataaaagcaggcagaagaacgtggaaggacttgacttgctgagtcttctggtcttcatctttctctcatgctggatgcctccttcccttgaaagtcagactccaagttcttcagcttttggattcttggacttacactagtggtttgccaggggttcaagggtcttcagccacagactgaaggctgcactattggattccctacttttgaggttttggaactcagactggcttccttgctcctcagcttgcagatggcctattgtggggcttcaccttgtgatcatgtgagtcaatactctagtaaactccctttcatatatacatctattctattaattctgtccctctagagaaccctgactaatacagtatgtatctatgcatagggaaaaacattgtggatttagggtttggtgctgtccacgatttcaggtatccactgagggtcttggaacacatcctccacagacaaggggggactactatacaaagtgaatggtgggtcagaccttattccaggtggtttacaggtatgacttcatttaatccccacaacaaacctatcaggcatgtgcatttattatgtttctcttctcacaaataaactgtcacaggagaagattattaagttttgaggctctatagcgagtaagtggtaggtgtgagatctgaacacagccaatctgcctccagagagtgggcttttaactgtatactgattcagagcaaacatagacatggtgtccttgaaaaagtaagggctttgggatcagatgaactaacattagaaacctgtacgatactgacactcctcccggtttaagtctccaagtcaacaaaatgaggcctaaacctggcatcaggggattaagtgagataggtttacccagtacctagcacagtgcctggcagggtagtttgataacaatttgcttctttccagggatttctgttaaggaaaatatttgaggactacacaaagttgtatatactgcaggggaggcaaaaccttccctccaccctcgaagggccccagctggacctgagacttaaactaatataaaatagattaacaggagaaaagcattcaaacttcatttaagttttacaggacacaggagcgcttgttagggaaatgaagaccgaaagaggtggcaaaacctaaatgcttttatatttggttgaacaaagagaggtaattgtgggaaaagtaaattatgtggggaggataaagggagataattattttaacgaagttgtttgtacagaattcacttggctttgaatccccattgagtaatgtttctttcctcttggtacagtaaagctatttttcacatgggagtttttatctcctgttttcaggaagaaaagaggaaattcaaatgcccttcttgcatctgctatttttcaagtgcctttagctcaaagtaatccttatgccaaagtggcatattttgggcgggcagcatattctgccatccttcagtagaacgatgagaaagatgttcactgcagcaaaacacatgtacacaagaatcaaaagggctggaaagaaatatatatatcaaggtactattaaagttaatttgcttttaaaaataaaaatcaaccctgattttcttgcttgggagatgaataaaaaatatattttcaatgaagtttaacttcaaagtgacactatgccatagcagctatgcacattcacatgttcaatacattcagtgtgattcgaatatggcatttgtgactttctgttcaggcagtgaagtcacaaagacaagtggttaaaaaagaaaaacattttcaaacactttatgttaatgaccttcatgctttaattactagacccaaaagaaaaaatcaaaagtctttgaggcaaaagctaagctagctaagatttcaagtgcaaagaacaaggaaatgcctactacaaattgctctttagatgtttatagtaattaaatgttttattttgtcttttcgatagcaaatgcctgccaagaaactctaatcatctttattatctactagattctcctcttcattcatggtatttcttgtgaatcagaaaaaggctttaatttttctgacagcaacacagtgctaaaagcaggtgaggacttcttaggaagaaaggcaatgatcaaagcatgcagccaccacatatgagctgttctctgccttttccagtggaagaaagtgggccaatgtgcagcatgtgagcaagggagttgggaggcaaatactattttggtgggtagacagcaggaaaagcaatccagacatcttaatggttgcaataaagtcccttgtgtccacacatttacaacagttatatatattcattcatagcaaagatccctcctgcctaggtcacatggtagactacctaataacactttgtccctcataaatgaatattttgatgaagcagcaacagagttttccttggctggtggaagcgggtggagaggtgagccttgacaagatagtgctttccaagcattgcagccatttggcccagaagcctggtcttagactctcttttcaagaaatgcatcttccagttatccagggccctttacttatgaaaatcattagggcctattaagttataaaattacaaacatccaaggtcttgatagtggtcactaagattctcttcgtttgcttggtttctaatccctttgttctgtatcctttccctttagaaacagcctcttcccacctttaaaagaccttagtatagggctgccttcctttcctgagtgcacaggattcaggccagacacagtgactggttcagaagttcagtcagcatccttccaggacattcagacagattctcgcccctctgagctcacaagctgaggggtgatgtaagcctagccacttgtgcccttgcttctgaaaaacctgcctcagggcgaagccaactcaaaagagatctaagagatgggaaacaatcttaatgctgccatttgaatccctggatgctgagttcaagatcagactcctggagataatgaattactaaagcatctccttttgcttaatctgctttgagttggttcctgtcacttgaaagtgaacaaggtctggctaaatcagtagccaatcctattattcaggggaaaaaagggtagtaagaaatgagactttggagctagggaaggttaaaaccaatgaggagttttgaatataatgagaggtgaattgaaaacaatatgacatttttgttatgtttcttcccagtgttctgtggttggggaatgtgctcatcattttagttggtggcaacaggggtaagggagagacaaattatgaagaactgtacttttccatatggaaagtatatatgggccaggcacagtggctcaggcctgtaatcctagtactttgggaggccggggcaggcagatcacttgaggtcaggagttccagaccagcctggccaacatggcggaaccccatctctactaaaaatacaaaaattagccaggcctggtggcgggtgcctgtagtcccagctactcgggaggctgaggcaggaatcgcttgaacccaagaggcagagcttacagtgagccaagattgtgtcactgcactttagcctgggccacagagcaagactccgtctcaaagaaaaaaaaaaaaaagtacaaatgagctaatcaatctggtgatttacctttgcagaaaggagttttacacaatttggaatataaattaaagcagcggtccccaacctttttggtactagggaccagttttggggaagacaatgtttctatggaaggtgcgggagtgggagggtggtttgaggatccccgcctgcagttctcagtagggctcacatccctatgagaatctaatgctgccgcttatctgacaggaggtggagctcgggcagtaatgctcactcgcctgccactcacctcctgctgtgcggccaggttcctaacaggccacgaactggtactggtccacagcctggggtttgggaacccctgccttaaagcatctcctactctaaagtggctgtgttctccatatttaacccagagcacttccccacttgctataccacgcaagatgacagaaacctcattcttccagactacgctttagcctaaagtagagatatatgcacaggacagaggtatgtccacaaagagagctgacaaagctaatatccagacagggacaatgcgaataggttatgagaaaactgaacacgttgaaatggaaaaaaaataaattagagaaaaaataaaaatattcaaggcagacaagaaagaccccatgtatacataactggtggtcttgagggagataacaaccataaagagagaaacaggtgactgtaggagtcctggggagctgggtttacacaggccccgcctctctgatcccacccccaccccactgcagctccctcccttggactaataaccacagcaagcatgcttccaggactggagggtaatcagaggccatgggttccccaagatctgcagaagagatccagtacagggttcctccctccctgagacacaagtgagagcttagcaatgaagttgcatgcggagaagagggcttgccccttcccaaggaagtcctgggaaaagcaaggactgtgtggtacttgtggggtctgtgctggcagaagcccgtgtctcccttctgagagagtccacagctgtcccctttctgagaatagtcctccaagaccctgtcccaggctgttgttctttgggagaggcaggctaactgctgccaggcttcaaggttgggagagccagcagtttgccccctgtgaggcctgggctccaagaggcccttcatagtacttcaaaaggcatgtagacagtgtgccctctgatgcatcgtgaccataaaagcaaaacctgctgggcctcttgctacttgccacctcatactttttcagtgactcccaacaacatgactcacagaggaaagggagaagcacagaccccattccagttatcccactggatatccttggcctcttttctgcagatctgttgaccacagatgtaagaatttatttctggagcctcaattctaatccattgctctacatgtgcactggtttcctggggctgccacagcagaataccacagacttgggggcttaaacaacaaagtgattcctcacagttctggaggctccaagtctgagatcaaggagtcggcatgtttggttcctcctgaggcttctctccttggcctgcagatgaccacgttctcactgtgttctcagctggcccttctctgtgcatgtacatccctggtgtctcttcctccttttgttgactataaggataccagtcctgttggaccagagccccactgtaaaggcctcattttaacttaatccacttaaataacttatttccacacacagtaagtctgaggttgagtcttttgaattctgggggagacactgcagcccatcacgtatgttgacgtgtgccaccgccacactgcctggttactgcagagtgttagtaagttttgaaattagaaagtataagtgctccagttctgttatttttcaggattattagggctattctgggtcccttccatctccatatgaatttgagaatcagcttgtttattcctgctaaaatttagttgggatttttttttttttgagatggagcctggctgtgtcaccaggctggtgtgcagtggtgcaatctcgcctcactgcaacctccacctcccgggttcaagtgattctcctgcctcagcctcctgagtagctgggactacatgcgcacgccaccacactcagctaatttttgtatttttagtagagacggggtttcaccatgttggccaggatggtcttgatctcttgacctcgtgatccgcccaccttggcctcccaaagtgctgggattacaggcatgagccaccgcgcctggcctcagttgggattttcacagggctcgttttgagtctgcagatcaatttgggtagtactgacatcttaaaattaagtctaccgatccacataagtgggatgctagttaatatggacaagtgaatttattactcctccaaaaaactattttcacaaactttatatcaacatgagaaatcatgttgtatctttctacctggagggagcaagaaagtcaggtggtgtgccttttgtacatgggcaacccaatttcttatctagactttcttttgctcgcctggaaaaaaaaaaatgaggtattgcaaaaatgtgataattgctttccttagtatgaaaaactgttaaaatgagtaaagcctgtgctcaactagaattctcacatttccgttttgatgtatccgcatttcacagtaaaaaaaaccctcagttatgtacatatgtgatcctgaagtacccatgattaaaaacaaatatttcaatctacaatgttcagttctattagatcattaaaagacgtatctctactcgcattctctgaaaacgtgtaaatcatgctcagcatagtgacaactccactaggacaggccgaccaactcatttgttacaaagtctctggccccctgagtgaggagcccccagaaacctaatgtgaaaggaaacttcggttttctccccagctgctttccttgagtttgcatgatatgctttggctgctatgtggagctgtcaaaagccttgaacagacaaaataaagaagaatggcattccaggaaataaacaagcttaatctcagttggacagaaggaggtacaaagaaggcctggggaaggaagaggaagaggcaggatacagggaagacagaatggactctgtaacctcaggaaaaaatagcaaccttataaatacaaagatgttccctggcagacacatgtcagcacctgggttatgaaagaccagccaatgcccccccacacaggttagaatcacattcatcaggaaggaagagagcagaaggaccctgctgcctggtgatgtctcagctggcgtggctgcagctttgcttccagcagccggggaaccgccatgggaaggcgtttcctcaaaatgcatgaaaggcggaggagcttggttttctgatggtttgctgccccttgaagttggcaacaccatcccttcatctgcatggataaaccggggcatcctttttgagaagcagtacttttttttttaagactttattaatcccacacgtttgagagaggtggttgggaaagcaagtattaatgaattaactgcttcctaggattcaatcagtcattaaaaatgtacccgtgaaattttcttgagctgttcaattgtttatcattatccaagtggttcatactctcatgcatttattttccttccacatttacctctaagcaaattacctaattcaacatggttattattctggatatttaaaagctgtgtattgggaaatttcacatagtaatatgaatacacctgttacgcttaatcctttgtgcctaggtgtgattattagatataatttatagaaattctgccgaactcattgtaatttattatccatttatggttttacttgattagtcttacttaaggatgatattttctaaatgtataaataaatgatacagcctattaaagtggaggttatataataagtgacgggtttaggagtggacatgtgaccgagctctggccaatgagttgcaaggggtatttttggaggcatctgagaaatgtttacttgctcttaaaaaagaagattgtaggaaaaaaagaaggaaaactttcctgttctactggacccccataccagacatctgcatgtactgcctcaagcaggggcaactgtctcatgactgagtagagctaagccaccacatcaacacatcgaaactggcagaggggaaagctggaaagattctaggtccttgaatttgtgaggctgctgaaccagctaaccctgcggcaaccccgctctggacttgccatttgacgtaataacttccttcgttattgaaacttgtgtgaattggtttgtatcacttgcagccaaaagccaccccaaagcttcccagctgacatctgtagactagggagtcccaacaagaggaacagacttcacctggtgaagccgtgccaacccactccacctgtctctgagatctatagacatttgaatgtgagcgtgaaatgctgctcaagttcaggtagactacagctcaagaatgtgagactacaggttggtagtctgcctccctctctaaggcaaagagatatttcaatgttacctgggacctgagaaagggggagggtctatggtttgcccagataactaaagtctgtaggttagaaagtcaggatttgtttggaagctataaagatgtatcctcatatgtcatggacatcatgtgatatggtttggctgtgttcccacccaaatctcatcttagctcccataattcccacatgttgtgggagggaccccacgggagataactgaatcatggggaaggtttcccccatactgttctcatgctgatgagtaagtctcacgagatctgatggtttcataaggggaaactcctttcagctggttctcattctctcttgtctgctgccatgtaagacgtgccctttgccttctgccatgactgtggggcctccccagccacgtgaaactgtgagtccattaaacctctttttctttataaattacccagtcttgggtatgtctttatcagcagcacaaaaacagactaatacatcatcctaacttgaatgatgcctgtcctcagtgagtggtccattgtgagtatccatcaaggagttttctcccactgcacactggacctcaggagttaccacaagctccctagcactcttcaaattgttcctcgtttccagcaagtcatctcttctccacccacctcatgaattcaatattttagatgcctgtcacattgcctgtcgctgatccctgactcttgagaccccactatgtgctacagtcttggtcccctgtttgcttggaagaagacaggaagttttaacccgaggctgtagagggcttcaggcataccggtctgttcttgttgcctggactcctccagcacatccaagtctgccctttaaccgtttcttggctacaactggtctcaatatggtgatggccaggggacagatgagctttgaaagcctcgggccaaccagccagatgttctcttgcctccagtggtcactggtgatgcctggtatgggggtgtgtccagaggttgacccactgttgctccccatggcctatgatagagggccatgctcacacagggagctgggaccaaagaccagagtccagcaagaatctctggaccaaaggtcaggcagtctggagacagtctgcatctctggcagaccccagggtgagaagcagctatcccaggccagagtggggtcagctggccaatctgggggctctggagcagatgagagggagcctgtcctgcacacttgaaagagaagttgcaaggtagtaccaaggacaattcagctctacttgattctgaaaagactatccccaccctcaccataaggagaagagacagtgtagtttgccagtgcaactgcggagggaaaacaatcccaccctatctgcctctatctcttcttctttttttttggagacagagtcttgctctgtcacccaggctagagtgcaatggtgtgagcatagctcactgtaaccttgaacttctgggctcaagtgattctcctgtctcagcctttccagtagctgggattacaggcataagccatcatgcctggccccatctctatcaatccaccatggcctgggggggattttagctatcatagcctgcagctgggcccaaaccagcgctggggaaactccacacccaccaaaacaatgcagcacagcaaactcatgtgccccctaagagggacagtggtttgaaggaaggagacagccaaattctagaacagatggctactacagagcagaactaatgacagatacagaaatagactatataatataaacaatgagaattcataaggagatattattagagcacaaaaaatgctgccagaacagaaaaatgcttgattttttttattgttttgttgttcctggatcctaagagaaactccaaatgctcaactttttccatttaaaaatttagtagaggtactgtataaaagaacggtccccactaaaaaccaaattactattttaggaagataaaatgaaagacgtatcccacagcacaagataaaaagttaatgaactaagaatcacgagttaaggatcaagatatggagggtggatgcaggaggatgcatcctatgtaaataataggagttgagggagaaaacaaaagtatgagagaataaaaaaagaaatgccaaagaaacaaaaccaatcgagtcttaagattgaaagggttctgaaaatgctgaatttagacacatccttacaaagctgctgaatttccagaatagggaggaaaatcatataagcttccagacaggaagaacacattgcttttagaaataaccagtctaggggccgggcgcggtggctcatgcctgtaatcccagcactttgggaggctgaggtgggcagatcacttgaggtcaggagttccagaccagcctggccaacatggtgaaacccatctctactaaaaatacaaaaattagtgaggtgtggtggtgcaggcctgtaatcccagctactcaggaggatgaggcaggagaatcgcttgaacccaggaggcagaggttgcagtgagtaaagattgcaccactgcactccagcctgggtgacagagagagactccatctcaaaaaaaaaaaaaaaaaccaaaaataaataaccagtctaatatcacatttctcacctgcaatcatggaaagtaatagatcatgggctaacatttagtggctagggagaagaaagaactgatgaggaatcctccaccaggcaactacagagaaatcaatgattggacctgcagtcaggaaacacagcttctctgcatactctctgtgaatactccaggatacgctaccaaagagccagatcagaacaagggtccaagggagaagacagagtgcagtgatcaacagtgagagtgaatctcgtaatatttatttttaaatcttcatgcacaatggtaacgtcaatgcaagttataacacaatttttcttgaggattcttgaaatgaaataatgaaaattttagttagatcctagccccaatctcagcatactccaggaataaggagaagacaagggcgaaggagtgaaaagaaacatgattcccagggtttctcctccaggtgggatgagatgaagaggacactgaaaatattcaggcagaagggtgtgctggtaattaagctacgttttctcaatttcaaatccactgctccctgacgctggagtgggggctctttaagctgtggttttcttttgttagatggtgttctattgggttcttccagtaagaggcaatggagggagcctgaaaagtggggagaggagatgaacttgcttcttccttttctcttgctctccatgtcagtaccagcctggcagtacccctgccctgggcttcaacctctctcaggacttccaaaccagctttcttgtgctctctcagaagtatgaacaatagcaaagcacttccctgcagatatgaaaaagactgaaagagaatactatatacagcctttcccaaaacatttgaaaaacagagaaagtgggcaaattcctagaaaaacacaaccaagaaaaactgatgcaagaagaatcacaaagtttgaataattctaggagcttctgaatctggaattccaaacttcccttcccagaaaacttcaggccaagatgacttcactagtaaattccactgaacatttgaagaagaaataacaccagccttaaataaatgtttccagaaaagcaaaagagggactaatccccattgtgtcttatgaaggaagtttaacctccatataaaatctgtcaaggacattttgaaaaatgaagatgaaagaccaatctctctcatgaatatacgataaaaaaatcccaaacaaaacattaacaaacagaatcaagagattcagcttgagcaagctgagttcagtcaaggaaataaggttggttcaacattcaaaaaccaatcaagataattcaccatattaacagaataagggagttctctcatatggtcttcccccaaaaaagaaaagtcatatgataaaattcagcatttattcatgattttttttaaactaacaaaacaaaatttagcaggctagaaatagaaaggaacttaaacaatcactacaacaacttccattaaacatcatatgtaaaataatgagaatgttgcctcaaagataagaaataacaaagaaagctgccatcatcacttcatcattttactggaagtctcagtcagtgcaatcagaaaaaagaaataaaagttacaagattggggaaaaaccccaagttatcttattttcaaatgatgtgattctacatgcagaaaattcaaaagaatgtaaagataagttaatagactcactgaatttatcaaagtagctcgatataaggttaatagacatacatcagctttatttctattttccaataacaaaatagaatgaaaataacagcatatgtggtacattttcccaaagatggatgcaacgcaatctcccccctacatgcccttttgtaccaaaatgtgggtggctgaaccttccatcaagggacagggactatctgtccaccctctcaaatgtgaactccttttgtggcctgctttgaacaatggaatgcggcggtagtgacactgtctgagtcctggagccccggcctcggaggctgacacctctacttctgtcctctggccacggtccccactgtagtgctctccttgcacggacagagctcagcccatgccactgactagggatgacaggaaaggctcagcagccagcatcaaagttccaaatagaagagtgaggccgtttagaccattatgtaattgagtgtcctgtttttaaaaagtatttcttctttctccttcctgcctgttccttgtcttgcccttagcatgagataatagtctttgctctccctccttctaccaggaactccctggcacaatgtttccctcatctaattatgtttttgtttagaagttccagagactaaatcttgaaacaattcgggccactatgggattctccctgacctgcagattacttccaagctgcagttaatttgcaactgggctgtacccaagatggcaccagcccattcaccagatggggcaataacgcaagatagtcataggaacaagtcatgtagactggcacctcctcatcactcctgcatgcccctcataccaaacaccctttttaagcccttaaccttgacccaaaaagctgaaatggtttctttcaggcactatccgcggccatttccccatggaatggggaagaaagcttttgggataaagtcactttcctttcactgtattgcatccttgttctcggctttgcaagcagcaaatagccgtgcctgcattcggttacaattggattgctccagctacactgcaatcacagaagaaagtttaggcaagaccagcaaaaaaaaaaaaaagaaaaaaaaaaaaagaaaacccatggaatcctgaggaatgataaaactattgttgttttaagccattaccttttgaggtggcttgtggcacagcaatagataaccaaaacaccatactcaatcacaataccacacacacatttattttgtttaaagtagaaatatatctaatgagagatatgcagtgcctctactcagaacattataaaacaatattgagataaattacgtgagacccaaatacatgttcatagcagacatgctacggtaaagatatcaatattccccatattcatcaaaagcttcaatataatcccattaaaaattccagcagggtttctttatacaatttgaccaatttactaaaaagctcatgtgaaaatgcaaatggccctgaatagcaaaacaagtctgaacaacaaaatgctgatgttatagataccaagtcttatttataaatctatagttattaagacaatctggtattaatgcaagtatagacaaaaagaccaacaagatcgaacagagaatccagaaagtgacccacggttaggaggacactcattcgtcacagagatggcactgcacagctgtggggaagggactgtcttttgaataaatagcccaggatcaattggatattcatacagaaaaatgaaattacattttttaaacaaaaatttactttcggtaaactgtagttctaaatataggtgggaaaataaagctatttgatgataacaggagaaaaactctgtgaccctgaggtaggaaaaatattttttaaatcaagacaccaaaaagaccactgaaaaggcaagcctctgaaagcaagaaacacatactgttctgtatgcatatttgtatacgtgcgtgtgtgcatatacagtcatgtgccacacaatgctgttttaggcaagtctgggccacgtatgtcacagtggtctcgtttgactgtaacgcccagcacagtgctcctgctcctgtttccccatcatcaccaacacctggtgttgtcagggcctctacactggctgttctctctgcctggaaagttcttcccacatggctcactcccttgcctccttcaggtccccagcaatggtgagatcttccctcataactctatattaagtgtagtaattaacggtacaatatttctactgtaccttttctgtgtttaggtatgtttagaagcacatatgctcaccactgtgttacagtcacctatagtattcagcacagtaacgtgctgtacaggtttatggtccaggagcaatgggctgtaccctatagcctataggtgtgtagtaagctgtaccctcatctaggcttgagtaagtactctctatgatgtctacacaacatgcatttcccagaacacctttgtcattaagcacataacacataactatatatgtacatgtgtatgtatgtacatacatatatgtatatatccgcccaacaaatcacaaataactcaatgacgggatcatttccagaacatacaaaataaataagaaaaatgggcggggtgcagaggctcacgcctgtaattccagaactttggaaggctgtgggcagattgcttaagctcaggagttagagaccagcctgggcaacgtggcaaaaccctgtctctacaaaaaattagaagaaattagctgggtgtggtggtgtatgcctgcagtcccagctactctgaaggctgaggtgggaggattgcttgagcctaggaggcagaggttgcagcgagccaagatcacgccactgcactccagcctgggtgacagagggagaccctgtctcaaaaaaaaaaaaaagaaaaagaaaagaaaaatgcacataacacaatggaacataagggcttcaagaaaaagagcatctaaatgtcaagtaagcatgaaaaggcactctaccttattagcaatcaaggagatgcagaacaaaactgtaatgagacaccatgactcaccaccctatggctaagatgaaaatgactgacaacatcaagtgcgggtgataatggggaaaaacaggaacattggtggggtaatgtaagctggaccaaccactgtggaaaatgatctggcattatctactaaagttgaacctatgcaccccgaaatttcactcctagagagtgcacaaaaagatttgatatgaggcacggtgtggtggctcacgtctgtaatcccagcactttgggaggccgaggtgggtggatcacctggggtcaggagtttgagaccagcctgatcaacatggcaaaaccccatctctactaaaaatacaaaaattagccaggcatggtggtgcgcacctgtaaacccagctactcaggaggctgaggcaggagaatcactggaatccgggaggtggaggtttcagtgagccaagatcgcaccactgcactccagcctgggtgacagagtgagactccatctcaaaaaatatatatatacatatataagtgaaagttcacagcagcattatttgtaatagtcaccaaattgaaataatctaaatgtccatcaacaacaaaatgcataaataaaatgcaggatgtatacgacgaaacactgtacagcaataagaaggaggaactacggctaaatgcggcaacatgaatggatctcattccttcactgcttttgtggatctggccctggcctcccagggcacaggtaccagagggaccctcctgcaagtccctcctcacctcaccaccacaatggtcctcaaaaaagtcaaactctttaaaatcccccaccagtctgcacaccgggcagcccctgttgtctagcctcacctcctactttccctgagggcactctcccgagccataacttctcctcgcagtctgttccttgagtgtgccaggcgtgcttccacctcagggctctgcacgggttgtcctctctgcctggaaagttcttcccctgcagaatcacgcggctcactcccttgcctcctgcaggtcttggggaccatgagccctttcccatgactctatattcaggtatcaccccatgtccatactcccgaggttttgaacgagttttactttttcaccataacactcacctgcatctggtatatgatttatctgcccattctgtatgatcaatctccctgcacaagaatgcagctttgggagaatgagaattttgcctcttttgttcactgttatatccgtaggagccagagctcttctaacacacagaaggcgctcagtacaattctgttaaaagaatggccacataagaagacagaaacacaaatgctgactgatgctgtctgtgcttagacagagcttgtctatccgtgggcctcaccagtaggttcctctgcctgtgatttcctttctctaggccgtgaacttctatagaaaggactcttgcagctcctgccagggcattgttgagactagcagccagcactgtgggagccaaagggagtgaagctgaggaggccgatggagatgcggcctcatctcttcaaaggctctcacttaatcccaagtgacttaatcccagtgttcacagaacatccatgtgcccccctgcagttcctgcctcccttgcagctgggatgggccatgtgcctgagtctggtgaatggacatgtgagtagaaggggtgtgtcccctctggcctgaggtgctcaccatcaggtgcctcccccatccctttcttccccctagacagcaattctgggggccatggaaggggtctcattacctcccttcccacacagaggaaagctgccctgaagagctatccagtccatactatgcatttgtgactaagaaacaaacctttgctacgttaagccattgaaatttcaagggtttttttgttactgcagcatagactatctcatcctgacgatcttctgtcaggcacccccactcctgccttagctgtactagacatccttgtactctgatgtctctctggttcaacctctgtctgctactggggtcagatggacagttacaaagctgcacaggctccatttggggctctgagggggttgcctgcatatcacagactgtaaaccagtgctccttttgccccatccacattcctgccttcagagacatctggtgactctaattcctgagcccttgcagggccctgaggcacaaatcagcttgtttcttcctgccccaccctggacccccagctctcagcatggtggataagcagaaagaaatcgaagccaaccacacaatgatacacttctcgtgcttccaaaatgctgctgacattttccatctgttcatctcctctttgtgagtttgaatcttttttcttttattcttttattgtcattttaatggtgcttcaggagaaatagtgataaacaataactatttcgtgaatacctatttattttgaatattcattgtaaccactgctaagaacagcaaaacttttaggtttgcataggttttttttttcttccaagaagttcagagtacatttaaaatatcagttcaaagaacaaaaggaaaatattattattaccattttaaatcagataaagccctgtgaggtctgaaaaactgccccaccacccaatgtttgccaatgctgggacacaatccaggctcccatctcatgatctgattttctactagtggacactatcctgagtgctatcatttatatccatcttcccacctttcataggaattctatctgcataacccaaagaatacctgctggagactgacacttactgcaactttgccagcactttcatgttcttaacaaggcatttcaccagtttaactactgatcatcactgacaggcttcagtacataatttcatatatgaatcttcatccatctttttcttttcttttctttctctcttcctttctttccttctttttctctttcttcagtacataatttcatatatgaatctccttccttctttccttccttccttccttctttctttctttccttctttctttcttgtttttcatggagttttgctcttgttgcccaggatggagtacaatggcacggtcttagctcactgcaacctctgcctcctgggttcaggcaattctcctgcctcagcctcccgagtagctaggattacaggcacgtgccactacgcatggctaatttttgtatttttagtagagatggggtttcaccatgttgtccaggctggtcttgaactcctgacctcaggtgatctgccctgctcggcctcccaaagtgctgggattacaagcatgagccactgcgcccagcaatgcgttttcatatattccataaaacacagaagtgtgtactaagatcatgtatatgtatatggcttggaaaatttataaggtctccatctagaagctgtacatctttggttttaaaaggagagggctagagagaggataaatccaatcagttgcttctttcattcctcacttcttttctactgttaacatacgtggtcataaagaataccagatgcaggccaaatacatttgccatgagaaaaagataaaaatcaaaacttatggcttctcaatactgcttagtattaaagcacaatgctgcattctctactacagctgtgtagttacaagaatctatttgagtggccatgtgtcaaagataatggcacaaaaaggctgggtctatatggctcatggcccaacatccactgcttaacatgatgctttttctggattaagatcttcaagtcaggcaaaggctccggaggaggacagaaaaccaaagtgaagagatgcactaggtagggaggtttttgggttgtaagtgatagaaactcaactcccgttacctcaaacaaaaaggggaatttattgactctttttttttttgagacggagtctcgctctgtccccaggctggagtgcagtggcacaatctcggctcactgcaagctccacctcctgggttcacgccattctccctcagcctcctgagtagctgggactacaggcgcccgccaccatgcctggctaattttttgtattttttttttttttagtagagacagggtttcaccgttttagccaggatggtctcgatctcctgaccttgtgatccgcccgccttggcctcccaaagtgctgggattacaggcatgagccaccgcgcccggccaaatttattgactcttagaaccaggaagggttcccccaggtcccaggcagagagtggggatgcaagcaggcccagaagcaggtgtgagctgctgtgggcatcgctctgtccaggccgtcccctctgtccttggcttggctctaatcctgcagcatggcttacttcacactcggggaagcgtggaagttggccatgctgagcaactctcttaatggagagatggagtgtggggtccacaccctccacccccgctccactgcctgcacaccatgccaagtccaggtattctagggaatggaattctttggggttcgctgccatgcccaagacagtgccttcatgctgtcctcacagcgcatcctgcagtaactgtggggaaactgagggtggggggagattgtctgggaagaggagctgggcctacaattctgatgctccctgcagcctaacctccaccccccatgtcactgccaaggaatcttgcagcccagagcagacagcaagagcctctgcccactaggtctggtgctcagaagcaaagagggccctctggggggacagtcaacacaaggagacttagggtgggtatgggcagccagagccccagccccaggagctgggattagggcccaggaatgaggaaacagggaggggaaagcacattgaccaatcctggaagcagcgttattgaaaggttctggaaattcaaagaagcaggcaatgtgtgggcagactcccgttagtggccagagcccagaaggaaccaactttgccttcaacctcagcccactccctgctaacagagggagatggtgacgagtctgaggggcagaaggaggtccaggcatagaattgcacttgtcctgggtctctgcaggtcagcagtgggatgagtagggagacagcccgccctgggcctccacagtggggaaatgaggcaaacgtgtctcttttgctacaggaccaagtccactgtcctagaaaggtttagttgacaaaaaaggagacattcacacatttcctccagcagacccactcactgttatttgttacctgggaaaccaaacagccatatataaacaagggtaaatcttagaatcttggaaatgaaagtgccataatttccaggatgatattaaaacgccgtgactttctgaaaagggttccagcaacgtggttgacagaaaatattgtgctttcttttccacaaggagattgaatgtgtcttatttacagttacccagaaaacaatgatgaaagtagctaagtctgcattctagaggcacaggtcaaggtgtctgaggaacaatttggcatcttggaaagtgaagtcccgaggctgggaccctgtggggagccttcttcattgcaggctccaagccgccagtctcctgctgtagggagaaggctgtcggtgctgcaaggatggagggggatgtgcagagcccaggcactgagagaagcttcttagagccagaccatcgggagggagaaaacagggtgacaggggtcagttcatgaagacccttggattggatttcattccaagaacagtgaaaaacccatgtaaatcaggacttcgtgaatgtgcttattctaacttccagaggaaataatgaatgaactgtctactgaaaacccctgcctgtgctccatctgaaatgctgcctccctcaaagcatgaagctggagtcagcactgacgacgatgggcagctggagtgggagaagaggagtggcatggcctcagggagggccaggtccccctgcacctctttcccacttggtgtcccccacctggtcactcccaggaagccactgctgaattgacagccaggcctctactgagtcaagggcgacatctggagatgtagaatcagacataaaactcagcacagtactcatcccttatccttagggggatacatcctaagacccccagtggatacgtgaaactgcagatggtaccaaaccctacgcagcagtttttcctatacttacatacatatgatacagtttataaattaagcaaataagagaataacaatagctattgataaaacagaacaattataacaatatgccagtaaaactactcttgtgttttgccaccattaagtaatatgagggttccttgaacggaagcactgcgatgtatgtctgataaccatcctggctactaagtgacggccacgtggggagtgtggacagcctggagacgctggacaaagggatgaagaaagacagcaggagatttttatcctgcgactcagaacagtggatttaaaacttgtgagttgtctgtttctggaatattccatttagtatttgcagcccatggttgatcaaaggtaacagaaactgtggaaagtgaaaccttggggaagaggggactgctgtataaaaaactttgaaaccttttccatatgtgtgtgggctccatccaatcacgtgaaggcctcaagggaacaagactgacctcccctgagcaaggaggaattctgccagcagaagggctttggatcgaactgtaactcttccctgggtctccagtctgctggcctaccctgcaggtttccacaacaccatgagccaattcctgaaaacaatctctctctatgtatatatacacatcctgctgattctatttctctagagaatcccaattaatagaaacagtaatgtagaaaagagatgatggtggcttggatgagggggtagcagtggaggtgatgagaaatagttacattcagggtgatttgtaggatttcctgaaagtttggattataggattgagagaaacagaagggctaagaatgaatctacagaagggcaaatgtaagatgctatagaaggcagaattagacctattttaaaaaacacatgaaatcctcagaacaaatattggaaaaagagatcctttaaaaaattgttacaaaactacaaaataactaggcccaaaatcgacagaaaatattatgaacctaaagcaaagtaaaaactctgaaactctacagaaaatcataaaacttgatgttttttaaattaaacattacatatattgaatactataaagatgtcagttctactaaaataacatataaatccagtaatcctagttacagtaacaactggattgggatatgtattagttttctagggctgctgtaatcaagtaccacaaattgggtggtttaaaacaacagagcatccatcagggagagaattggtcaaatcagagctttctagaaaggccatcccttaagagcaggtctatctcagctctagagtaagggttactctaggccattggttggcaaactgtagcacatgggtcaaatgtggcctattgccctgttatcatatagcctgtgaactaagaatgacttttacattttaatgaagaaatatatgtcacagaccatctgtgacccataaaccctggtcctttacagtaagtttaccaacccctgctggaaacctaccataaaaaatcttaaaaacaaactcaaaagcaccaagctaatccacaaataaatgaactaactacctgccagaacaaaattcaacactctctgaagcgaacaaaatctaaaatccagacactcagccgtatcacatttacaatgtccagcatacgctcaaaacttaatagatgaattcactagagaataagtttcagacaaccaaaatgaccaaagagacactgacaaaagacatatggaaagctcacactggccaaacttagaacagtgtacgcatcatagggaataataattgcagggagtaaaacatgtctatgaagttcataatgatctttacaaaaacaccatttggccacttctagaggatgctcaaaaaccaatgtattctcctgatgacagataaagggaaataacaaagcacagtagataactagtaccatctctatatcaaataatcaaactaataaatgatgaggaaattgtagaattagaatatcatcagtttgcaaccttcagtgtattaatgaatccaggcatcacacattaaaagttgctaaaatcacagagaacaccagactttggcatgcctctttatgaatgaacagaatcccacctatcatcttaccaaagagaaagaactggagtctgatcaggcctctaaatcctgttgcttattaacaggaaatatacagaacacaggaacattttgaactgcagcaaaagtaggtaatcagtgaatccatgcggggtctacaggtgaaatgcttcggctcttgaacagctagactataaggaaaaatgacccattaagataaaaggagacaaaaagactttaaaaaaatccaacaaaacaaaactaaactgcagtgtctgaaggatgcacatttagtgttgaaacaataaaagaatctagcagctgaatgcacatggtttttaaacttgtggaacatggacaaaaattgaccacacatggggcagaaaagcaagcttcaacaaatgtcaaaagtttgaaacagaaaatgtatggtttctgacaaccgtataattaagctaggactatataacaaaaagatactagaaaacctatgttcacaaattaatatccttctaagtaacctatgaatcaaagaagaaataatcaatattagaaaataatttgaacggaatgatattaaaactaataggatacaagtcaagctgtgtttagagggaatttatagccctgagagcatttattagagaagtaaagctgaaaattaatgacctaagcattcatctcaagaatttagaaaaagaactgcaaattaaatcttcagaaaagagaaaaaaaaggaataataaagacagaaagcaatgaaataaaatttcaaaatacaataaaaagggaaaaacaattcattgataattaataaaactggcaaatctgaggtaagattgatgaagaaagcaaactgcaggcatagataactactatcagaaatggaaaggaggtatcacttctcctacaggcattagaaagctaataagaggatattatcaacaaatttataggaatacatttgaaaatttagataaaatggaggattgcttagaaaaatacaacccaccaaaactgacacaagaagaagaaatactgaatttgaatatattgtaactattaaagaaactgaatcataattcagcaccttccatgaaataaaatcctacagccagatgacttcaacagtgaattaattctaatgaccatttaaggaagagatactaccagtcttacatgaactcttccagaaaatagaaaaagaactattcactgtgttttctaaaggcagcataatcttagtaccaacctctgataagacctttcatgaaggaaaatgatatgaaccatctctctcatgaacataaatgcaaagatcctaaacaaaactttaacaaacgtgacttgaaagtgaaaaaaagaaaaaagaagagtaatgtccatggaaataaactagaagtacataaaaatgataacacaccatgaccacataaggttggatccaggaagcttggtctatccataacaggttgaagaaatattttatgattatgtgacagatgaagaaaattacagaactgtgttcaacaagtattcatgttaaaaaaactcttagcatacttggtttaggagttttggctacagcttactggtgtttaacaaactccttcggcctcagcagctgaaaaccactttcctatggtcatgaggtctgtgggtcaggaattctccaggcacagtggagatggcttgtgtctgctccatgatgtctgggcctctgctggaaagacgcagtggtggagatgaactgctgcctcttcagcgtcaccttttacctaccactcagccccaggtcacgtggctgcagcacactggcttcttgactgttccttcaactcaccagccaggctccagcatcacagaccttacttgctcttccttctgtctggggccttcttaactagacatccacctggctggacattcttctttctcaagtcacttctcagtgggatttctctggcctccctatgaaaaatcaaaatccccatcctgtgcccactgaccctctctggccccctttctgcctgtaattatcactttataatatataatatagttaacttatttaactatacttttattctatgtcttccctcatgaggatgtaagcttcatgaggcaggtatattttgtctaattttattcattgctgtatccccagagcctagtatataataaagcacacaaacattagctgttgattaaatggatgggtaggtagatggatgagtaggtgggggatggatggatggatgaatggatgggtggatgggtaggtgaatggatgagtaggtgggtgggtgggtagatggatgggtgggtggatgaatggatggatggatggctaggtgggtgggtggatggatggatgtgtggatggatgtatgggtgaatgggtagatagatggatagatgaatgggtaggtgggtggacagatggatgggtaaatgaatggatgggtgggtgagtggataaatggatgaatgggtaggtgagtaaatggatggataatggatggatggatggatggatggatggatggatggatgggtaggtaggtgggtgggtgggtgtacagatggataagtggatggagaaatggatggatggatggatggacggatgaatgggtagacagatgaatcggtaggtgggtagatggatggatggatggatggatggatggatggatgatggatggatgggtgggagggtgggtaaatgcatggatggatggatggatagatagatggataaatggatggatggatggatggatggatggatggatgagtggatgggatggatggatgttgaggcatggcatcaccaatggtagataatcactgggttaaaatggaatatatgttgctattaggaagaatgaattaaaactctatgtgttgttatgaacaattaccaagatttattatgagaaggaagcgaggtacagaacatagtcttttttttcttttgagatggagtctcgctctgtcagccaggccggagtgcagtggtgcgatctcggctcactgcaacctccacctcccgggttcacaccattctcctgcctcagcctcccgagtagctgggactacaggcacctgccaccatgcccggctaattttttgtatttttagtagagacggggtttcaccatgttagccagacagtctcgatctcttgacctcgtgatctgcctgcctgggcctcccaaagtgctgggattacaggcatgagccactgtgcccgaacagaacatagtcttaatatgctccttttatttccatttaaaaaataatttctatacaggtaaatatgtgtggatatgcatcatcagtgttttctgaaagaagtaaaaaacactattcataatggaagttctagggagaaggactgaaatacaggtgggaaggatgccttacttttccatttagcacttttctgcaaagtttggattttctaaccatgctactcatatttttattttaaaatatcaacaggagttttttgacagtatgatcatggactatttaaaacagtttttctttacaattcttgctacctaaaataatacttgttataaaataaaaaataagggtaattttatttaacagaatcgagaaaagcaatgctagtttttaaggacttccttgaatcactgagaggtcttcttttgtcacataaggattagataatgttcaatattttctatctgctaaggcagaagtacttttacttatgcatgtccttagagttttcagtaacaaaaatttcagataatcagagcactttgttctctacaccgtctgcttttctgtgattttacggtaataggcagtataacagagttgacagaaaaacacttagtaaataaatatggtttaaaactttttatactaagttttatgtctgattctgtgtctccagatactacctttgactaaggagaggcatggttgtacgttcaatgatggctccctgggaatgacccaatggaagtagcattttggaaaccctggttctgtaatctgaacgttgtggcccatgagattaacatatagaaacctaattcccagtgtgatagtattaagaggtgaggtctttggaaagtgattaaatcatgagggcgtaaccttaatgaatggaattagtgtccttataaaagaggctccagagaacttcccagccccttccaccatgtgaggacacagcgaggaggtaccatctatgaagcagaaggtgagcccttgccagacaccaaatctgcttgtgccttcatgttggacttctaaccctcctgaactgtgagcaataaatgtctatggtttgtaagttacccagcctatggtattttgttatagcagcctgaacaaactaagacacccggggtctttgtttgttaactatgcatattgaagctctaaacccatgcccatttccctgtttttttcatttttgatgtttgctcagtttgtggcccattttcactcttcatcttcatattgcaaatatctgatatgacagtcgagtggaagcttctcttccaataagaccatgtaacaaaaatggaaaaccaaaactattctgaaaaaagccatttaaaaaatgcataccaagattttaaaaaaattcctgttaaatttatcatgagtccaagctgttcattcaacttatcgtcttggtatttgatacaaaaaatccccattcactgactttttaaaaagtagaatgatgctggtgagttaaggaggtatagagtcccatgttttaaaggaagatgcagctcactcacactgcagcaatatcctttgccggctgaagcaaaataaaaatcagttctactgaaagttgataaagtttaagtccattaacagcgagagtactttatattagatttgcaaatgaatgagaaattaatggagaaaagagctctcacaatagcttcaaaatgggcatatttataaccctattctgcttgccaaaaataattacatcccatttttttctgccaaccatttaaactcatttcatagaaaacggaaaaagagggttggtgcaaatgggatgtttcccgcaagaaagaagaacggttttggaacccttgagcaatttgcaaggcgtgtcaattttggaacgctctgtcttgaaatattcgctttttttatgtttatttgtttacctattgtttattctccaaatcaattacacaacatttatttccaaatgccacaataatggaagactggcatcacatttggaattgattctaatgctgcacagccgcctgctgaggatcctgatccggttcatgagctgaggctgatcccagcgaccccagacctgaccaactctgcattacccagggaggagcaggccagtctgagcagactcaaaggggccgcttctactcggagccactttgcatccactccaccctaagcttctaagatacttcggagcccacacgacactccttcacaggggctgggtggcctggcctgccacttgaaatatggggctgctggcacctgctgtatccttctcagccccaggcatagctgctgaaaaggtgacaggaagagtctattttcatgtcatcacttagtttgtatttgtttgcagctatttcagccttttacatttgtattatgcattctgaacaagttgctatttgttttcttagttgatgtagtcagctgcacagaaatgcttaatgcttttctcagatgattccaaccaaactgactttgatttcagacagatagcccatggccatgctgacacataaaaccaaccatgacactgggttttttttcagccttttattttttttttaggtttagggacacatgttataggggtactttttttaggtttaggggtacactgtcatagagctaaatggcatgttgttgggggttgttgtgcaggttattttgtcacccaggtgattaagcacagtacccgacaggtagtgttttgatcctaacccccctcccccaccctccaccctgaagtaggccccagtgtctattactcccttctttgtgtccatgtgtacccaatgtttagctcccatttataagtgagaacatgtggtatttggttttctgttcttgcattaatttgcttaggataatggcctccagttccatctatgttgctgcaaaggacatgatctcattctttcttacggctgcatagtattccatggtttatatgtaccacattttctttcttttttctttatttttgagatggagtctcactctgtcacccaggccggaatgcagtggcgtgatctcggctcactgcaacctccacctcccaggttcaggcgattctcttgcctcagcctcccaagtagctgggactacagacagctgccaccatgccctgctaatttttgtgtatttttagtagagatggggtttcaccatgttggctaggctcatcttgaacctctgacctcgggtgatctgcctgctttggcctcccaaagtgctgggattacaggtgtgagccaccgcacccggctgtatggcattttctttatcaacactccactgaaaatattgaacagatcatcgaggcagaaaactaacaaagatatttgggacctgaacttgacacctgaccaaatggacctaacagacatctacagaactctccacccaaaattaagagaatgtacattcttctcatctgcacatggcacatactctaaaactgaccacacaatcagccatgaaacaattctcaacaaatgcaaaaaaactgaaatcatagccaccacactatcagaccacagtgcaataaaaatagaaattaacactaagaaaatcactcaaaaccatacgactacatggcaaacaaccatgacactgttacagccatcttacctgttccctccttcaagacctcccttgcagcctgctctcaactcaccaaccagagtgggcctttaaaaaattaagccaggcaatgacactctctgcttaacacctcccagtggctccctacagcacacagagtaaaaggcagaggacttagattgacttacaaggccctgcagtttccttccctctcccttcctctatgatcccctctctttcctccccactgctcacttccctctagccacagggcctcctggttgctcttagaactgtcagtcccactcagggcctccgtactgactattccctctgcctcagacattgcaaggcaaactccttcacctcctcactccctcacttggctcaagagtcacatgctcaatcagctctgctgtcaccatcctatttacaatgatagtttctgcccccatcactccctcagccaactgtaccacgttctactttctaacagacgttaccatttttagtctattactatatgccttcattaggatgtgagctccatgagggctgagatcttggtctgatttgttccctgatctatctcaaatcctcaaaacagtgttaatagttgaaaagcactcaataaatattggttgaatgaacaaataaagggcttatcaaatgcaaagataaatttttcatttaaattctctgccagaatttctggttccagaagatgggcagaggacaagtcatactggagcttgcacggcacaatgagttcagaagactattctgagtgagactggaagacaaatgagaattttgaactggggagtgacatgaggtgacttacaggtttttaaaagttcatcatggcttctgtgtggtgcacaggattcaaaggcaggagtagcgccagggagagtatttcagctgccttggtccagcaagagattaaagtggttcagaccagagaagctgtgctggaggtgatgagaagtggctggaccctggatatactacgaaggcagagctaacaggtcttgttgatgcactttgctgagagggagaggaagagagggagtggcgagagtcaagggtaactgttgaagttttggcctcagaaactgagtaaatggcagtatccattactgggacagaacagaggggagaagaacagacttgggagtggaatcaagaattctgctttggatgtgttaaaatggaaatgcctaccagacatccatatggaggtgctgactggccagttggatacatgagtctggagcccaaaaaagaagctgaactaaagatagtttttaaagccatgggtctggttgaaatcccattagagagagaagctggatagagaggaagactcggggcttcgtgctgaagcacttcccctttaggaagaaaagccagcaagaggggctaaagaagcagccagtgaggtagggaagggctgagcagctctaccgaactggaagccacatggagcatgtgtttcaaatgttgctgtggggtcaggtgagaagagtctaatcactgactgcgggatttggccatatgagggccttggggccccaggcagcgctgcgataccccagtgggttgttggtgatccttcaggatgggaagcagtgcccactggggcaagtagggtggtacaggctgactgtgggaggcgcagggctcagggaaacctgagcattcagcatagacaggaacctggagtcaggatgacaaggaaaatctcctgaattgggcacaaggatccttgggggggatgaggaagaggaattgagcatgctgcatttcctaaatgtggggcattggggtgcaaggcggtgcacctgaatatgaaaggaaatagccatcctataattccagaagcttgaagacaccaagagagttacactcacagagaagaaaaaggtttgcttttctcatggaaaaggttatatgtaacaagtttaggataccacatgacaatgtcttagttttaattaacttttataattcagcacatttttaaaagcacatacttgtatttctgataatgctatgccaggtttttacacttgtttcatattttttctcaagaggaagttatagtagtgtatctaagatatactgaaaaataattggtaattttttttttttttttttttttttttttttttttttttttttggagatagagtcttgctctgccacccaggctgcagtgcagtggtgtgatcacccaggctggagtgcagtggcgtgattacccaggctggagtgcagtggcgcgatctcagctcactgcaacttccgcctacctggttcaagtggttctccaacctcagcctcctgagtagctgggactacaggcgcatgccaccatgcctgactaattttttgtacattttagtagagacagggtttcgccatgttgcccaggctggtctcaatctcctgagatcaggcaatccaccctcctcggcctcccaaaatgctgggattacaggagtgagccactgcacccagctggcaaatattcttttttatttttaagttcatttgccaagaactcaattatttatagtggtacttctctctagctttctgtaactaaatgagaacattaatttcaaatgtatctctctactaaaatcatacagggtgttctatccttccttttatacaaaaaaaattgacaattatctgacgaaataggaaaatttgaacagccatgttttaaaagctgatcatgtcatgcttcagctaacataaaaaaaaaaaacctgaagtcaaaataaacgtttaaataacctgaacatgctgataattgacattgctttctatcataatcatcactttaacactgaaagatgaagaacttgctagtggtttaaggtagatcaggcattggatacagatccttcccattggtgtttactatccaactgcaagagatattggatgaaatatgaacatagcaaaacatttaaaaaggagaaattagatttagagaaaaaactaacttacctattgctatggactaaagtgtgccctctccattcatatgttgaagccttaaccaccaatgtgactatatttagagatagggtctttagtaggtacttcaggctaactaagatcacaagggtagggtcctgacccacaaggattggtggccttagaaaagaagaaagagacagagacctctctctctctacctgcacacacatggagaaaaggctatgtaaagacacagtgggaaggcggccgtctgcaagacaggaagcaagtcctcacgagaaccagaccatgctgccactttaatcttggactttccagcctccagaactgagaaaaactaaatttttgtgtttaatccacccagtttacattattttgttatgacaccccaagatgactaaaatacctattaatgagtttttaaaaaattattttagaagagaaacaatatgttgggttgtaatgtcaacaaataagtaataatgtgtttatatatttctatgatttttctgagagagaaaaattttaaattgagtaaatttctccccctaggatgcctgtctacagattacttcttccataaactctgacctcaacaattactcctaacaggaattcgaactgtcttgatgcttgaccagcctggccaacacagtgaaaccccgtctctactaaaaatacaaaaattagccgggtgtggtggctcacgcctgtaatctcagctaatcagcaggctgaggcaggagaattgcttaagccagggaggtggaggttgcagcaagtggagatcatgccactgcactccagcctggctgacagagactctgtctgaaaaaaaagaaaaaaggaaagcgtggtgacttgttttagacactttcactactgataatgacagttcacaggaccaggcaaagcagagactcggcacagtgccacagggagaccctgtcctgggcgccgagtggacctgcccctgagtcagctgcctccccttaccagcggtgcggccctagcgctcactgcatttcctcccacccctagtttcttcctcagcaacacagggataggagctcccttgcaggtgactggaggcagtgaatggtccacatatataaagcagctgcagtggtaccttgcacataacaggaattatttttagaatgacgttgaagatgttcagaatacccaaccccaacatatggagctctggcatactgttttcagttaaagacccttgaaaaacagcagaggcaagaaggacattctaatcaccccttttcttcctgaaaataggagataaacattgccatgtgaaagatgtcctccctcaccaggagaatgaaacattcttcgatggggaggaagagccaagagaccctgtgaaatgattcttactccttcagcctccccacacagtgtacctgtccccagctgcctctctttgtccatcttggtataaaagcatttgtgttttgctacttctctgggtcttcatttccttatgagggctcctgagtcacataaaacatatataaattggtgtgctttttcctattaatctgtcttgtgtcaatttaattcacaggcccagctgaaaaccctaggagattagaggtgaaattctgtctcccctataattgaatgtattataacacaaaaatatactcagaaagaagtcattaatttgagtatagtgataatgatagctatcagagtaatcccttttaaaatagtttcagttcctgtaataccaaggcccactcacatgttgtagtattgttaccactgtcgcggtaattagtttccatgacacaaaatcacctcacttgctttcccacagaggcagcaatatgctaaaagagcagactctagaccaggtctcccggggtccaagtcaagtgtgtgttgatgaccttccctgaaccctggctttcttctctatagaaagtgctcagtgggccaagcacggtggctcacgcatgtaattccagcactttgggaggacaaggcaggtggatcacttgaggtcaggagtttgagaccagcatggccagcacggccgacatggcaaaaccccgtttctactaaaaatacaaaaaattagtcgtgtgtggtgctggcatctgtaatctcagctacttgggaggctgatgcaggagaattactcgaacccgggaggcagaggttgcagtgagctgagatcatgccactgcactccagcctgggagacagagtaagactctgtctcaaaaaaaaaaaaaaagtgctcagtggtaatgcctatcccataggacgactgtgagattttgaacaataacatatgtcatgcctgtgcttgaagcctggcatgcatggccctcaggaaatgtgtacactgacctgggcataggactgagactgtcagagggaaacacggggcctgggagtagaccctgcatgctccgagggtctgcttccatgtgacgtggactgaaggtccctctcctgattcttcatgagatgagccagacaaacatcttatgagtgtcaccagcagcaatcaagacaggaagaaaggggcatcatgtcctgtcatgaactagaaagggggggcaggacagaaataagtggagaaaaggagatcctgaaggttccatgtcctccccagccctcacctatgtgagcacaggtgagcagacagaagctgagaattcgcactaataccttcaagtctggggtgatggggtctgagttgggtgcaggtagttctaggacaattttttaaaatctctttaaaacagaagctcctacgcagcaactcaggagctcaaccaagaaagaaagggccaggactgagggacggatgacgctcactggagcagaactgccctggctcggtcaaggggacatctctagggaggtcctcagagggaagagcaagaacccaagacctagcaaggatgtgctcagcccctgggggatctccccaccctgtcctaagttagacagtcaaggccaaaggcaacatccatgtctgaaatggagcctctgacaggagaagagaaactggccctggtgggtctgaaggctgtcggggcagggaagaattgtccgggccaagcccaggagcacaaggagagtgggtacatcaaggtgcatggaagcacaccacagcttatttggcaaacagaaggtcagcagaaacagagcttgaaaatggggaaagaaacatcaacccagacgccaaagctccccacaagaacttcatggaacctaatacacacataaacttaacaaaggaaggactcaaagtgagaaaaacaagactatgatgaaaagaaagctagagacagaactaaggaaaccaattacagcgtgagaattaaaaccccatcactgcaaatctagtaaataatttagaaacagcaaggaacagagtagacatgagtgaaaattcaagataatggcatgggggaaggtgtgagatctccacagtaattttgtagaagaaggaagagacaaattacaatgaagaggacccgtaaggagattgggaatttttttttttaactctagaaacaaatgtgctttgtgatgagagacctgtaatctaaaatttagtattctctcttcagtttcatttcaattctcctgttaatttcaaacaaagacaattttttaaaacatacacattattcttccatagcttgtgtcttgtatcattatatgatcgatagatttctgaatttatgaccacataacagtctgatcgtttctggatggtatacttctgggtaattcattgcctttgctgttgtacttttctgtatttgcttaaataatttatgagagacatgcattgttttttatttttaaaagtataatcttggccagatatggtggctcacacgggtaatcccaacattttgggagggcgaggtgggcggatcacttgagatcaggagttccagcccagcctggccaacatggcgaaaccctgtctctactaaaaatacaaaaattagcagggtgtggtggtgcacatctgtaatcccagctactcaggaggctgaggcaggagagtcgctacaacctgggtggtagaggttgcagtgagctgagatcgtgccactgcactccagcctgggtgaccgagtgagactccatcccccccccaaaaaaaagtatgatctttaaagggaagaaaatccactcaacattctttcaataagtagatattacacactatattgtaggcactgggattatgagctaggccaagaccttgcccagcttccagataaagtcatggaggttatagattcaggaagacaaacattactccaaatacagttcattccagaaatgcaagagtgattcagcattagcatatagtccatcctgttaacagagctaaagagaaaaattatatgatcatctctacagatgcaccaaaggtatgtgaaaaaatcagcattcattcctatgagaaacaacaaaacagaaactgagggataggataaagtcatgcctaacaagatagaaaatacatatttatgcaacacatacctaacctcaaaagccagcatcttaattaacaaagaaaaactaacttttcctgctacagtctggaacaagacaagcactcactctttaacactgggtctgaagtattagcccatgtacttagacaagagaaatcaactgtagaaataacattcatgaaagaagaagttaaaattatctttatttgcagagcatatgtttatgtactcacatgtggaaaaacaaaagaatccccacaaaacaagcaccaaaaaaaaaaaagaaagaaaatctaataagaaagctggttgtataataaatataggcataccttgttttattgttcttcactttatcatgcttcacagatgttgagtttttttacggattgaaggtttgtggcagccctatattgagtaagtctatgagcaacatttttccaacatcatgtgcttactttgtctctgagtcatattttggtaattctcagtacatttcaaactttttcattattactatatctgatatagtggcctgtgatcagtgacccttgaagatactattataattgttttggggctccatgaactgtgcccatataaggcagtgaacttaactgagaaatgcatgtgttctgattgcttcataggctggccgttcccctgcctatctgttccctgagacacaacaatattgaaattaagccaattaataactctacaatggtctctaaatgttcaagtgaaaggaagggtcacacgtttctcattttaaatccaaagctagaagtgattaagcttagtgaggaaggcatgttaaaagacaagagcagccaaaagctaggcctcttgcaccagttagcaagttgtgaatgcaaaggaaaagttctcgaaggaaattaaaagtgctactccagtgaacacacgaatgatcaagaaaacagccttatcgctgatttggagaaactatgagtggtctaacagaagatcaaaccagacacaacattcccttaagccaaaatctgatccacagcaaggcccgaactctcttcagttcaattcaatgaggatgagagaggtgaggaagctgcagatgagaatttgaagctaacagaggttggttcctgaagtttaagaagctgaggcagcaaatgctgataacctgcaagtccagaagatccagctaagataactgatgaaggtggatacatgaaacaacagattttcagtgtagacaaaacagccttatactggaagaagatgccatctaggactttcatagctaaagagggaaagatgacgcctggcttcaaagcttcaaaggacagactgactctcttgctaggagctaatgcagctggtcacttaaagttgaagccaatactcaaccattctgaaagtcccatggcccttaagaattatgctaaatctatttcacctgtgcactagaactagcccaacaaagcctggatgacaacatatctgtttaaagcatggtttacttaatatttcaagcccactattgagacctaacgctcagaaaaaaaatatgcctttcaaagtattactgtttattgacaatacacctaagagccctgatggagatgtacaagaaggttaatgtcatttttctgccagccaatacatctactctgcagcccacgggtcagggagtaactcactttcaagtcttattatttaagaaatgcatttcacaaagctagagatgccatacatagtgatcctgtaataaatctgggtggagtaaattgacaaccttctggaaaggattcaccattctaggtgccattaagaacatttgtgattcatgggaggaggtcaaaatagctacattaacaggagtttggaagaagttgattccaatcctcacaggtgaccttgaggttttcaaaatttccgtggaggaagtaatcacagatgtggtaggaacagcaggagaattagaattagaagtggagcctaaagatgtggctaaattgttgcaatctcatgagaaaactttaatggacaagcagctgcttcttatggatgagcaaagaaagttgtttcttgagatggaatctactcttggtgaagatactgcagacattattgaaatgacaacaaagggtttagaatatgatataaacttagttcataaagcagcagcagggttagaggactgactcaaattttgaaaaaagctctactgtgggtaaaacgctatcaaacagcattgcatgctacggacaaatcttttgtaaaaggaagagccaatcaatgcagcaaacttcatcactgtcttattttcagaaattgccacagccaccccaaccttcagcaaccaccaccaattagtcagcagccatcagcatctaggcaagaccctccaccagcaaacagatgacaacttgctgaaggctcagatgactgttagcatttttgagcaataaagtatttttaatcaaggtatatgtataatttttttagacatatgctgtggcacacttaataggcaacagtataatgtaatcatagttttatatgtactgggaaactaaaaaattggtgacttgctttattgtgatattcgctttattgcactggtctggaactaaacctgcaatatctctgaattatgtctgtatacaaaaatcaataatgtttatccataacatagataaacagttagaaaatgtaatagaaggccaggtgcagtggctaatgtctgtaatcccagcactttgggaggccgaggcgggtggatcgcttgagctcaggagtttgagacgatcctgggcaacatggtgaaaccccgcctctaccaaaaatacaaaaattagccaggtgtggtggtgcacacctgtagtcccagctacttgggaggctgaggcaggagaattgtttgagcctggcaggcggaggttgcagtgagccgagatcgtgccactgcactccagcctggtgacagagcgagactttgtctcaaaaaagaaagaaaatggtgacatgcttgtgaaagtaaagagtattttgaataaatggaaagaaatatattcttggataagaagatacaacagcaaagagatgttaattctcctaaagttaatctataaatttaatgccatattgattaaaaaaaatcatcattgtctcctagaagctaggcaaactgattatatagttcttggaagaacaactaagcaagaatcacaaaggaaactccataaaagatcaataaggaaggctagcccttccagatattaaaatgtatttaaagcccccctcttggccgatgaattgacagaccaataaaataaaacggaaatatccagaaacaaacacatttgtctatggtaatttagtatatgacaaaggggtcatttaaaataattgagggaaacatacacttttcataagtagtactgataaatccagatgggatggccatatggaaaaagaaaaatacacatctgtttctcaccagttatatcagaactgattccaaatagattagaaacttaaatggagacagagagaccccactttaagtattagaaaaaaacatggaattcctctctaaccggaaagttgagaaatatttcctataactcacagtccaaagtaataagggaaaaactgatgaacttaactacataaaatacaaatctttacatatgaatactaccagaagcaaataaaaaagacaaatgaaagacaaatgataaaccgcattatgcagtaaacaggaataagaaatgtctttatacactgctacagactgaccccacgcgatatcactaagttataaaaccaaaggctggaacaatgtgcaaggtaggcacacgtacatgcagtatgtgtacagcacatgtgcttgcttataatttagaaatgaaaggacaaagcgaaaatctaagagtagttactatagggccggggggtggggagacaaggaatacaaacaggacagaaatgataactagaattttcaggggaaaacactttactgcatagatttgactttgtaacagtaaatgtcttatataattatgaaacaaaattaaatcaaaaattaattaaaatccctaaaatcaaaagcaaaatgaaataagtgaaccagtaaaacgggcaggtgccttaaccacagagagcggtttaaactgactgtaacatatcaccatttaattgtatatctcaagtggtttatttcctgaaggataatcaagagacatgggagctctggtggcctctgctcactggggccagcaagggaaaataaagaagagagacagagagacttaagagacctaacaacccaatgcaaaaagagagaaacaggcacacagaaatttgaacatgaggtatttgatgataaaccaaattattggtatctattagttgtgatcacggcattgtgactatatcattttaaaaataaaaaataagggccaccttctcttttagaggtaggcatgtatgtattttgacacaaaataatgtgatgtctcaggcttgctttcttcatccaagggagaagtggtggggtactgatgacgcaagaatgtccaggagtggctggcagctatagctgagtaatggatgcatagggttcaatatgtcattctctttacttgtgtatatagttgagatatccacaatgtaaatgtcgaaaaatatgaaaatatgggttcagataataactctgctacttagtcacacagccagtttgtaaaaatttcctatgttttgggaacctgaattccttccttttaaaaagaagacacataaacctaagttacaagacaaattagtatatgataaagaggtcacttaaaatcactgggggaaacaaatattacaaatttgttttattacatattacaaagcctgtcatatagcagaactaaacaaaggccagttattttttattttggtatgaatttaactatgccaaattactaaaaatattttcctaaacatcacatcaaagtaagatttcacatggagttttaaagaggaaataaagaatgaagccttttggttttataattacacaaaatagcaatactagaatagaactaaatttatgcccaaatgtattcctcaattagtgcccaattcaaataccagatacaatgatgttattctgagtaacacccataaaactacatataactattaccataaataacatttaatttgtgggaccgcagttgctaagcctgctgtacctaaaactttgctgacatattctgcctactgtttcataaaaaacacacagtaatcagattaggtcaattagaaagctacaggcaaaacattgttccctttcaaatgtcctggtaaatagaataattttaaaatgaagaaatatttgaatcaaaatagtcaggaacagacctcaaagcattaaagaactagatctttatactctcgagagttgcattcaaagactcaatcaaattcaagttcatcacatatgcaaaacggaacacgaatctcccattaaaattatcataactgctggcttattaaaatgcttgagtgcattagacatagcatagaaaaattcaatataatatcactccaataatgtttctatattaatctagaaaacatggggaatggccctaaagcaaaaagtgctgctacaggctcatgcagaattgaacttatggctgttgaggccaacccacctcaaagaggcaaaaactgtcacagcagcaagatccagaggccttcatccgacccgggtgggatgaagagaagaattctcagcactgacccacagaaggaggcgggaggctgtggtgagatgaacagactagcgcccactctggctagctctcaaggtgagatgagggtgtggcttttgcacggtggcaatgtcgatgattttgaaacctcatgacagtgtttctgaatgtccaccgaaacatggctctcacaggcaacaaaacactcctgattagaggtgtaaattttccgcgtttccagagagctcttcatatgttgatggaaaattcccagcaacaaacttgaaggagtaattgcaggcaggccgtgttttattgcacttcgttgcattgcactgcacagatactgcgttgttgataaattgaaggtttgtggcaaccctgcaaggtgcaagtctatcagcatcatttttctcacagcgtgtgctcacttcatgtctctctgtcggtatattttagcaatgaagtatttttaaattaaggtatgtacacttttttttttgttttttgttttttgagacggagttttgctcagtcacccaggctggagtgcagtgtcgcgatctcagctcactgcaagctccgcctcctgggttcacgccattctcctgcctcagcctcccgagtagctgggactacaggcgcctgccagcacacctggctaattttttgtatttttagtagagacggggtttcaccgtgttagccaggatggtctcgatctcctgacctcgtgatccgcccacctcggcctcccaaagtgctgagattaagggtgtgagccaccacgcccggccaaattaaggtatgtacactttttaaagatacaatgctactgcacacctactagactacagcttagtgtaatcgtaactttgatatgctctgggaaaccaaaggatgtgtgtgacttgctttattgtgataaccgtcttattgcaatagtctgcaacagaacccacaagctctccaaggtaggcttatacattttcctattggttggcttagtgcaaaagatgaacccaaactggcaaagattaggtagaaaccagtttctgcaaactgaatgctccctttctccaggaacatctaccatcacatagccatttcctctacaaaactgttaccaaagagaagccaatttgtttacagtcatatgtaaaattaaaagcaacgattaactgtataccacctaaagtacctactctattcaaaacaaagctatgaaaagtaagaacatctcattttgccatctgcactgcatactcaaaccaaggcagagccctgagaggaagtgccagggagaccctcacaaccgccatgggtactgaagacacgagaaatagttaatggcaggccacttcttacttcacttcagatgaacggaaatctgaaggcttccatgttctataaactcttgggttttcacattagagaccagtggagagaaagagaaagtgcaagccagacccctgctttaaagcactgaccattcttttggaacaagaagctcagacagccccagtttcctctgaagtagcacaagtcaatgcaggctgagtgaacagaggtcctgggttgttcaagtgccatctaattccctattgaaattcactgctgccatcagtccaatggcagagcatctgtgcccctggactagggaagcggagatgcccagatttctgacacataaaccactgggtgagaaattcatctggaataacaaatttatctttaaaaagccaaacaaggacatccagtttcagttccaacacgtaaaaagcttggagttgtcactcccatccttatgataagaaaaaagctgaacaaacagaaactcagcaacctttcttggacccctcagagagctgaggttgcagaacaaactgccactgggaaatctgaagagatgggaatgcacagggtcccggctgagatctgctcacctagagatgctgctgggccagcccccagttggagcctccaaacgttaattctgacaaattgctggaggctgagggtggaccagcctccaagtgagactgctggggctgcagttttagggggacaccctacacttttgtgtgttttgcctctgagaacatcaccagattctcagggttaagagccctgatggctgtagcaggggagggaaaggctagtcctagtgacaaatgaacagaaccttctccataacaaaggcctgctctccaacacagtattccatctgggggaaggcgttttcctgaccccatgcccgtgcagccttcctgtctcacctaaggcaggaataaaaggctagaaacgcttgttaaggtgatagcccagagatacaggcccactaaaagactgaaatttcatcatcagagtaaaacacaccacacacacaccttcccaccacagcaacagggctgcagtataactaccacaaattacagttgaaggagctgctagacacaagaaagcattcttagggaaatccaaagacaagaaaaggacaaaaacaagagaaataggtgaatttgaaccctctggcacctacagctacagcaaatattaagagcctaataacagccatattaatataaaacctcacaggtaaggcctgtttcctttaattcttattatctgatacactatatttggttttcagcaaaaaattagaaggcatggtaaaaggcaaggaaaaaagtctgaggagacagagcaagcaacagaaccagactgagacacagcagagaatttggaaggactaaatggggtatttaaaaccactgtgatgaatatgctaagggctgcaatgggaaaaatggacaaatatgcaagaacagatgggtggtataagcagagatggaacgtctgagaaaaaatcaaagaaaatgctagaaatcaaaaacactgtaacagaaatgaaaattgcctttgatgggctcataagtagaccagacacagctgaggaaagaaacagtgagcttgaagataggtcaacacaaatgtcccaaactaaagtgcaagaaagaatgagaaaaaataaaaataaaataaccaccataaaacactcaagaacagttgtataatttcagaaagtgtaatatatgtataacaggaatattaaaaggcaaaaagagaatggaatagatgacacatctaaagtaatataaactgataaactttccaaatgtaatttaataatgataaattaaattacatttattttatttaataaaataagctgatagctttccaaacagaccccaaaccagagatcaaagaagcttggagaacccaaacaggataactatcaaaaactctacgctgaggcatctcattcaaagtgcagaaagccaaagtccaagagaagatctagaaagaaaccagagaaaaaaataacaccttaccatagatgaacaaatataagaattacagtcgatttatcatcaaaaggcaagcatgaagagcgtggagtatttaaagtgatgaaagaagaaatcccaccaacctagacatgtatatccagcaaaattatcccataaaagtgaaaaagaggctgggcgcggtggctcatgcctgtaatcccagcactttgggaggccaaggcgggtggatcacaaggtcaggagttcgagaccagcctggccaagatggtggaatcccatctcaacaaacaaacaaaaaaattagctgggcatggtggcgggcacctataatcccaggtactcgggaggctgaggcaggagaattgcttgaacccaggaggtggaggttgcagtgagctgagatgatgccactgtactccagcctgggtgacaagagtgagactctgtctcaaaaaaaaaaaaagaaaaaaaaaagtgaaaaagaaataaagactttttcggagaaaggaaaatgcaggaaatgtgtcaccagcaaagtgacctgcaaaaaatgttaaaagtagttctttgcaatgagaacatatggacacagggaggggaacaacacacactggggcctgtttgggggagtgggcggggagggagagcattaggaaacatcactaatgaatgctgggcttaatacctaggtgatggattgataggtgcagcaaaccactatggcacacgtttacccatgtaaccaacctgcacatcctgcacatgtaccccagaactaaaaattaaaatttaaatttaaaaaaaaggagttctttgaagaaaggaaaatgaaataggtcagaaactcagatctacacaaggaaagaaaagagctttgaagaaggaataaatgaaggtaaaataaagtcttatttttcttatttttttaaaaatttgaatataaacttattttttaattgacaaacttatatatatgtattatgcacatcatgttgttttgaaatacgcatacattgttgaggggttaaactgagctaattaacacatgcactgcctcacatacttattttttgtgttaagaacacttaaaatatattctattggcaattttcaagaatacactacattgttattacctatagtcaccacattgtgcagtagatctcctgaacttatcccttttatctaagataaattttttatcccctgaccaacatctcctcaaccactcatatattttcttattcttaattgatctaaaagataactgtttgcttaaagtaatatgaaagaaaaataaatcccgggaccctaattcactatggcaaagggaaaaattaagttggaagctgagtcacacaagaagctgcctttccttttgttgcccagcagacagctaaagataaaaggccagacagaggccagctgtctccacgagtgctgctctgtgtttactttatcttgtgtaaagtgtcgacttgctgagcactagatgaatatataatcgattatttctatgtctcctccttttcacgtgcaacacgtggattcagtgatgtgaccacacccaccctccttcccttcctgcccacttttcccctttaaatactgaagacctcaaaatcctcttgggaaaaagtaagatcacagattgttcctgtggttttgtgttcctttttcccggatgcatccttaaccttggttaaataaacctctaaattgcttgagacctgtctcagatacctttcggtttacggtaataatagtcaacatctattgagtgattatagcatatggataaatgcaatgaatgatagcaatgtcataagaaatggaagaaggaaacagagaatactcatttataaggtacctgtgatactgtgaaatatttggtcttgacctctttttttggcaaacaattcctaaaatccttggaatccccaaagtccttttgctaatgatgctaatgttaactgacagcttcaggatggggttgctcactggaaagacagaggcaggattagagggttgggactttcagcccaatcccccaaccccagggagtggagagggcctgaaggctaagttgatcaccaatagccagtggtttaatcaatcatgcctacacaatgaagcctcgataaaaacccaagaggaccgggttcagagagcttcctgatagctgaacacacggaggttcctggagggtggcgtcctgaagtgggcatggaacccaagtacaccttcctcctatcttaccctatacatctcctcatcggtgtcctttctaatatcctttataacaaaccagtaaatgttaagtgtttccctgagttctgtgagctgctccagcaaattaatcaaacccaaagagaaggctgtgggaaccccaaatgaaagctgattggtcagaagtcctagaggcctggacttaggactagtgttgggagagggggcagccatgggttccaggctctgcaccagtgaggtctgaggttatttccaagtagaagatgttaaaattaaattagagaataagcatctggtggccactccctgctgtgtggggaaaacccccacaatttaggtcacagaaggttctgtgttgattatcgttgtgctgtgagagcagaggaaaaacacagtttgagaaattttttcccaaacagtacctattctagatatgaaccagtattgtgttatttgagagtgaatatagagtagttgaaaatgtagagtgaaaactctagggcaaccactaaaataatttgtaaaagaagtgtaattgatatgctaaaagaggagataaaatggattcattaaaaatgctctattcaaaccagaaagggcagggaaaaaaagggaaagaagtgaacaacaacaaaaaatgttacaaacatagtagaattttttttttttaatacagggtctcattctgtggcccaggctagagtgcagtggcacgatcattgttcactgcagccccaaccttcctgagctcaagtgaccttcccatcttagcctcctgagtagctgagactacaggcacacatctagctatttttttatttttattattattattttttagagcctggtcttgaactcttgggatcaagcaattggcctaccttggcctcccaaagtgctaggattacaggcatgagccactgtgcccaaccatgtagatatttttaactacatcaatccaactgtgcaataatcactttaaagtaaataacctaaatatcccaattaaaagacagaaactatcagagtagataaaataaaaagccaactatatgtagtctacaaaaaatccactttatatataaagactcagattagaagtgaagggatgaagaaagttatagtgtgctatgctaatcaaaaggaagttggagtaccaatattagtttcagagaaagcagactttaggacaagggaaattatcagaggtcaatacgagcatccatagtgatataaaggtcagtttccaagaagacataacaatccttaacatgtatgcacctaaaaacagagcgtcaaaatacatgaggcaaaaactgacagaactgaaaggaaaaatggacaaatgtactattatagttgaagacttcaacattttcttcttagtaattgatacatcatcaacatctatagactacatccaacaacagcagaatacacattcttctcaagctcacagggaacattcaccaagactgaccacattcttggccagagaacacacgtagacaaatttaaaagaactgaaatcatacaaagtatgctcttagaccacagtagaatgaaactagaaatcactaacagaaaaagatggaaattcccaaatacttggagattttaaaacacatttctaaatagcatatggttgaaagaagtctcaagtgaaatgaaaatatactttgaactaaatgaaaatgaaaatacaacttatcactattgtgtatagcaaaagccatactcaaggagaatttgcagcactaaatgcctataacagaaaagaagaaacgtttataaccaataatataagcgtgtaccttaggaaactagagagagaagagcaatccaagcataaagcaaacagaagaaagaaaatactaaaaattaaggcagaaatctgaatagaaaattgaaaaataatagagaaaattagactcagaaaaaaggatacacaaattattaatatcagaaataaattaagggattaccaatattaatccatggacattaaaatgataacaaaggaactctatacctctaaatttgacaaattagaaaaaggactaattccttgaaacatacaaatgaccaaaactcatacaaggagaactagatcgtctgaacaggtttaaagctactaaagaaactgaatcaataattaacgatattccaaaaaagaaagcagcaggcccaggtgatttcactgacgaatcctactaaacactgatggaaaaaatagtatcagttttctgcaatttcttctacaaaacagaagcagagggaacgcttcctaatttattctatgaggccagcattaccctaatgccaaaaccagatacatagagcataaaaaagggaaactacagaccaagatctctcatggacataaagttctcaacaaaatattagcaagactaaaaatgtatgaaaagaattatatacttcaacccaatgggatttattataagtatgcaagactggtacaatatttgaaaatcagtcaatgcaatataccacatcaacaggctaatgaggaaaaatcatatcacatcaattgatgcagaaaatgcatctggcaaaatctaacactcatttatgaaagaaaattctctacaaactaagaacaaagatgatcttcctcaacttgataaaaagtgtttataaaaagctaacatcacacctaataatgaaatactgcacactttcccccaaaaaagaacaaggcaaggatatcctctctcactacttctgttcaacatcatattagaagtcctagctagtgcaataagacaagaaaaggaaataaaaggtacatagattgaaaagtcagaaataaaactgtctttgttcataaatgatatgattgttcatgtacaaaatcccaaagaactgtcaagaaactctcaaactaataagctagcataggtcacaggatacaatattaatatacaaaagtcaattgctttcccatattccagcaatgaaaaattggaatttgaaatttaaaatgtaccattaaacactgcaccaagaaaacgaaatacttaggtataaatctgacaaaatatgtataagaactatatgtagaaaactagaaaactcaaatgaaagagttcaaagattacctaaataaatatagagatattccatgttcatggacagaaagacaatattgttaatatgtcaattcttctcaactagatctataaatccaatgcaaccctaatcaaaatccaaaaactattttgtagataaaagctgattctcaaacttatatgaagaggccaaagacctagaatagccaacaaaatgctaaaggagaagaaaaaagaagttgaagcactcacaatacccaatttaaagatttacaataaaaatagtataaacaagtcaacatggtattggcaaaagaacagacaaagagatcaatttaatggaattgagaacccagaaataaagcccataaatatagttaactgatctttgaaatatcaacaaagtcattcaatggaaaaaagagaagatttttcaacaaatggtgctggaaaaattggacatctatatgcaaaaaaaaagaaacctagacataaaacttacaccttactcaaaaaattatatcaaaagggatcatgcacctaaatgtaaaatgcagaactataaaagttctttaagaaaacacagaatatcttggtgatttggggtttggttcaaagacactgttaagagaagaaaaagagaagtcacagactgaaagaaaatatttgtaaaacacatatctgataaagaatttgtatccaaaatgtataaagaaaagtaaaactcaacaataagaaaacaaaatgtctaactttaaaagaaggtggctgggcgcggtggctcaagcctgtaatcccagcactttactttgggaggccgaggtgggaggatcacgagattaggaggttgagactatcctggctaacacagtgaaaccccgtctctactaaaaatacaaaaaaattagccaggtgtgctagcgggcgcctgtagtcccagctgctcaggaggctgaggcaggagaatggcgtgaacccgggaggtagagcttgcagtgagccgagattgcaacactgcagtccaggctgtgcgacagagcaagaccccatctcaaaaaaaaaaaaaaaagagggtaaagatctgaacaaacatcaccaaagaagatacaggaacagcaaataagcatatgacataatgttcaatatcatttgccagtaggggactgcaaattaaagcaacaataagataccattacatacctatcacaatggctaaaatccaaaaatggacagtatttgttgtcagttgctgatgaggatgcaattgctagtgaggatgcagaccaacaggaatttttatccattgcttataggaatgtaaaacagccacttaggaaaacagtttaaaagtttcttacaaaacgagacatagtcttattgtatgatccagcaatcatattcctaggtatttacataactgatttgaaaacacctgcatgtgattgtttatagcagctttatttttaattgccaaaaactgtaaacaagcaaggtatcttaaataggtgaatggataaacaaactgtggtacatctacataatgaaatgttatttggccataaaaataaatgaagaatccagccataaaacaatatggatgaatcttaatgcatattgctatgtgaaataagtgaatcttaaaaagtaacatattgcataattccaatgacatggcattctggaaagggcaaaacggtagtaatagtgaaaagatcagtaagagttcagggagagagggaaggattaaataagtgaagtccagagaatttttcagggtggtgaactatttttatgatatgtaattgtggatacatgactatgcatttgtcaaaacccattgaactgtacaggccaaagagctaatctgcagatatgctaacttttaaaaagtatttaaaaggtgggaggatctcaggatcctaattttgcaaaatgtgacaaaaaacaatctacgaaacaacctcactgaaaggggttggggggaaaaggtgctgacttaagtaactctgaaaatcatggagtctgtaatactaaaggccaaagaagctgtacatcagtgatgaactctagttgataaatttgtttcccaggtgggcagtggttaatagttctgataccactactcacgtattttgaaactgaccattaagtaaatggatggcagatggtgagaaccaggtttctcactgctggagtgggaacaggggaggaggctggactgatccacgctgtaaaggattggcattgaagacatcactatgaactcatgtttagcttaatagactattgatggttatatatagaaatagttacaggttacaggtatatacatgtgttggtatacactcatatacagtcgtcctcccttatatgtgtggaataccctattctaatacccctgtaggtgcctgaaaaaacagataatgctgaaccctatgtatactatgtgttttcctatacatacatacctttgataaaatttatcattaggcacagtaagagattaacaatgatccctaataataaaatagaacaactaggctgggcgcagtggctcacacctgtaaccccagcattttgggaggccgaggcgggtggatcacgaggtcaggggatcgagaccatcctggctaacatggtgaaaccccgtctctactaaaaaatacaaaaaattagccgggcatggtggcaggtgcctgtagtcccagctcctcgggaggctgaggcaggagaatggtgtgaacccaggaggcggaggttgcagtgagctgcgatcgcaccactgcactccagcctgggtgacagagcaaggctccgtctcaaaaaaaaaaaaaaaagtatgaattgttcatctctaaaatttgctatttaatatttttggaccatgattgaccgcacctaactgaaaccacggaaatgaaaactgcgaataaagaggaaccaatgtatttccttgttttgtcagctgagtgaacctagaagcaaaggcctctcccccacccagtaataacaagcacacctggcactgagattttggtttctaatgccaacctccaaccaaaagaaccagagctttcttggagaaatggccaatttgcccatggactagggcaggaaacatacaaaatgagccaggaacctcttgtggtgccagaaagtaagaacgtgataaaaattaataacctcacaatgatgggggtgtgtcaaaggaacacagaagccaacttttaacaataaagtaacattggattataactgtgagtataaaataaatatccatgagtccatatttctataaatacatgattgaacacacaagtaaataaatagtaaagaagggacaaatctcccaagggaaaaaattccaaatactttatgtagatactccgccctcagggaagaggaacatgattccccactccttaagtggaggctgcacatagtgacttccttccaaagaatacaatataggaaggtgggcaggtagaacttcacagtagagaaaactgccaatcactccctcagtgatcacctggctaggtgatcaagtcaacatcaacagtgatgccttactgatagtatgtccccctgatgtgatgagataagaacagtcttggccgagcgcggcagctcatgcctataatcccagcactttgggaggccaaggcaggtggatcatgaggtcaggagatggagatcatcctggccaacatggtgaaacccggcctctactaaaaatacaaaaaaaaaaaaaaaattcagccaggagtggtggcatgagcgtgtagtcccagctactcaggaggctgaggcaggagaaccgtttgaacccgggaggcagagactgcagtgagccgagatcacgccactgcactccagcctgggcgacagagcgagactctgtctcaaaaaaaataaataaataatggtctttacctctctggtcttcttcctccaaatccagtctaatcatgagaaaaacatcagagaaatcctaatagaggggcaccctacgtaacactgaccagtactgctcaacactgtcgaggtcatacgaagtgaggaaagtctatgaaaaagccacaactgtgaggagcctaaggcaacatggcgacgaaacgtgatgtggggttggatggtatcctgggagagacaaaaaacattaggtaaaaactaaggaaatatgaataaccatggactttacataatcataatgtagcgatattggctcattcattttaacaaatgcaccatagtaatgtaagatgttacaaacaaagaaactgggaattctttacactatcttggcaatttttctgttcatataaaactattctaaaggatgaactttatttaaaaatccaaatggcaatcacaacgcataaatatcacagccaaccacaccccaccccacagtaagttgcttttataaaccaacagctgctggttgctgcagaatccccagggccaggctcaggggctgtgtccccactatacccagggcaagcccctgagctgccactgccagggattcaatcccccacccaaattaatttacatgtggtgtgagttttacactgacggaatgagggcttaatgtttgcttggtgtaaaactgatgtatggaggaataattttagagcatgacttttagaaggaccaaagagggcagcttctcaatcggcagcaggtggcacgaggatcaatagctgacgtctgtgccgctggacagcaggcccgccgggaggagggaaaagcacaatggacacacatgaaggacccagtgaggactgagtgatgggctggggacacctctcatactaccctgtcatgaaggccacagtgcaacacaggagatggggaggtcaggtcagaacacctgtccggggcctctcgatgggcactaggaatctgagacgagtccttggcactgatgctcaaaacatctttcatacctccagaaattgactctcctaatccagtttcgagcaggagggactcatctatctatgtgcaactgacagaattagagggttcccttgtgacatctaaacatccccatgaactgagcatactgtatgaacactggtgcaccgatattcagcaatgacagcatgatcgttaatccaccaaccaaaaatgcaagctgagcggctgggaagacaagtcacttgcccttgcaggctccgtcttctcaccccaacaattctacttaagtaaagaaaataaagcacaaaagctttgaaaccacggctgatagtgcaggctcctcaggggaaaggcaggcacccgacagaccaagaatctggtttccacacccatcacacctgcagcactgattcaccagtgcagctgaggtgatggaagcagggaaagtctaaggggagggacaccgaatcatccccaaaaccacaacagaattttctctgtgaacctctccaacactgtcagcctgattcttctgccaggattaactgaatataaacacctaaagcataaataatccgtgtcaataatttaggtgtacagtaagataaagtgcactgctcaataggcaaaactacagacaaaagaaaatatactttaataaaatttacactagtaccagctaaacaagaggtcgaagaaagttgttaaatttctcatcgcatcctcaaagatataacaaagttaaacaggaaattacaaaaagaaggtggttttaaaattcagcaaaaaaaaagatgaaatcatcgtgaccccagtgtaactctatagccatagctttacatgtaaacactggatttaaaatgcaaaatctgtggttactttagaccactgagactcaattatttatgctgattatttataggtagcttctaatggaagttgattattgaatattttcaaagagaaaaaaaaaggaataaattctcatttcgctaaaaagctttgagtttttttcctgaagggaagaaaatagattaggtggtgtcctgagttcctctgcagcctggggtgctggcatgaataaataaccgtggtaagaagcaagcatgctagcagccaagccacagacaatagtgcccaatgcatcgcccatcttcagaaacgaaacatgttgcataagacattttcctaaaaacttcatacttggagccgggtggggtggctcatgcctgtaatcccagcactttcggaggccaaggcgggcagatcacctgaggttggaagttcaagatgagcctgaccaacatggagaaaacctgtctctagtaaaaatacaaaattagctgggtgtggtggtgggcgcctgtaatcccagctactcgggaggctgaggcagcagaatcgcttgaacccacggggcggaggttgcagtgagccgagatggcgccattgcactccagcctgggtaacaaaagcgaaactccatctcaaaaaaaaaaaaaaaaaaaccctttatactcggactttaagcatgagtctttctaaagtgcattctaattagagcacatggggctagataggggtgactggcagaaactggggaggtccgaaaatgcccccctcagagaactgacctaagaaagcagctagagcctgaggagacccactggaggtcacatagagtgaagtgacatgaagaaatggctatggacacagtcctgggaaaccagggagaggccagagaggggtcacagtctgtctttagagcagaactagaattaacatcaaacgccaccataagcagaaaatagaagctgatgccacctctgacctctgagctgagaaaagtgagtccatacagggctcatgaaggccttagaagggcctgcagagaagacaggagcactgtgcccaggaggcagcctggccagcagtccagagacatccagcaccccccgccccacttgacacaggcgcatcagggtgagcacctgtgatgagaatacccactccctgtgcacacagtacctgcatggccctcccgggcacccggctttggggggacacgtgggcagcgagctacacacagaccctatccctccagcaggatcccccttcctcatttgcattccatttagtgataagattttccccatagccttatccattttctcttactccccaaggaaaaataatcagaattattagttttggtggttatcctatgttatggggtgaatctgtccttcccccaaaattcacagaaattcctaacctccaatacctgagactgtgaccttattggaaataggttcactgcagatgctattgactaagatgaggtcatatgacagtaggggaggcccgcggtccaatctgactgtgtccttaggaaaagggggatttgaacaccgagacatgaacacgaggagaacgccatgtgaataggaggcagagacggggtgatgcatctacaagccaaggaacgtcacgtcacggattaccagcaaatcacaggaagctaggagggagacctggaacagattttccctcagggcctcgagaagaaatccacgctgccaacaccttgatctctgctttccagtctgcagaactgtgaaggaataaatttctgttgcttaagccaccttgtctatcgtactttgttatgggagcccaaggataggaatccagcctgtaatgtgaacttcagttttacagagatgttccagcaacttccccgggacatgataacccagaaaacaagtgaagaaggtcccgggggatcctgctgttgtcacacttcaaggtccctgtgcctgactcatgggaacccccaggccttccatcggagactacgcgactcttactagaagctcaggaaggtacacaacccagggcaggcagaacactttatctctaatgagcagcaagcagggctttcaaggcagttaagaatttcctagctgttttcttcctcatcgcaatcaattctgaaaggcatgttttcatagttcgaggattctaagggctacgatgaaagtctctgctattaggttaaacatttgaacaacatattaaatattcaaatagaacattaggttgaactttgactgagcgtattaaaatactttaaggttaacactgaaaaggaactttttgtagtaaattaaaggtggcttctcctcctgaaggaaagtggagtctaattcctagcctctcgcacaccggccggcctgtgacttgcgtgatccagcgaatgtgacagaggtgacactctgggacacgggaggctgagttgtaagaagcctcttggagcctcttagaatgctggctctggcagaagccagacactatgtagcaagtatcactcacgtggtgaggaagcccaggtacccacatggagacgccatctgaagacagaaaggtgtctggccagccctggctgctctgtctatcccagccaggcatgtgagtaaaggaacctttttggacattccatcgcagcagaaatgacatgcagaagacccagggaacccagccaacagtgggaaccaagatcccaaacgtatggccccagcacagctgccccggccatctccagccatcagtgagggttctagtcactggtctgtctctgggtcatcctgctaaattcctcactcacagaatcatgaaaagtggttgcttagtgccactatattttggggtggtttattgtgcagccatagataactggagcacacttttctgtgaagtattttctttccagactcgaacagttagatgggtttatccggaggctacggtgtaattgaaattccattaaagatgctttttaacaagtaagcaggactaatgtatcttcccactgcaaaggcctgcactatctttgccaaaccacatcatactctgtgaagtcatccagtacaacacgtaccccaagttcatactctttaacagctctctgaatcaaatggagacttagtcagggtgaacagtgtcactgcaacgcttgcaagcaaagtaggattcaaccccacagcagaggtcagaaatgccaataaaaatgaccttctggggtcatttatgggtttcacagctctgatttcaagaggtaccagatatgccaaagaaaatgtggccaaagacctggaaatacgggctcttctgattcagtagggccaggggtcgctgccccagccagaggtcagccaccttggggtcagccaccctggcactgcccagctaagacagtccccacagaacctgagagctggctctccattgtgtctctccagagaaacagccccaacttctgttggttgtctgtacagacttcaaaggaaaaatatcttcctcctatctcatgaaaacattccttgctggggctggacgcagtggctcacacctgtaatcccagcactttgggaggccgaggcgggtggatcacaacgtcaggagattgagaccatcctggctaacacggtgaaaccccatctctactaaacatacaaaaaaattagccgggcctggtgtcgggcgcctgtagtcccagctgctcaagaggctgaggcaggagaatggcatgaacccgggaggtggagcttgcagtgagccgagatcacgccactgcaatccagcctgggcgacagagcgagactccgtctcaaaaaaaaaaaaaaaaaaaaattccttgctgggacataaacccttttcctatcgtcatacttgtccaaactgtgagttcacagccaatgataattggatgcgtggcctctgctgggtagataacctatgccaaactgttttcaaatagacagaaaaccaacattaatatggtttgttgttgttgttttgagacagagtctcactctgtcacccaggctggagtgcagtggcgtgatcacagctcactgcagccttgatctcccaggctcaaacaaccctcccaccttgcctcccaagcagctgggactataggcacacaccaccacattcagctaaattttatttttttagtagagacaaggtctcactatgttgcccaggctggcctgaaactcatgagctcatgtgatcctcctgcctcagcctcccaaactcctggaattacagatgtgagccaccgcgcccagccttagtatgttttaaaagtcaaaagaaaacagtgtactaacagtgacctgaatctgcctgcacttggaggctcaccgttttcacgtgctcacgtatgccatctcctttaagcctcaggtcaagtccatgtcatgctcatttcagcaaaaatgtcaggcagctctccctggcccacagctggctcctggtagggcagtcaaagtcagatctaccagatgccagcacccatgagaaaaggatctggatggtgccaacctaataccccctccatccccagccaccagcagcgccgaggtccttccgtccatgctgtgtgcatggcttttctcatcccctctctgaccccagcagctgggtgagcatcttacagatctccttcccagatcccgtgcaaaatggccagaattctaggtctcaggctgttcatttgtttgatgtgaagttagacttagttaccttggtgttaggagagaacagtgtttaaattatgtgtggcaaggaaaattaatttgagattatgaattccctgcagcgttcaaagagtatcatggagcttaagagcaagttggctgggtctcagtttattgacctggaggaatgtggaaatgctaagggaaagcatggagctgaagagtgctgtgcggactgtcaatccatttccatctgaaatcacactggaaaacagaaaagcctacctatggatctgtgtgggggcatggagaacagtgtgggtggagatgcaaaaagctccacctcagagagctgggagggaagcggagtcagggagggctgcctgcctttttctgtagacattcccctactgattgactggtgacagtgagattttatcacgtttgtaatttccagaaggggaaggcacaatgactggttacagtgagattgtattacatttgtaatttacagaaagggaaacacacaaactgcaagagaaatagatccctagagagcgtggtccaagaaggctgtgtccacatttccacattccctgtggctgaatgcccagactttgagatcaaccccatcaggaagaaagttaaagacagaggctaatcagagtttggcaatgctgagagcttccacgtgccaggtcctgcctgggctctttacctatattacgtcattcagttttcacaacttccccatgaggtgtcatccatgttacaggtgagaaactgaggcacagagacagtagcaatttccctatgatcctaaagtgatcagaggtacagctgggattcccatccaggcatcccaaagcctgagctctctatgttgtgacacttcatagttgtgttgacttttatcaaatcattcaacctctttgagggtcatttttcttatctgtcaaatgaaggtgacaacaacaccttctttttgcaaagattcctttgcaaaaaggaatcttacatatctttatcatatgtatctatatcatcatacatgtacgtatatcatctcgcccagtgcctgcagacaggagactgcagagctatgtgcccaaccaacctcacagggagggcacttttgagtgtgggcaaggtgccatcaaatccactgataagggacagtttagggagtgaggagtgcatgtcccacagcccctctgcatataaggagtgaagaggagggtggtgatgaggtaggacaagggttggaataggagatgagactaagaaaccaggcagctcaggaggctgaggcaggagaatcacttgaacccgggaggcagagcttgcagtgagccaagatcgcgccactgcactccagcctgggtaacagagcgagactccatctcaaaaaaaaaaaaaaaagaaaagaaaaaaaagaaaccaggcaggcacagatggccacgtggagaggtcagcccctgagagggctctggaccacagcctgaacaaagagcacggatgcaggcagctgccttggaggacacagaggatgtctctttgtgtcgcctccatagggcactggtgtctggaagagctcctcggccagccatcacttagatggctggctgactgggttaactttccacccactccctcctccaaccacccagcttgatgttccttcaatacctcttcaacactcatgaggagggacgggagtaaactggttttcttttaataaaaaatattatgcctttctttttaattgcaaagtaaggtttttaaaaataccatttccaaataaaacggttgtgggaggcatagtaaacatttaaaatttacatcatacaatgaattattgattcccagcaaataatactccccactcagtttcagattttcagctgaatgtagcagggcccgagagcctgtgccaggcccagtcctctacatcagggaccagggaacacttggatggggtggggttttatgtgtctctccactgccctcaaaggcactgccaatctcagcaacaggaaggtgctgactcctgactcaccagctctactgcaagtccatcacctgcaaaacctcagtgatttggtccagtgatgtgctactgcccagcactagtggagttggcacgagatagggcccctggcagctgcccagcggcccacccctccattcggctttgatgccatgggagagggctggggccagtgacagtcaagacccatgggcccaggccttcagagtggctcttagcataagggagaagggggtcaaataagggagaaacagcagggaaaattgaaaagacattctaatggctagtggggtggagatggaacaggtaaccaggtctttctggggacagacaggcatgatatgagagatccatccaaggatccgtgtttaactgggacaggtgtgcagcttcgggatgtggggatgaactgtgaagtgaagacagaaagaaaattcgtgcgctgtaacaggctcagtgctctctctaccatatgtcaccataatatttcaatcattagatctgaactaaatacagatttaatttaccaaataacgttttaatgacaacagcagtggcccccagcagcactccaatttacgtacaacttcgagataaattacatcgtttgacttgcgagaaagatgtctaattaggaagatttccagatataaagaactgtcactgtaaggcatgtcatctcatcactctaaagtcactcattaacatatgaaaacattcccgtttaataaactgcttatgtcaaacgaggtcctgaagatgggacgtgggtgaaggtgctgcccagtaggcggctcaactgattcatcacctgatgttatcggccatggccatccctccgccttcagatggagtcgccagatagatatttttgccatacaaggttcttatttcattttatcgtattctgattttctagctgggtatatttcagaattagtatttgtgttaggataagacactaagattctcttgaagcactggtgttttacacagtttatcttaaaggctgcttccaagttgctgcaagataaaactgacttaaggagtctgtcaattagatgcaaccatggtaaccagagaaaactgcaaaatggccataattctgcaactttgccccaaatgaggacaaaaccaccctgtatccaatacaatacatatactgggttttgtagtggcatgaagaaatgccttctgaagttggcccagtttaggaggtatcaggaacgacatctcagtgggtttttgcaggaagaataggagtttgctgataaatttcatgcttcctctgtagacaatggggaagcatcagaggggacgtagcagggtgttgaagtgacaagttctacagcagggagggtggatttggagcagggcagggatgaacagagggccagtgcaggggaggggaccactcagaagaatgctacattcctttcagaccaaatgtgtttgcagcctcactgggaatgctgggttagaccctacaccaaaaactacctggaacaagagctgttctaataatgctaagcatatgtgaaactgtgatgattctaatattggaactttttattttaacagaaaaccaattatcgtaggaagcttctaccatctctcatccaacagtgttagcatgactgttactaatacattgaaaaaataaaaatagataatggagatctggcaaggtggccgaggaaatcacatgtatgagagatgggtggatgaaaaagtcccaaaccccttcaagaagcatccgtgccatttcaagctttccagaacttcagagtcatggactgtctactcctgtttctctgtatcctccccccaaccccagttttaatttccattctattttccctttatccatttactatttcacttatttatgactcaaatatgccaggccccatgggagagctgggacacacagtgaactaactggagccagcaccatctcacactatcactcccgccttccagtgaaggagagaaccaataaccacagggctggttagggaagtacaactgtgccacatactcccaaggagaggccaggtgcctctgaaggcttatagagtagacatgtcctgcccatcacaccttcgtcgtttgtgtcagagctacaactaaaatctagaattcctaatttccaccctactcactctgcctcattcatttttcggtttattcatttgctcattcatttgcttatacctttgttcactgcccattcattctttcaacattcgatcagttattcatccattaattactcacagggcaggccctcttgtctcagctcagctacaaggcacagaggcataacaaggctaatgaacactcacgggtcataaccagggtgctacgggcacattggccagtgaaagctgaactggtctgggcagctcgatgaaggctctgcagaagtggccctgacaagtgctagtgaatcactccacaacatgcaaacctgatcactaacataatatgcaacacacgctcacatgttccaggtgccgcgcagacaggacccctgccccttgaaagtcagagtcaaaagggggagtggcgaggaagcaaaggctgcatcttgtgtcaagcgccgtggaagggaatagtgaagtactcccgggtcttgggggccttctataaagaaggtggtagcatctgggcctggagcctgcaggaaaagaaccgggagaagcaccttacaagcacggagagaaaccgtggaaagttacagaaactgtcaggaggcccgtggcgctggactacaggatattgtcagatgaagtcagcagcttgagcaaagcattgcaggtggaggaaaatttttttaattttttcctatatgtgtcaagaagccactgaaagctttcagacgactttttattgacagaatcctatttacatctttaaagaagtatactggttggaccctcaagcccatagaggggtaatgttgcaagtagaaaagaccaccccttgctctaagtgatgaggcagattccaacccttggccaggccgccatgcagggcagaaggtgccctgattctggctgctgcagaagttgggggatggcaattgaaaccaaagaggtggccatacagatggcgatgaggggacggactgcaggtaacttttgaaggaacagctggtgggatttgtatgtgtatgggcagggaggtgagggaaagggactgctgtgcgttccatgcatcttgattccattatctttgtggccctaatgcaagctttcagctctataggaatgcgaaacaactgcagatttcccatcgggcacatgccagagataagtgcttcccagagattcttggttgttctcagtcttctgcatcacatgccatagtgcgacgaagtctcccttccgatgtacaggtctctctgcaggatcaaattccagaaccgggattcctgagtcaaagcgtgaattaacctataattgtcttaattctgaaaaattatcctcctggggctggttgggggggcattttacactcctcttagcaaaatgtgaaaaggtctgtttcaccccagcctcagtgaaagattatgttctccagcttgtgggtttttgcctgacatggcaggtgacatacaatatcttactgttgttttaattgtaatttctgttaccacgaggttcacagtgttttcatgtgattaggccatttctgtgagctctctgaccccgcccatttttcttttggatatttgtggtctttttcttataaacttctagaatgcaggaactattcacgatctgaattagaaatatttctcccagtttggtactttgcttctaagtttgcatactttcttagaaattttattttatttatttagccacgtaaaagtttttgctttgatatggtcacatttatcaaaatttgatagctgcaaagaatactatatgagctggtaaaaaggaatggggggggtggttcttcggtccagatttagaaagatctccaaatgcattgtgaagtggaaaaagcgaaggtacatattctacccctttttctctgagaaagagaatgtgggcacgtatgttcttatttgtttatattttcataaaggaagtatgataggttattttatatgtcagcttggccaagctatggtgcctggtcatttggttaaacactagtctagatgttgctgtggctgtccttttagatgtaattcatatctacaataaatagactcagttaagcagattaccctccatactgcggggggcctcatccaatcagtcaaaggccctcagagcaaagactgaggttccccaagtagaaggaattcctttcaagactgtgacatagaaagcccagctgagtttccagcctgcagaattcagactcacaaatgaaacctcaacacctacctaacctccagcctccctgctgccctacagatttcaggcctgccagcccccacaatcaggtgagtccattcctttaaaaaaaaaaccaggcgctctctctctctttctctctctttctctctccctctctgtctcttcctctcattggttctgttactctggagaaccctgattaacacgggaacacttggaggattccacaaaaaatgagtacagtaactgtgtgtgggaaggatgagggaggggtggtaatgggaattctcagtttaggccttgttatagttagaaactttaagccgtgtaaatatctcacctactcaaaacagaaagtaaaatttggggcaaaatcaacttttaggtataaaataaaataaatgctctataaattaagcaataaaggttatttgttttatagaaatttaagatacaaaaaaagagaattatccaggtttatccaaaagatgaactgctcaggaagaagacaatttttaaaagcactgagatgcaattcttttaaacatgaacctatataccatatttaaatccatataatattctacaaatctggtgtatcctccaagcatttgatacaaggtttaactctcaccaactcttccactcctgaccccaccaggtgggcaaacataacttgtggcaatctgcaaagaggccaggccacgacctgggctggagtggccagcctgtggctggggagactttccagggaacaggtgccacctccccaaaacgcttcacgctgcgtgcaaggattcagagatgtccagggtaaaccaacactttttaagccaaatctaaatgtttaataaaaactaagaatgatgcataacaagagcttcatcctggaagtacacaccattttacaggaaactcaaaccctaaacatatgtaatcttgtttgtagcagggaacttcctccctgctagattgaagaaaagtattaccatctgggacacattcctctcaccctcagaagaaggggctttatagaagggtctttacttttattagcagcaccctgctatgcacctgctgatgttcataacacatggggctttctgggccactccagtgactgctgagctggcacctgatgacatttcttcaagtaagttgccttagttgacccagctactgctccacaccagaggtggagtggggaggagtgtcctctggtggaaggtcagtgccacagagaaacactgggcactcagactgcattcggtcctgggacagacagcgtgtccccaagcatccacagtgcagcgtccacagagaggcctgactcccaggggctgacagaggcagaggacagagctatttattgaaatgaggagtgccctgctaaaagaaactgcatgcatagcattatagagccaggtaaactcatggtgaggagtctgtgttttggattaaacacgcacgcgcgcagacacacacacacacacacacacacacacacacacacacacgtctgtgtttaatcccagctctattacataactttctggaggttgtttccctttgccaaggctgcctttccctacattaagtgggaacaatataatcccaccataaagaactgtcatgaaatccgaacgcaatgatgaccactaaggctacaagtgcccgtaccgtaggtagtaagtgcttactaaatgctggctcctcctccgtaactgatgggaatattaggagacatataggtctttggatagttcttgaaagctgtctctagaggctgtatttggaaacatatcacatggatcatctcttgaatgaagttcctcgtgacccttaggcctttcaggagtaatgccagggtccttcctgtgagcagctcagccgagtggggctagcggggagcagagatggggctgggacagagcacaagcacagccctggggtggggtagacagggatgctgggcaagcacaccccacctccgctccccgccaaggctgtctgctttctgcaccaaggccccttctacccctgcaagcccacctggccccctgcacacaggagagttgatgcccccagaggaaacaattagggggaatgggaacaaggccccgcatgccctcttcagggggacagttctgggacattctgtacggctccaggcaccccccaggctcacagtggcagccctgataacaccccccagggattccttctcctgccccacatcccccccagctcctcacacctgcttccttgtcctgggctctgcttctgggctaaaaacaaccccagcggggagagctgttaggaatgcaaagaggagaccaaggacttgaggcccctcctatcacctcatttacatccccaggagtgcaggccacactgcccatcaaaagcacgtccccgtgaggcaagatgatgatgatcgcagcggacatttattacctgccagacaccaacctaagcaccttattattaactattttaattctcacaccaattccacaaattactatgagtttgttttccaaaagaggaaactggggcacagagaagctaactttctgaggctgcccagctggtgagcagcagagccaagcatcccgctcggcgaacgagctccagagcccatgcactcaaaggcagaagctgcgctgcacaacgacgccaagaagagaacctggagggtccaggctggcagaaatcagggagggcaagggcaaggaggaagccaaaagctaagaacaaagtcagacaaacgccgaggcagaagccagggaagcagagcatgtcaccaattactggggacatgctctgagagagagggtttgagaactgccactcaccggccggggactgcttgttctaaaggtgcctcaggctgaaatccagctgggcctgtgctccaagccaggagtcctggcacaaaaacacggatctttgctctttctgtccgcagggcctgggatctcagccccaccccaagacagtagaagagaagggacccaggcaggggctgtggtcagtgtagagcctctggtttactagggaagtcaagcctgctggttcccattttctccataaattactcccattaaagtcaaatatccacattaactaaatttttgatatttcacagaatggttccacaaaaagagtactttcatttagctttaaacagccctttctgctgacatccaaattcgtatttcacttccctctcatctttaattaaagcttattatcctctgtgtaaaccaagaagatttatgacattatttagtgagttttctttttttaaattataaataacagtaaacttcagaaaatgctccaatttcacagttatttgttttcaagatttttggccacacactaaagctaaagctaacctccaaaaggcgcaagtcacatcttaaatgaaagctctgatcaaatctagtcctccccagcttctctgggcataaattggaattttaagccataggccaagagttaaaactatagcttctgatttgcttccaatgcgatctgtaactagttattcatggtccaaagaaaagtttggattcatgtcagaaccgcctcatacacacagccatctgaaaagtcccagagaagccctgtttaaatgcaatccaaactgatcctgccatgtttcttctaaaagaaggaaccatttcctgtctcgtgtatggtttcttttcctttctttctttcttttttgagacaagatcttgctttgtcacccaggctagagtgcagcttcaccattatagctcactgtcttgactcatgcagtccttctgcctcagcctcctgaatagctgggactataggcccatgccattgtgcctggctaattttattttattttattttttatagagacaaggtctcgctgtgttgcccaggctggtctccaactcctggcctcgagcaatcctcccaccgcagactcccaaaaagcttggaattacaggtgtcagccaccacgctgagcctatggcatcttaatttttaaatttttcatctcttttcactattttttctacaggagatcattatttcatttaatatagatacccatagtcacaaagagacttaggacttcagaatcagaaaacaaatcaaaaaaatacaatgtcctactacaagaaaatagtttttaccttaaaaaccatggagaaaggaaagtgctaggaaacgatggaccaaagtgattgtgattgaaaagaagataaggggcaactggaacaaagcattcacatgaagtccgtcagcacctagaagggctcatcaggagtctacgcaggctcgccaacacagcagcaactgcaacactcactgctcttttactgacaggatcaaggcatgtagacacggtatctgcgaggcagaggtcaattcagatttttaatttctctcctgcagcccagagccttgtattgggagaccaaacttccattcactgtcatggcattctggagggcacagagagtcaggtgtaacaaatatagaggggcaccatctgggatgggtggggagtattgtcagattctgcgtcagggtgcaaggggtgggcgagcttaccagagtgaggggaaatctataaggaatacatgtccaaccttgcactagagtttgaaaaaacatcaacttttaagtgctgaatcctgaatgcatttattgagtccaaaaatatctgtgtatgtcttcaatgtgtcaggcactgttctcagtttgggcatgcggcagtgaataaaactgtcaagtaaatttcacacagtgagagggcaagaggcttgatacatcatatagggtattagaaggtggtaagtgggggaaatggaaacagggggaggtctaggacagggagcagcaatgttgaacgggtctggcctcactgaaatgtcaacagaacgagaagagggccgcagggctgcagctacgtgaggaacaatgttcccgactcagggagcagtgtggaggcgtgtggctggagctgagctggagaggagaatccaggaagaccggctcgggagtgggaggggtggttgcagatggaggagttggcttttagcctgagagaatgtggagtcttcggagcatttccattacaggagtgacaggatttggaatgagctttgaaaggttcgcaaaagtagctctgaagaagtggggttatgtggcttctgcaatgtgacccgcgatttggcacaaccttgagaactccagccccagtaggaaaatggccaaaggccataaagaagtcacacaagaattcacagaagaatattttcagccccatggtgtcatatgagtaaaaccacacagttccatttcagcaccaggtgggaacctgtctcctataagttaagcggtataaatgaaaatttaatcatgattttccctttcatagaattgtggcctaacttctgaattctgataaaataacttaacattggccaacaagatcactcagcatctgagacctaatttgataaccataactcaaatatctcatcaactgaagttgcaattaacaaaaagtccagttggcagagcagggcctggatgatgaacgattcacagctgatctggggctgccgcctctacggcggtgtcttctttccagaccccccgaaagttcacagactgtcacacatgcacacaactcccgtggccctgcaaaaccagctcccatcaggaaacatgtgggctccttcctgcatggtacagtgaaaagcaaaatcctaacgtacttactcgcattaaaaaaaataaaatgagaagactcagttttatgtctacacaactgcaaaaacaaaacaaaagtcagagatgtgaactccagattgttaacatatctgctgaaacaaacagaacagtttaatcaggaatgtgtacaagctatattgcatacaaattggcatcaatcatgaataaatgaattttggctttttgcatctcatgtatgggacttatttacatggcatactggcaaactggaatgtaaactaacaatataaatgatattgcaatttaggagcatccccaagctgccagaaataggaagaaggcagtgttttggtttcctacagtatggaaaacttatagtgataacccaactaattcatagcaagggggagaagacagcacactaacctttaataaattaataggattgggaggctaaggcaggtggattacctgagctcaggagttcgagaccagcctgggcaacacagtgaaaccccgtctccactaaaatacaaaaaattagcctggcgtggaggcgcgtacctgtagtcccagctacttgggaggctgaggcaggagaattgcttgaacccaggaggcagaggttgcagtgagctgagatagcaccactctgcactccagcgtgggtgacagagcgagactctgtctcaaaataaattaaataaataaaaataataattaattgattaattaattaattggagctgttttcccttttctgcaggtactgaaaaccatcttatgcctgcctataggcatctccatttaagggcttcccacaccctgaaatacaaacactaccaaccaagctataaattatattgctttctactcctgtttctactagctatttctttaaaatttgctaaaatctgcctacaaaactatctaaacttggtgtctattaagaaatagggggatttttcaactctaatttgagttctttaataactatttctgtttgggttttctatttcttcttaagtttggctatattatttataaattaagccatctcatctaaatcttcaaatatattggcataaggttgctgattatcatgtctgaaatctcttgtttatattattttcctttcatatttctccattattcatgtttcttctcttttattgtaatcaataacaggtgtatgtacttataactcttttcaaagaatttttgattgcctctattgcttcttggatatccatttcgttacttttcctttaatcttacttattctttttgtgaatgtatgcatttactttgattaagaatttcaaacagaaatttaagtttatctctggtgtttgtgaaatgtgaaaagtaactgaaaactgcaaaaacaaacaaaaactcctaaagctcccaccaaaagttttgcaataattattaatatttcataagagagggtgggtatggtggctcacgcctgtaatctcagcactttgggaggccgagttgggtggattacctgaggtcaggagtttgagaccagcctagccaacatggtgaaaccctgtctatactaaaaatacaaaaattagctgggcatggtggcgtgcgcctgtaatgccagctacttgggaggctgaggcagggcaatcgcttgacccaggaggcagaggctgcagtgagccaagatcacgccactgcactccagcctgagcaagagtgagactccgtctaaaataaataaataaatatatatataatacacatacatttatacatttcataagagataagagaacacatcaatgcagtcacaagtcacttaatgacaaagatacaatctgagaaatgtgtcattctgagcaatgcaaatggtaacttcatcattgtgcaaacctcagagagtgcactcgcactaacctagatggcatagcctactatacatgcctaggctatatggtgtagcctattgctcctgggctacaaacctgcacagcatgtactgtactaaacactgtaggcaactgtaatgcaatggtaagtatttgtgtatctaagcatatctaaacatagacaaagtgcataaaatgtgatacaataccactgtcctatatgtggtctgtcatcgatggaccattatagacatcattatgcagcacaaaactgtattttattcattccacagatgacatgggagtcttcttatttttgtaatcaataataacaggtgtgtgatcaataataacaggaggagtgatatgctaattaggaactaaggatgtgcaagataaatgtttatactccaagaatgaaacagaaacgaaaaattaaaagtaataacaataagatgattaacaatatcaatagcaactaacagtagtttcttggttacttatcacatgctaggtaatgttctaactatttcatatgaaatttatttattttattttattttgagacagggtctcactctgtcatccaggctggagtgcagtcattgcaatcatagctcactgcagcctcaaactcctgggctcaagcaatcctcccatctcagcctcccaagttgctggcactacaggcacatgccaccacacacagcttttttattttttttttggtagagatggggtagggggtttcactttgttgccaactcttggtctcaagctatcctcctacctccacctcccaaagcactgggattacatgcacgagccaccacgtccaactaattttactttctgtagacagggtcttgctatgttgcccaggcaacaatgtagtggcacaatcataactaactataaccttgaactcctggactcaagcgatcctcccacctcagcctcctgagtagctgtgactacaggtgtgtgcaaccataccgggctaatttttaaattttttgtagtgatgtggtctcactatgttgctcgggctggactctaactcctggcttcaagcaatcctcctgccttggcctcccaaagcactgggattacaggtgtgagccactgcacctggcttcataggaaatttaatcctcaaaagatcccatatagaatgatggaggttaacactgttctccccactttacagatgaaatccccaggaatgaaggcggtgagagctagcaagtgggtggtgtataaggcaaatcattattaatagccacaagcacattacacagagtcttagttttaacttcaatggaagttttattgtttttgacagttgccaaagcagatcagatactgtgattaggtacacggtttcttcctgcttatgaaattacattctgaagcccttcggtctcattccccggctgcctccactctttcttgtaaccgctcgcctgtcacctgtctgatgtgcatcaccagctcattcatcacctggcagatttactaactcactcatcatgcagacactgatgagcctgtccttccgcattcatccccacaccctggctgccgctcactctgacataccgccgcctgtcactgtttgccagccaaaccgatacttttcttaggagctgctattagctcatttgtcagattattttattcctttttgcttatcaacttcccttcagacatcttttagaattttttcttcttgttctcctctgccaaccacttggctcatttgcttatcacctgatattattcacccctcatcattcgacagcttttcagattctattagtcaacatacataatgtgagttctatctcttgtttctattaggttaaacccatacaaatcttgctctgtgccaagtgacttagaatttgcatggggatgacacttacattagagcatattcactatggcacatgaatatcagttataaaactcacattccctttcacaggtcagaaaatgtgggatagcagcagccttttaaaaggtaacacacagcggcatttttttttaatgtttaaaaatatataaataatttattctccccattgcacagaatggcaatatgttctctcctaggtgattgaaaaggtttttgtctttagtctcttatggactggtgcatttgatggggatccagaaaaaaagatgggactaagtgctgcacgcaaaagagaactggccatgaagaggacccacccgccagacaagagccctgtgtgtctgcctgggaaggagaggagctcattcctgaaggtcccacctggacgggctgtttgcttatgaatgtatgcacttaggtaggtaggtaggtaggtaaatgtgtctatgcatgtatacacataagcgtatgaatctatgtctatgggtgtgtgtatgttgcatggaagtacacatgtatgcagcaggctaacactgactgcatttactgtgtgcaagtctctgcaatatgctcccaagacacagtagctcatttagtcattacaacaacctttgcaatagaaataccaatggccacccatattcactggttctcatttgcctggctgtgttctaagccttgccaccacctgggaggtaggttctatcattttcccccatgaaataaatgaatgaactgagcctcacggggatagagttactcacccaatggaggagctcttatgatccccatgttaccagtggggagactgaggcacagagaagttcagaaagtcacttgaggccatacagtaagaaatagagtctgtacccttaagcacatcacactacttcccagtagagaaagatcaccttctgtgatgcttaattttacgagccaacttgacagggctaagaggtacccagagagctggttgagcatcatttctgggtatgtgtgtcagggtgtctccagaagaggctaggatttgaatctgtagactggagtagagaagatcaccctcaccaatgtgggtgcacctcatccagtccactgagggcccacatagaacaaaaaggcagaggaagggcgccgtctctctccccttgagctggaacatccatcttctgtccttggccatcagagcttctgcttctcccaccttcagactccaggacttaacaccagcagctccacccctcctcctgttctcaggccttcgggctctggctgaagcacaccaccagccttccagggtctccagcctggagatggcagattgtgggacttcttggccttcacaagtgcatgaacctattcccatgatcaatgtcctgtataccccattggttctgtttctctggagagtcctcctaatacactttccttttaagaatgtataaaaagacatacatatgtgtacacacattcacagctcaattaagacccttctatcatgagagaatggagacacgttctaagacactaggggatcgggggtgggagagggcctggctccaaaatagatattttgatgaaaccagagtaaattcttagaaattttctgagtctcacggtgataaacagacactgtctctatgaaacacgcacaagtttcaatgatagaaaaggaagagatgagaatagctagcgaccagaaggaaacacaccaagagaaaaggagactgccccaaaacagaaagagagactggaccagttaaaactctgcactggaaatagttaagaccaggccagatactgcaaaaaaagaaaaaactggtaaaaatattttctgtagagcagtattttacatttcccctcattttgctagatttttctgtttgccctccagatccaccatacacctttactgctgcctggaggctgatcttgatgaggcttccctgttttccactgggttcagacttgggcagcactgaggggagactggagtgggcaaggcatggcaactggggtatttgtttcctctctgctggaaaggaccagtgcctgcattctctcaccaaaggccacccctgtctcagggtgaatcctacgaattcaggtctcactccaggccccagagccactccctccctgtgctgttaaggtccaggagccagggcagctctcagctatggctagccctgacagcctcaccatttctgcccctacctttgtaaatagtcaccccattaaactccccattacccaatttaaatatgtcatctgcttcctgctgggatactgagtatgaagtgctccaggcatcccccaggacagagcccctgtatcatgatctgttttataaaccgtggttctggacagtaatttgagtttttaaaggtcccattggcttttttttttttaagcttaaaaaccaaagatgaagtttaaatttgagaagcattcatgagaatgccaaaaaagggacagagtgatacaaataaaaaaaaaaaacctcacacttggaggatcagaagctgagatttaaatgattaataatgcatgcttccagagaagagcccagaacaaatcattctgttctcattatgtagtgaaacttacactggcttcagacctttcctcaaattgctaatgccagaaaaactgattgctcaagaattctgaatctaaccaaattactcttacattgaaagtaacagatggctactttcatttatacactgtgggaaatatatatcacccatgtccccatggtgaagagatgaatgaaaattcagaacgtaagagagctgaagtcagatagtaagcaaatgatggagagtggaatggctgagctaaataaggggtcccacgaagaggaggctttataacctgagttccctatgtaaaattaaaatgtgaagggggttttagatgcacagaataaaaaatgctaatttactcatttttccataaggaaaagatgttaaaattgactttttttgggagtatcacttacctacgaggcaatgttctctgttccaatagcgatggtggtcacccagggacttacatttgctgaagctcattgaactctattcttaaaacaagtgcatcttgttctatgtgaggatgtgaggatgagaagatttttatctttggttttggtaatttgataaatgtagggttgaggatacttttgaaaaatcaacaagatggtctagaagtgaagaagatatgaaatgtatatatatgtgtgtgtgtgtatatatatatatatatatatatatatattttttttttttttttttttttttttttgagacggagtctcgctctgtcgcccaggctggagtgcagtggcgtgatctcagctcactgcaggctctgcctcctgggttcacgccattctcccacctcgcctcccgagtagctgggaccacaggcgaccactaccacacccagctaattttttatatttttagtagagacggggtttcactgtgttagccaggatggtcttgatctcctgacctcgtgatccgcccgcctcggcctcccaaagtgctgagattacaggagtgagccaccgcgcctggcctgaaatgtattttttaaaaacatattgatatagaagttaaaaataaggtaccaaggataagtgcatgagaagatatgcaagtcctctgcagaaaaaatcttaaaactccaatgaaatactctggaaaagaccaaaacaaatggagggatatagtattccatggtcaaggccatttaggatcacacagatgttaattctccctaaaatgatacacagataaaacacaactccaataaacatcccaataagggagtctttcataaaatccaacaagctgattctcaagtctccatggtagagcaaagggccaagaaaagcccagatgcctttggagggaagagaaagctgggggcccttcctcctcacaggtatcttgttgtacaggaactaccaaagcagaccaaaggggcagaactgagtgcctagaaacagacacacagagatacagaaagtgtatttacaacaaagtgggcactgcaggtcatggtaaaaaacagattctagtgccactacaattggtcacgcataaaagaagaaaagagaattcctgtctcacagcatatacaaaatttaattccaagtagattaaaggattaaatgtgaaaagcaacacttctgattctgtaggggagaaaaaaaaagaagcaaatgtttttacaacttcgaggtagggaaggatttcttaataaaagataatcacatacatgcacagaaagtatccccagtgaaggaattaataaattaataaagataaccataagaaaaatgacatggtaagtcaaagcctcggagggggtattttcacatattccaccaagaaatcagcaccagaagatatagtataaataacttttataaattagtaagaaaaagagaaatgacacaaatgggtaaaacacacaaactcacatattacagaagaagaaacacaacataaaactggttgatctcagccaggcgtggtggctcacgcctgtaatcccagcactttgggaggccgaggcgggcagatcacaaggtcgggagatcgagaccatcctgcctaacatggtgaaacctcgtctctactaaaaaatacaaaaaaattagccgggcgtggtggcgggcgcctgtagtcccagctactcgggaggctgaggcaggagaatggcatgaacccgggaggcggagcttgcagtgagccgagatcgtgccactgcactccagcctgggcgacagagcaagagagcgagactctgaaaagaaaagaaaagaaaaaaaaaaaaaactggttgatctcattaggaacaaggagagcaccaactgggactggagatgccgtggcacactcaccagactggcaaacctctcaaggcatgccatgaagaatgcggaacacttggggcacctacatgagtacagttgctttgggaaaaccatgcgacatcatttcatcaatcacactgcccatgacccagcaatttcatgtccaagtgagtgccctggaggaacccatgcctatgtacctgaggagacgggcatttaaacattcacagcaacacaggtcacaggaacaaaatattatatacatggcccatgcagccactgaaggagaacagacaaacatattgtgatctattcacaccatggaagactgcaacaacaatcaaaataattgatgtagagctacacatgaacacgtatgaatcaacaaatatcatggtgaatgaaaaaaagcaagtaatcaaagaacataaagtgcaattccatttacacaaagttcaaaagcaaaagtaagcagtacattatttagggatgtgtacatatgtgtaaaagaatgatgaaccttgaatctctgctctgaagacaggcaggagaccagatgggaaggagcccacaggagggtcctggagtgggcagcttacacttctggtgctggttggtggggccttcaattgcctgcttcatagcaatacatgaatttcattgtacgtgtcatatatttcatgtttaataatattttattaataaatatttcctaatttaaaacagaaaagatgaaatacattttaaacataactgtcagtagaaaaaaaagctagattcctacagtctaaatatttacataaagtaaagcactctcaacgtggtatttatcagaaaaaaaaaccagaataaaagacagaagtgccgaagaaacgtgtaaaaacaagaagataaaaagagtgactgaaacaatccctaaataagtaaagagatttcataataactcaatcccttattttaaacaatttgatttctataagatatgtacctgaaagaaaatgtcagagagaaattaaagaaaaactgatgggcaaagatatcaggcacattcaaactaaaggaaagcaagcccagtgctctaatttaaacaaagccaaattcaagacaataaaacactaaattgagacaagaccactttatattattaaaagatataatctacagggaatgaacagtaatatcccaacatccaaacagagcaaaatgtgacagaaagagccgcagtgaatatgaacatgaatatggatcatgtaggaaaaagctgttatggaaaaaaactgcaaaagctaacagtagctgtgggccagggcagaacacgaaggagtgttttctaagctgtttccctgcattttccaggttttctgtaatacacatctatactcacttatcaggaaaaccataactgtaaagatctgtgttttggtgaggatatcacacgtttaagaaaggcagactcctttcttcctccaaaagtcactgctgaaagtcatgatttttaaaacttctttttttctgaaccccaagacggagtcttgctctgtcccccaggctggagcacagtggcatgatttcagctcactgcaagctccgcctcccgggttcaagcaattctcctgcctcagcctcccaagtagctgggaataggggcatgcaccaccacacccagctaatttttgtatttttagtagaggcggggtttcaccctgttggccaggatggtcttgatctcctgacctcgtgatctgcccacctcagcctcccaaggtgctgggattacaggcgtgagccactgtgctcagccagtttcaatcaattattctatctattgttgaaccacacaaactaaagagcaaaacaaatttgaaacctttgagtcttccttcccttactaatcagaatttttatattttgacaaggaaacatagatctacagcaatttgattaaatacacatgaaaatcagggtaaaataaaattgtttcaacttcatcccactatttattgtatatcataaaattattcaggaatcaaagataaggttcatgaataatattcttcattaaaagagggtggatgtttgaaagaaaatctggtaactaatagcctataaggtagaattttttaaaacctgggtacgtagagagagttcctcagaattgcatattaaattcactttcaattagtatggttcagcattttattctgatgatttatttgtatgcttggtaatactttttaaattaactgtgccacagacagacatatcacatacttcacagttataataattttttctaacgctatatctttataacggtaattgccttctttctgaaagaatacgcattttgaatctagtgacacttcatttattacttttcttatattagagctacctcagcatattagattttttcttaatgacttttttctattaggagaccatgaagaccccagggcaaaggaagtccattaggaaaggggggcattttagaggaggcaggaatttctaaggtagacatcagacaattcttgtcaagaacagactgaacacgagatcctccatttcctgtgaactatagattaattttgatatctgtacaaacaagattatgaaatttgcaatattcatcattaatacagtgaattaaattcctcacatagcaaaacatacatcaagtatgtcactgctcactgcacctcccactctcagttgacacatcaccctgcacagctcctccctggacaactccagctgaccagagtacctgcttataccacgtggaacaggagaccgaggatcctctcaccctgacagctgccttgctctctcctggaacatagcagcaggtgattattcagtgtgggggcaaaaagagtccctatcactcctctggtctgagagccagatgctagagtatgtccaggaagcacttccgagaagctattccctggacaggctgagccgccttggggcagtcacccatctcctgaagccaggagtgctggagcacaggctgagaatgactctgaggctggagagaagactcaacaacctgttggtggctccaccacggctgtccctttctcccaaaactttctacagctcgatttactcctggacccctgcacctggtgcttttcctgcttcctggattttgtcttggttgttctgctggcctgcaaggagtctactctctgatctacccgcccaaactccacccatccaataatatttgggctgaatcccattctcactgtaagattcagtctgaatcagtcttctcctacttcaaccttagtggaagcagcatgacacaatgaaaagagcatgccctctgaaatcagacacacctagactcctccatccaagctttagcaattacccttgtattatgctacccaagtacataatccctttgaaaaggacatgctcttcaaatgcagctgtgaatacttgtcttgggccaatgtataaaaagcaccaggtaggcaccagtttcctcttatctttctaaataaaaattatatacaaaattcatttctcgatttctaacttgcagcaatttcctcccattatcttatacaactttatgtatctttaacattttattgatatttttatttccccaactcatatcataacctcacctagaacctaaacctaaataccatatcttaaccttcttagtttccaagtcattgcacggctcagggccctgtgcaatgcatttcattactgcggcacaacaggctctgagcctcatctcatggcaattctgacgaccactctgtgctcacggtgtgctgatggtgtcctttatgtatccaggacagatagaacaaggaactgctgaccaggcaggttacagaatcagcccagggttagacacttacaggtccaatggggaagcaccccaggaaacatgtaacaaagcctccattagcagcagctggacaaattcttcccctcttctggaaacatccttaagctttgctgatgcccacacctggggatactaagtggtttattgtaatcaagaaatgtatcatggtcttggggtccagctacatgcaactcacttcacagcacattaaccaacagacacggatcacaggaaaatcactccagccataaagaaacacacagactctgggactccatccagaggcacatcccagggcttctgagctcccagagacggcccccactcagtgctgttccacagaccttaccacccactcagtctctaccttcacaggaagagagtaacattacccagacagggctatgagaataactcactctttctcagaagcttctcagccagtcagaagcagcaatcagggaaaagttgattacaattgtttccaggtgaattcaagatgatgcatttaattatgatttttgagcacataattaccttattgggtatctttgtctaccttgtttttaatctttttttttttttttttttttttttgagacagagtcttgctctgtcacccaggctagaatgcagtggcgcgatctcggctcactgcaacttccgcctcccgggttcaagagattctcctgcctcagcctccagagtagctgggactagaggcacacgccgccacacccagctaattttttgtattttagtagagaaagggttttaccatgttacccaggctagtcttgaactcctgagctcaggcaatacgcccgcctcggcctcccaaagtgctaggattacaggcatgagccaccgcgtccggccccttgtttttcatctttctattctagctcgctgtcacttgcaaaaagttaagtttttatatattttcaataaaaaatgtgcctgatggattaaaagagtttatacttccaagtgaagtgacttaagcaaataaaaataattgtcatgtttcaataaaaattagtattttatcaacaactatttttaatttcacttggtcttgagtggtttccttatgttatactttagtctgtttcagtctcgtttttctggttagactatctttccctgctgatatttaatactgttagtaaatttaaaagaagcgtattagtccattttcataaacgaggtgggaggttgggatacttaagctgctttatgagcacagcaaaattctgcattgttttaaggatctgtacaaatatgttttcaccctacttccttcttttcttctgcacttaataaatgaaagcttcatctttaatgtgaccaagcaaaatacattctcttaaaaaaaaaggtcacgaccttgactgtaagaaatccccaaagtggatttataatgaattttccgaataaataatgactccaaatacatttacattaaaaatattaacctttaactcacctatatttttaatagcatataaagtgatatttgagctcaattcatggcttcgaaagaaagccttgcaggctttctataactcatattaaaggttaagatgattcataaatttttttccacagaatatggcaaacagatgactttgtagtgtgactgggactgaatttctgatgggcacagcaggaaacatttctgtaagtgcaaaaattcaaagacacttttgaaaagaagttaatatatgcagcgtaagattttaagctttcttacattgaaaaatgatcagcatagcaatgaagagagagaaataaaaaaaccactaatccaggctgaagttcattcatcacacacttccaattccttgatatctgcatgttacattaaatactgcagtggagaaaaacaaaaataagagaatccaactagaatggaaagacaatcaaagctatttttcttcaacagttgtctataagtttccaataaaattggggctatgacaagaatcgagcatttatacttatgcataaagtaagggctggtttctctaatagggctaattatcggacacctattaccaccactccggggacagcatcaatgaatcaaactccacaggactagaaatattctgactagtgtccaggataacaggagagctaccagggcttttggtgccacacacctgggtttattagggccagaattgctctccataacctaagaaccacccaaacatccgcaggataaatgcaaaaccctgggaaccctcttttttttgagagaagaaatatggaaggaaaaaaactttcctctattttgtagcttctaattaaaaggaatccatgaaagaattaattgcacctaaacgtattttactacgtcttacgttgtactgcagtaagtcttaagatgagctgcagaggggaatggattatgccttactaaggcatggaaagaggtttttttggttatattttaaggtctcaggtaaggcactgattaagagccagttggcctgggctggaaacctgcccaccacttgcctgccacacacctgccctgtgcctcagcttctcttttggctaggatgataacagagttgtctcactggggtgtcataagaagtaagtgcagcaggcatctatctgaacagggcccagcatatagcagtttcccaccacgcttgttattgtggaaggtacacagaaatggtcggatttctctgctgtgacgtccttccattcagctctcttgcggtaaaacgcttcagtctaagtgccttccttcacccagctgaaaggcagaacacttactcccgttttggataacagtgcaagctgtgagtcataactggtgtgggagacagagatagatcatgcctttccctattgttagtcatttcaaataaactgaatgtatcctggtttgggggtgatgcctttaaaaattttttttaatttaaaatttttttagttgactttatttttagaacagttttaggttcacagcaaaagttagcaaaaggtacagagagtcccatacactccctccctccccagaggcacagcctccgccactaccaccagccgccagcagagtggtgcatttgttaacaactggtgaacctacattgccacaccattatcactcagagtccatggtttacattagggtccactcttggtgttgtacattctatgggtttggagaaatgcataatgacctgtatccaccattatattatacagaatagtttcactgccctgaaaatcctctgtgttccacctcttcatccctctttcccaacctgtgacaaccacttatcttattactgcctccacagttttgccttttccagaatgtcatatggttggaactatacagtctatagccttttcagattgacttctttcacactgtattatgcaaagtttcttccatgtcttttcatggctaaatagctcatttcttttttttttttttctttttgggacagagtcttgctctgttgcccaggctggagtgcagttgtgtgaaatcggctcactgcaacctccacctcctgatttcaagagatccttccatctcagcctcccaaatagctgggattacaggtgcccgccaccatgcccagctaatttttgtatttttagtagagatgggatttcaccacattggccaggctagtctcaaactcctgacctcaagtgatccacctgcctcggctcccaaagtgctgggattacaagctcatttctttttagcactgactaatattctattgtctaatgtaccacagttacatatccattcacctagtaaagaacaaggttgcgctttttttaccccactgctctgggaatatagtttccaaaaattataaaaaaaaatacagagccgcttttagtatttctgaaggctgctctgatttgtctttgtcctttaaaagtctgcagaaaaaaaaaacaaaactgaatctaataaaggtgcttctgacatttctgcaacctaaacacgctttacttggtatcttccgtaccctcacaccagaagacgacacctttgttggttctgtttgttaaagactcagaagccagggccccagcaccacccagcaaccccccgaatcaaggtgcagcagaacccagcattcacgctgaaacacgtgtcctgtgctctgatgtagacccaaatctaacagccattgacatggactgttagatgacttccgttatcacctactgggataaaacctattttgttttggctaataaatactgttctatgtcattactattattattattttcgagatgaagtcttgctctgtcacctagtctggagtgcagtagcatgatcttgattcactgcaacctccgcctcccaggttcaagcgattctcctgcctcagcctcctgagtagctgggactacaggttcatgccaccaggcctggctaattttttgtatttttagtagagacagggtttcaccatattggccaggctggtctcaaactcctggtctcaggtgatccacccgcctcggcctcccaaactgctgggattacaggcgtgagccactgcatccgaccttcattaaatttaatgtattatttaaactaggatttttttatcagctttattgaagtataatttacataaaagaaaacccaaccatttaaaatgcacggttcctgacaaagtacagcctgataaactcatatggccatggaagcaccaccgcaattaaactacagaacattccatgtccccagagtttcccttgtgcttccctgtagccattctcttcccacaccccagcgccaggtgaccactcatctctcctccatcactagaatttcagaaaaatggaatcatacagtatgcagtcttttgtgtctggcttcttctatttagccatttgcttctgagattcacccacattacatgtatcaacaaggagaatctttttaaccccagaaatactctggctggaaagtagaaaactattcagcaaaagctactgtagaaaaacactccaagatgattaagaactgtattccacccctctcaaataagacccttgaacaacaagtgattcctattttaggacagcaaggagattgccaagtgatggatacaatgtatttattttttaaatatcttgctagctaaagacctttaaagatatttggagagagatgacatcagaaaaagtggcaaagacctaaaaattcactcctccataagaggaaaaaataactgaatgaaatggttagaatcaagttgctcataactctggaaattaaccaaaggcctgcagcaaccttggaagcatttcttcaagatgaagagctgaatctcggtaagaacagtaggatttggggcattttggcttgccctagtcccatcctccattcctcatctctacagtacccttgaaaaataaaagctcacatgcctggtgcagcctggaagccacttgagggaagggaacaaagctggatcttttccaaagtcccattcccaaataattctcatgatgtgaccattctggtgattccctagaagaccatacttacaaacctagttatatttgacctgaccctgagctcacccagtgtgaacagtcttttccctgggggtgactgtcaaatacatttgtaggcaagtgttttcactttgcagctgcctaatcagtagataatagttggggcaaacaatatattaatctaaacacttaaaaaaaatcctggggaataagatgcccatagcacttttgaaacgccccaatatatctctgggaatacagagtgccacatgcatgcatagcgctgtgcatatgcccaggaaagccctgagaaggctctaagctctcagatgacaactgccttgcagaatgtggaaggtgtgccccaagagtcacacagacccccttgtcaaagactgggagatgtactggctccaggcatttaaagaaatctctgtccaataactaggtaactcctaaactaacttggtagacaattcagtagccacacatgacaaagaataggctttacagaattcattcagaaaagtcatcaacaataaactatagtggacaagaagaatttgctttctagaggcaccacattatattagtgaaaatgcccagttttcaacaaaaaaaaaaaaagagaaatatgaagatacaagaaagcatggcccatattcaggcaaaaaaaaaaaaaaaagcaatcaatgtaagtgatccctggcctggcacagtggctcatgcctataatcccagcactttgggaggctgaagtggggagatcactcttgaggtcaggagtttgagacctgtctggctgacatggtgaaactccgtctctaccaaaaatacaaaaattagctgggcatggtggcacatgcctgtaattccagctactcaggaggctgaggcacgagaactgtttgaactctgccaggaggcaaggctgcagtgagctgagatcatggcactgcactccagcctgggcagcagattaagactccatctcaaaaaaaaaaatatatatatatatatctagctcacatatacatctcatacacacacatatatatacacacatacacacacacacatatatgacccctgagaaaggcatggtggacttagaagacaaagactttaaatcagttatttaaacgtattaaaagaactaaagcaaactgtctaaagaactaaagaaaaagatgacaatgatatctcaccaaacagaaaatattaatgaagagatagaaattataagaaccaaatagggctgggcatggttgctcatacctgtaatcccagcaatttgggagactgaggcaggaggactgcttgaggccaggagtttgagaccagcctgggcaacatagcaagatactatcattaacaaaaaaaatacacaaaaattagccaggtgtggtagcactcacctgtaatctcagctactcaggaggctgaggcaggagggagaatcccctgggcccaaaagttcaaagctgcagtgagctatgatcataccactgcactctagcctgagagacagaacaagactctgtctgaaaaaaaaaataaccaaatagaaattatagattgaaaagtacgataactcaaataaaaaactctctataggggttaaagagcagatttgagtagaccaaagaaagagtcatcagttaacctaaagataggttaattgaggttatccagcctgagcagcagaataaacaatgaagaaaaatgaacagatcctaagaagtgtgtgagccatcataaagtgtaccaaagtgcatgcaatggagtatatcaacaggagaggagagaaagtgaaaagggcagaaaatacctttgaagaaactatggccaaagacttcccaaatttgatgaaagacaacaatctacacatccaagctgaatgaaatctgagtagaataaactcaaagagatccatgcctagacatatcataaacaaactgtcaaaagccaaggccaaagagagaagcttgaaggcaaaagatcagtgacttaccacatacaaggggtccaaataagattaacagctagtttctcattagaaaacatgcaggacaggaggcagagcaaatggcaagaaaaaaaaaagtgtaaaccaagaatttcatatccagcaaaactatccctcgaaaatgaagaaaaaatcaagacattaccagataagccaatgctgagataatttgtctctatggaatctgccctaaaacaaatagtaaaggaagtcttttaggctgaaattaaacacacacacacacacacacacacccaggtgcacgagcgtgtgcaaaactagatagacagtaaattaaactcacatagacataaaaagcatgattaaagataactacatggatgctatggtttggatgtggtttgtcccagtcaaaactcaggttgaaatttaattgccaatgcaacagtgtttggaggtggtgtctttaagaaatgattaacttaagttggattaatgtctttctcacaagactgggttagttctctgcagaaaggattagttttgataagagttaattgttataaaatgaggttgcctctcacgtttttccctttttgcctttccctttatctgccatgtttggaggaagcacaaggccctcaccagaagcaggagatgcgattgtccaatcttgaacatcccagcctgcagaaccatgagctaaataaacctatttttttaaataaattacccaatctcagatattctgttatggcaacatacaacaaaaggtaagacatacagaaaacaaatagcatactgggagacataataattcctcatcagcaattacattaaaaaattaaactctccaattaaaaggcagaaatttcagaatggattttaaaaacatgatccaattacacactgtctataagagattcactagagtttgtcagtaaaaagtagaaaataatatactgtgcaaatgctaaccaaaagaagtttgagtaactatcctagtattagacaaaatcatctttaagacaaaaattgttactagaaacaaataaggacattttataatgataaaggcttaatcattcaagaatacagaacaattatagacatatttgtacataacaattgtgccagagtagcaaagaattagcaaagaacaacattctgaacagctgagctggtagctctatactgaaaaatgagaaatgtcatttgcctaaattattgacaaccggaagactgcaaccgagatcaagtgcaccctagaaagccacaggttttctatcctggctgcatattgaaatgatccacagagtctaaaactatagataccccggccctatgccaagaaatcctgatatagtgagtctgaagtaacatttcttaaagtgccccaggtgttctgaagtgcaggcaggataaggagacacgggcctagagtgtgagagcatgggctctgaaacatacagcctgggtttcaacctgagctctgcctcttactcgctccaaaaaaccttgaacatgactgaaccttgctgtacccacatcatggaagagtgtctggaacacatcatagaagacactaagaacagatttaaaaaaaaaactatcccagtaatgtgaaaatacatattctttattcatgtcgctagttttcagcatttagaaaggcacttataaatgttagccattactgtcgttgtcatcatcatcatcatcatcatctgtcatcatcatcatttgcccaggacaggcacaacttgaggtacctctgaaccctcacaatggacactgaagttggggaagaaagagacaaatggcagctttacctggtggaaaataagctcagctcttccctcttgagcctgcttcatcccccaggaagactaaagtggatcttgccagtcagcacaacagagctcccactttcaaagatggccttcacattctggaccacgcatactagggtggagtttaggaaaggtaaactgtgccaccctcccataccaccacacccccgcaaacacacacacacacacacacacacacacacacacacgaaaccaactaatccaacaacaccaactttctaccttcattaacatagtccttcttttgtaaatataaataggacaatgaaagatggcctgatattgagtgggaaaaaaatagcataaataatgacctagatgattaaagagaccagttaacctgtggggggaggtgagaatatctgataaacagaattctaattaatatacttgaaggagattgcacccattaaatgagtgtttcataaaatgtgaacatattgctatgaaaaaaagcaattagagaaaaacacagttcttagaaaataacataactgtctgtcaaaataaaaaattcaacagaatgatcaaacagtagaatggatacagctgaaatccaaagtagttatctagaaaataaaatagaagtgccccagaaagtaaagaaaaagagaaagaaaacattagaaaatgttaagaatcccataggatcaatttagaaggtagagcatctatccactaggaattcaagtaagagaaggcaaaaataaataaatagatagatagatagatagatagatagatagatagataaagagatacaatcaaagaattaatggaagaaatttccccaacaatttttcttgaactatccaatagacgaataactagaactagtttaataattcactatggtctgtgataaacaagtatgagatcaatacacataatttttccagaaattatggcagaaaatacagttggttcttgaacaacacaggtttggactgcataggtccacttacacatggatcttcttctacctctgccacccctgagacagcaagaccaacccctcctcttcctcctcctcctcagcctactcaactgatgacgatgaggacgaaggcctttatgatggtccacttccacttaattaatagtaaatacattttctatttcttaggactttttgaaatgatattttcttttctctagcttactttattgtaagaatacagcatataatacatctaacatacaaaatatgtgttagttgactatgtgatcagtaaggcttccagtcggcagttgcttacttgtagttaagtttttgaggagtcacacattatatgcaaattttcaactacatgaggggtcagtgcccctaactgccatgttgttcaagggttaactctatatccccatctctaaatattatagatattattttccaggaattaatctataaaatcaatgcaatcacaaaatcaaatcatggccactgtgtaactttacaaactcattctaaatttattgaagaatgcacagaagagcaaataatatgtgaaaataagtcatttgacttattataaagctggactagttaaaacaatgtagtgttgtcttagaaatgaactgatagattcattacacaaaataaagattaacaaacagacccatatctagcagtgaggtggtggaaaacatttcaaatggcaggagaaatactgaatcgttcaaaaaaaataatattgggaaaatggtcatccgttaggaaaagataaagttagagtcttcataccatatgtaaaaataagctttgattcaattaaacataaaaagaaaaattaaacattttagaaataaacaggtgaataatttcagaattatggtccaagagagatcttttacagtgtatattttaaaaagacactttgttaaaaattaaaagacaaacaaactgacaagacaaactgggataaaatattagtcacttaaaacagaaaagtattatgatcttaagaaaaataaaaagaaaaaataaaaataaaaataaggaaatgaggagaggtcccctccaaggagggacagtgacagtgaaggagaggagtgatttgaaagactagaaggtaagaaaatgacatattaataatttggttcaatatattgaatcaggtcggggtgaggaaggaaccaagggaacctgagtttaggttttagaataaggcaactgaaggaaagggagaaacattcctaatgagataggggagcaaaaagaaattagtttgggtttggagtagattgagttggggtccttgtaggataaatgctaacatggaggctcctccagtttagtctcactaggcagattcatttgagttaacaaaaaactaaactatagacctcatgtgaaaaattataagattgtgttgtgtttctgttttgctttcttttcattctctttattatttttttattttgctttcttttatttttatttttattgtctcctacttgagttgctttattgaatcttcttttgtagacaaataagaatcatataattgtttggatttaaatggttattttcaaattgcttaagggtattcgaaaacaacttctttccttgcaatttttaaaatgtccctttctaattgcttacatgttaatacagtcacacaacaaaataatatgcaactgtttaaaacagtttgtactaagaaatattagtgaatggagcaacagtcatgaaatactcctaagcagaaaaaaaaaggcaggttacaaaataggtgcactatgaatctaattttcataaaaatatgtacgcatctgtgtatgcatggggaaaaatggaaggcaaaacagcaaaatataattgtctatctctaagtgttgggatctgggatgatttttaaaaattgtcttgtgtttttatgcatttgctaaattcaaaacaatgaatatttaatatactagagtttaaaaattaaaaaaaagaaatctcacacatcaatgtaacacagtctcacagaaaaaatatgtacaagcaattcatggaagaaattcaaataggtaatggaatcttattctttgtttcgtttcggtcccatctattctttgtttcctttttcctgttttctgccttcttttgcattaattggatattttttattattccattccatttcctttgttggtttcttagccaactctttggggtttttggttttattttgtggttgctttaagctttacagtatacaactttaatttatcatagtttaccttcaggtgacattagacttcatcaagtatagtctaagaatcttacattgtatagttccatccgccctcctttacagtattttcacacaattacttattcaaatgttataaaccccacaatacattggtgcatttttttttcctatttttggttctttgcatgcattcagcttcttgaatctgtgggtttctagtttttattccattttgaaaaaaaattactactatttcttcaagtattttttctgtttgccctcactccttattccacatatattagtgtttctggaaattattccacaaagctctgtgatttttttccatatttttgttgaaaaaatgttttttctctgtgttcttcattttggagaatgtatattgcattgcaatgcctgtaagtccactaatcttttttcttgtctcaaatctgccattaatctcatccagtgaatttttttctctcttacattgtagttttcatcagtagaagttcaactgggttttttttatacctccatgtgtctacttaacttttggaacatacaattttaataactgtaatctttgattagatgatagacattaggaatgttatctagttggtgctggatacttttgtattcctatgaacgttctcaaactttgctctgggacacaggtaaattacttggaaactatctgattcctttggatcttgcttttaatatctgttaggcagaactggaacagcatttagctcaaggctagttattctccactactgaggtaaaactcttctgcatgctgtatacaatgcccaggtgaatcatgaggtttccaatctggatggtgggaaaaccctaattttgtgactggcacttttgtctctagtcctctcagatagttctttcatggcctcagtttctctacctacatgcaagagctgatcagtagcagctgaatattcacagggcttcctctccaaatctccagaaccctctacttgagtaagtctttcctctctggcactttgttctgcaaattctagccaccttggactcccaggctcagtatagcctccttaactcagcaggactgccaggctcttcccaggttcctgtgctgtggcctagaaaccttctcacaacaggaggctgcagcaatccatccccagaggatccagaggcacacctttctctacagttatgagaaataaatacgcgagaggaacctcagcatccctgaactcttcctggaggccacaaattacagttggaatttctgtgctgccatctaactagggtccctaaatgcaatgaagatgatgagaccccagggttgcaggggccaggtggcagctcttaattgccaaaggcatggtggatgtggttactgtgaagcacagagagccaaagcagccatcagagtagactggctcaccgagatctttggtgttggctctgaaaagccctgtttctctgattgagccgtgatggatacacgtttctgtctgggttgataaagcttagcaataaaaataaaccaccatctgagtaaggcaaaaagccagatccctcaaacaatgtaatataaaatgcaaacaatactaaacacattattggatctatatggtactcatattcccatagattagtgcttcttaaagtagatttactttgctttaaaaaaaaaaactgtcctaaactgtaactaatttgttattggtaaaaataaattctaaaaaatgttttcaactccatggttattagtttctcaacagtattagttattatgaataatctaatatccagttcagtgctactgtactcaaggttttaaaacttataccgcctgtgattgtgggagactgtttccattattcatacataagccatcacaagatggttcactgaatctttcaaaaaatcatctaatcagagctatataatctgatttctaattggcatccagcataatatagaacccgttatagtttaatgtaaggaagacaatgatctcaatcatagaagacactaagaacagatttaaaaaaaaaactatcccagtaatgtgaaaatacatattctttattcatgtcgctagttttcagcatttagaaaggcacttataaaacactatggtaaacacacacacacacacacacacacacacacacacagcatttcccttcttcccctccgacattgcattcgccagcctacaaagggaggcctccctcactgagtgctcacagtgagctgctgctcccctctctttgccctcccgcacatcagtcactccggcagggactgtacagctctccttcatctcgctctgtgtgtctgtaagcgcagaatgatgaaaagaaggagctgcagcagggctccggatggccttgtgcttgggagccctgcagaggaaagctgctgccaggagagcaatggcagcaccaaaacgctccagcagcaggggccactcatgcctgtactcagccagccaggcctgcagggcgaatggagtggctgcaaagaccttggagctgtgggcccaaaactgcttcttctcactatcctgagggatacgcccctttcagagagggcaactgactgtgtggtgtttatggaaggagttggggggagggcaggccagtgtgcccccctgggaatgaactagaaaactcactgctgcatctttagttgacacctccaggaagaaaaaaaaacaaatcattagcacagacaataaaagcaggagcttttattttaaaaatcattgaaatcaagacttcaagtcatgctagtgctaagtcccagggcagggtactttgctttctaggtcttcctttccttgcataaggtctcacacgtcatctggaaaacctcagttccattttgtggtccctgggaaaccatgaagggcttaacgaaggggagtgacacaggctggcagacactttacataccacccacggcatctgtgtgtgtgtggagaacggattggagaagagccagctttttggcacacagatctgttaggaggctactatatgagatgccaggcaaggacctgccctagaatggtggctcaaggcagagagaagacaggggcagctgcatacaaataaaatgagtcacggccaggcgcagtggcttacacctgtaattccagcactttgggaggccaaggtgggcggatcacgagatcaggagtttgagaccagcctgaccaacatggagaaaccctgtctctactgaaaatacaaaaattagctgggcgtggtgcgcacacctttaatcccagctactcaggcagctgaggcaagagaatcgcttgaacccgggtggcagaggttgcagtgagccaagatcgtaccattgccctccagcctgggcaacagagtgagactctgtctcaaaaataataataataataataataataataataataataataaaaaaatgagccacaaggagagagcttgtgaataagtatgatgggtgaggaaggagaaggatgtctgagtgtctccccagtttctagaatgggtaggcggtggtgtcatcaactgagacagaaaatacaaagggacaagaagatgaggttgaaggaatgtaagtcatgtgatacctaattagagaagaaagataatgtccacacagactacagttggctggaacaaaggaggatttgggagtcagagaggtttgggttcaagtcctagctcattacttaaggtgtggaagccttggcctcgctttaaaaaccttttttaaaaaaactcttttgaactttaaaaactcttaaaaaaaaaaaagagtaggaaaacctactcttgccaggactgttgtgaggataaggacatacaggtcccactcgatgaatggttaccatcattgtttacagtattttctttggtattattctggatagaacatctttggtcacatttccaaaactctgcggtgatggttcctgatggttccttagtcaactcggctagaccacagtacccagatatgtggtcaaacactagtttggatgttgctgtgaaagtatttttgtagatgagattaagttttaagtagaccttgaacaaagcagattaccctccataatgtagtgggctgcaaccagtcagtggaaagaagagaaaatgacggacctgctacagggaggagggaattccacctgctgcctcccttcaggctaaagctgcagcctcagctcttccctccatctccagcctgcgggccagcactgcagactttcgaattgcccgttcccacaactgcgtgagccaattctttaaaataaataaatctgtctatatacatatacatacatatataaaatttataacctagatatatatatacatctgtgtatgcgtgtgtatatctatctatatctgcctctatatctgtatatctcccattggttatgtttttctaaagcaccctaatagaactttatattgtagattttccttgcatctattgtgaatgcctttactcctcataaagccaaagccgaggctatctcaatggtcatgattcagagagtgagtttttgctaatgaaccaaaagattgcactgttgtggtcaacacagcagaagaacattctcatggtacagataaaaaactacccagcaaaatccatacacttccgtctgcagtgcagaactgcctctgggaagtgcctgtccagagaggcagtgcctgccacaggttcctagatgggcctcatgacaggctctcctgaatggcttgaaaggcaagcaatgaatgtcagtttcaggccaagaaaattaaactgctagggttccttttctgttctctattccctttcactgacttgccaggtccctgagcccctctgtgaagcctgccacaggccacgcctgacctggacaggggccagggtagccttgccctgaactgagccactgatagtcaggaggttgctccagcaattagtgtcaccctaatgataccctaacctccctacataaggcaaggaagtcagtcaagccacatgaaccccttctcctctgcctggggcttgggaagaaattagtccatggaaggtcagtgctgaccacctcccagagagcagactggccctgctccaactatgcggcagggctggggagcgagcactctgaacattctactcctgtaggtccagctgctgctacatccccccactgggatgagtcctgagaccccagcctgcttccctggcttccctgggacactcctcagccaccaccataaggggtcctaactcctcgtcagctataagcttatgcatcctgcatggtaaaatgcccagccctgtgagattcctgatgctgaggccagggctgggggtggcgcgcgggggtgattgggtgatggacgtcatttctctcttgtcttttcattcacacacccactctgcggaaggcggcttttcctttgtttagagagcttaatctgtctgcaccatgaaggtgggtgtggagtgaggaggcagctgtccccatgtcactgaaggcagcgcagtcaccacactgcataccccgaggatgtcaaccccacagtcagcctattcactgcatttccccttggcaccaagagccagcttcaaaataatccagcaaggggctggggggaggtggggggtggggagatagtgacaaaacaagatgggccagatgttggcatctgttgaagccagaagaggagtacacaggggttcatgacagcagtctgtttacttttacgtatgtttgaaaagttctaaataaaaatatttttctaaaaggaaattccttatatgagccgagatacagcagaagaggagcctcacctgactctaaggccactcctgtcttccctgataccatttcagggcgtcatggttactctcatgaaggaagaggtgtttttaatagacaaatgtgggttatttttctattcccattaatatttactacatgtcattatctccaagtctaatcacttaaagaggagattttaaataattgattaatataaaagaagaaaaatgccacgctgtctttttcattatctatcaaaacccagaaaacctcttcctctagtcctgacacagacacatacatatattaatgcatacactgagaagaacaggcatacaaatcaatagacacaaatctgctcagggcatttttccgagggaaaaaccattaacctctctccatctcccgcgtggcctgctcctcagcacaatgccacggcaattcaagtaactctttttattttactcacagaattttagggttcccccaaaaacacaaaaatctaacatttcttgaactctgataacatatattttgcttgtgcgatcatacatatgcatgtatagtgcataaacaggctttaatgtctagatgaaatgcatgcatccacacttttttttttttttttttgagatggattctctctctgcaccaggctggagtgcagtggtgtggcgcgatctcggctcactgcaacctctacctcccgggttcaagcaattctcctgcctcagtctccccagtagctgggattacagacacccgccaacattccccggctaatttttctaattttagtagagatggggtttcaccatgttggccaggctggtctcgagctcctgactcattatctgcccgcctcggcaccccaaagtgctgggattacaggcgtcagctgcgccaagccgcatccacacttttaaaatgcccttgttggccaggcgcagtggctcatgcctgtaatcccagcactttgggaggccaaggtgggtggatcacgagttcaggagttccagaccagcctggccaagatggtgaaaccccatctctactaaaaacacaaaaaaattagccgggcatggtggcaggcacctgtaattccagctattcaggaggctgaggcagagaatcatttgaacctgggaggcagaggttgcagtgagccgagatcatgccattgcactccaggctaggtgacagagcgagactctgtctcaaaaaaaaaaaaaaaaaaaaaaaaagcccttggttcacgctcggtccttacaggaggacagcaaaacaaaacaaacacaaagaggatgccctcggagcatctcagcaagacactgaggagcgctctcagaagcacctcccatgagaaacacagtgcttctcacaagcccatcagcattcagcagtgagattttatcaagctctgcttcccgctgcctgaaaagaagttggaattctcttcgccactgcctccaacctgctcacgcatctgaaggtggaaccctgctccaaggccacctggagacgcaggtgccacttaccacaagggagagaggcctcttccaggagacgacacctatgagtcccgacagcagcacctggaaggacaaaagatacaggaaggtgagatgcttccgaaaccttgcatgggcaatcaaaacactgtgaaccgtttcaacccggagaaggacgtgtggaacacagcacacacacagtggcggggctaccatgagctgcattttcacagcttgcacccactctgagaggcacattggtctctcagggcaccagggtgctatggaggggtcactttgtgcactgcactaggtggcccgagagtgacaggctttctgaaacaccccaccctggtcctcgatgtgatttggctgtgctaggcacacgcttgtattcctagctactcgggaggctgaggcacgagaatcacttgaacctgggaggcagaggttgcagtgagccaagatcacaccactgcactccagcctgggaggcagagcgagactccatctcaaaaaaaaaaaaaaaatcacagagaacactatttggggaaaaggcaaatgcaaccccacccacgggccacctggccacctgccatggttgcatggaccctgggcatggcagaccctgcaggctccttctgccctatacacacttggctcccctgatgcacacccttctctcccctccagcccctgcgagcccctccccttcactcatcacagcttcccacctcacccgtacataggcagtgtcttctgatgaggctccagaactttctaggccctgactccaagcagcccactcctttcccaggccaagtcctgcccttgaccttgcctggggtctcaccagaagtcatcccctctctcctgcctcctccctactgtcctgatcacatgaatacactgtgacttctgtcccttagaagaaccactgcttagccctgtgtccagctcctggcctgcctgtctcctaggcggcctcctgaggccaggcaacctgaggatgacactggctctgatccccacattcctgatttcctggtgtccaggaagggccaatggatcatgaagacacagtcacttcccacccactaccatctatctggcttcagccccacaactccaaggaaacttctcccaaggttccccagcagtcaccaagtgcgacagacaaagctcggtccccatcacccggctgagggctgaggctccctcccatctgggctcctgtggcttctcactcccctgcggttcttcccacttcccaggggccgctctcctccacagcctccctcctggcctcctccctctccccaacctcttcctggtttcccaacacctgtctcctgagccctttgtctcctctccccagggctctgtggtggctgtcctgaggctcctcgagtaccatccactggtatctgcacaggtgattctcagcccagggctttgccatggccacggcatcacaccgtccacaggctctgctcctggcatctgtccaacccaacatgtccaaaaatgcagctgcagcctccacctcagaagcccacacttcctcttgcaacctctgctctccacaagagtacctcttcttccccgtcactcaagccgaaatcctggagatctttccctctcccttacccccatgtccaaccagggaggaacaggaggctaaggctcactcaacagggcagcatgtgagaaggccgaattaaaaggaaggtgtttgcagaccaggtctcctgtgaagacaaattgctcacgcttgccactgtgggcacaagccaggcatccgggcactggctggaagggcttggctgcatgtcccctgagactccaaaagcactggccagacccgggaggagggcatgatgctgacaaactcacaaggtacccttggtcacagactgcagttcaccctcaaccacctccacagggggcagaaccaggtctcagacacagcagccactatcacatcctgcaccatgctagtctagtatcaaaaacatctggccacaaaacaacaaaacaacaacaaaaacatgaaccaaagcacgcacaccagggctctgctcccaagcctctcacacgtgtattttttctgcaacgctcacaagtcctccaaacacagttaccggcgacagacattatttacagccatttcccaccgcccgggtcccctcccatggccatgccacccaggctccttgcctcgcagtccagttccagccctagggaaatccttgaccaatgtctctcgtgtctctcaggggctgtgtctcactaactctccttccaaatgcccctgaaacctctctcttgccttctgtacccaacatttgaacccagtgggcacaccatgttcccatgtcatttcacagtcagaggacaccggcctttcttggaaggagatgaccattcccgccggagctctcaccatcatttcatgtttgacatttcagaccctgacttcactcctccacacccactttcttctttttgtgaattcaaaatttctgaccataatgccatcatgttttgagctcatggtatatagttcaggggccactccgtcactaagcaggatccattcttctgctcagcaccctccatttcccggttcatctctctgccctctgccggcacgctcctgtttcacctgcccgatgacagccttgtccactcgctcttgtctccacctcctccctccccactgaagccatcctggatgcctccaccaaacaaaccgcatcaccctggcctgacaatttagaccacaaagctaggtccctgattttccagcactggaggcacctcccttggtggccccactcctgtccaggccactctgggcacctccagggaggctggcaagggaggaaactgcacagcagccactgtgtgactcacctacaagccacagagctctgtgggctgtcttccctccacacccaacctccgagacagcccccatcttccagcactcccttcctgtccccagccctcccggccccagcctcagcccccgactcttcttatccctcaagttgagggccacattccggggctctggctctgactctgccatctgcctaggatgaaacttccaaaaagtgtcttccatttttccacacgccccaacactggcctcacgcagactaagcctggacagatggtgagaagaaacatcccctagaaaatggcgtcttctacttcccatgtctaccagatgaaatcttacccgttcttcaaccatggccccaccctcctcactcacgaagagcctaggaattcaagagcccagggggcccatcagatccccaaactaccaccagagtcctgcaggcatctttaataaactcagattgaacgccttgacctcttctcagctgaagtgtattaaactatcaaaattctacagtgactaagtcgcttgtagcaggaatttcactggaagtacataaaacttccaaatcgtagccactactccacctacttctaagcctgaaggaagttaatattgcttttatcttattaagctacagggagagttcttgaccttccccattcccataagcaaagctatcattccacaaatcccctcacagaatttgactttcaacaaacacgggtgacttgctcactgaagacaatgtgcatttccaagtatcattaataactacaactaggaatggatcaaattctcctacacaaagcaaaagaataaagccattaaacttggcgtggcaggcagaattctaaaatgacccctggtgacccctggccttacagaatgctctcccctgagtaagaatatgatgggctgtcactcttgtggtcttcccccagggacatgttcaaataacatggccccagcaacactctggttgcagccttgtgaaacctggccaggtgactcttctatgggaggggggcaaggaaatgctgggtagagaagggtggggtgcctggcgagggctccaccctcaggcctgtgcccatggacctaagtgagaacgggcaatcctgttttcatgcccaaatgttgcatcttccaagaccactctggcctcccatgccccccatcctgtgcccataaaaatctgagaccatagtgggcatggacacaagcagctggatgttgaaaggaggagaagggcacaccaacagacaccagcagacactggcaggccactgacggcgggatgacacagaatttggtcgagggcagtcggaggagagtccagccactggccggcctgactccaggggaagacaccttcccactccatccccgttttgctccccatccacttcgctgagagctacctccaccactcaattaaacctcgcacccatcctccaagcccatgtgtgatctgatttttcctgtacactagggcaagaaccaggatacagaaagccctctgtccttgtgataaggcagagggtctaactgagctgattaacacaagctgcctgcagatggcaaaactgaaagagcactctgtaacacacacccactgaggctttgggacctgcaaacactcaaccctagacgatgccgtggagatggagccccaaaacactccccaaaacctacccatcttcatgttcccccttggagtttgaacagcggggcaccgaagaagcgaaccacacccttgtcacacgcccggtgaggcggataagggaactcctccggtttcaactctactaagcaaggtccagactcctaacccaagaaaactatgaggtattaagtgagtgttgtgtcaagctgcaaagtttatggtcatttgctacacagcaacagaaaacaattgttagggactaaatgtatgtgaccccccaattggagatgttgaatccctaacccgcaatgtaatggtatttggagatggggcctctgggaggtgattaggattagactgggtcatgaggatgacgccttcacaatgggactggtagctctacacgaggagaaagcgagctctcacgctctccgcacacacacaatgaggcagaccattcagagtgcaagtcagttattggtgtataaaaatgcttgtgaattttgcacattgattttgtatcctgagactttgctgaagttgcttatcagcttaaggagattttgggctgagaccatggggttttctaaatatacaatcatgtcatttgcaaacagggacaatttgacttcctcttttcctaattgaataccctttatttctttctcctgcctgactgccctggccagaacttccaacactatgttgaataggagtggtgagagagggcatccctgtcttgtgccagttttcaaagggaatgcttccagtttttgcccattcagtatgatattggctgtgggtttgtcatagatggctcttattattttgagatacatcacatcaatacctaatttattgagagtttttagcatgaagggctgttgaattttgtcaaaggccttttctgcatctattgagataatcatgtggtttttgtctttggttctgtttatatgctggattacatttattgatttgcatatgttgaataacagacaaaaagagagccaaatcatgagtgaactcccattcacaattgattcaaagagaataaaatacctaggaatccaacttacaagggatgtgaaggacctcttcaaggacaactacaaaccactgctcaacgaaataaaagaggatacaaacaaatggaagaacattccatgctcatggataggaagaatcaatatcgtgaaaatggacataatgccgaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaaccatctgatctttgacaaacctgacaaaaacaagaaatggggaaaggattccctatttaaaaatggtgctgggaaaactggctagccatacgtagaaagctgaaactggatcccttccttataccttatacaaaaattaattcaagatggattaaagacttatatgttagacctaaaaccataaaaaccctagaagaaaacctaggcaataccattcaggacataggcatcggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgccaaagggctcatatccagaatctacaaagaactcaaacaaatttacaagaaaaaaacaaacaaccctatcaacaagtgggtgaagggtatgaacagacacttctcaaaagacatttatgcagccaacagacacatgaaaaaatgctcatcatcactggccatcagagaaatgcaaatcaaaaccacaatgagatgccatctcacaccagttagaatggccataattaaaaagtcaggaaacaacaggtgccggagaggacgtagagaaataggaacacttttacactgttgtgggactgtaaactagttcaaccattgtggaagacagtgtggcaattcctcagggatctagaactagaaataccatttgacccagacatcccattactgggtatatacccaaaggattataaatcatgctgctataaagacacatgcacacacgtttattgcagcactattcacaatagcaaagacttggaactaacccaaatgtccatcaatgatagactggattaagaaaatatgccacatatacaacatggaatactatgtagccataaaaaaggatgagttcatgtcctttgtagagacatggatgaagctggaaaccatcattctcagcaaactatcgcaaggacaaaaaaccaaacactgcatgttctcactcataggtgggaattgaacaatgagaacacttggacacaggaaggggaacatcacacaccggggcctgttgtggggtggggggaggggggagggaaaacattaggagatatacctaatgtaaatgacgagttaatggatgcagcacaccaacatggcacatgtatacatatgtaacaaacctgcacgttgtgcacatgtaccctagaacttaaagtataatttaaaaaaacaataataataattaaaatattcaggaactatgaaaaaaaaaaaaagaatgcaagtcaggaaggagccctcaccagaaaccaagcttgctgacaccctgatttcagactttccagcttcacaaactgcgagaaaataaatttctgttaggtcacctagtctatgctatttcgttatggcagcctaagtagactaagacactacgacatccggagtgggacactggattgttgttccaaaacatctgctttctccccagacctctccaggaggggcagcacaggcttccctccccacacccctccccaatcctggaaacactgacacagctcccaacaccaatgcttgagcgcttggaactgactgtgcatgcattgcttgctgttcatcagtgagcttctgtggagccaagttggaaaacttttccctagaaaggtatagttctgccagtaacaggaatgcacccaggatttggaaacactgtgatgctcgagggcctcagctcacagcacagtagaaatcccaggccaagcccctaccttgccgtgggcatcaggctcagccacagtgctatggtggacactcatgctcagggcaagtcccttctccagccacatgccgcctgacgctgctccctgtcattgtgactccagccacctgccactctggcctcaattcattatttgtttatttgtttcttcgggagtgggacactggatcattttttcaaaacatctgctttctccccagacctctccaggaggggcagcacagacttcactccccccacccctccctgataccggaaacactgacacaggtccaaatacgaaggccaaatagattgggaaaggcatgatattgctcagggagaggaggcttaaccctaatgacggagggcctgcagaatggcttgagggaggcttttcacggcccaggtgctggtgtgcctcctccctggagaggccagctctggcccactggagaccaagggcggttgatgtaaaagcagctcagagcctctgctctgaaaccatcggatcttgaactgtttttgctcaattccagctaccagcaaggattatgttgcacattctgacatgtcagtaatcctgtaggttgattttgcaccactctcatgagaaaaagggtcatgaatctagttagccatgaaattaccgcatcatgaaaccttcatcccgtttaatttacaggtatcattattcagagtccacagttcacaaagaatatggagaaaacgaagagggttggggaagagtaacatagaattaaatagctgtggaaaaaaagccaaatagattggaaaaggcatgatattgctcaaggagaggaggccgaaccttgcgagcaccatgagttgtcacaaggacgccaactcgctcttttctccacttccccacccagcctaatagaggcaagagataaaatcagaacagagacagaacttcctgctgttgaggctgatgacaagggataacaggctgccgggaaataatggcatccttagagtcaaagacctgcccatttgattggtaccctgcctggacacagaggtctggaataaattagctctttaaatcttgtcctctaacactgaaaagttcttttacttcctaaaatcaagaatgttcttcagatcataaagtctggtccaaaggcaactgatagtgaagcaagtccttctagaacgcagtcttgaaagccaagtaaattactttcatgaaacatatggcagatgggtgcccaatagctacagagatatcaatttaccactaagaagccagcattcactgtgtgtggaaagaattgttgcaaaaacagagcaaataatattctgagtccaccaaccccccatcttccaaacctcctggactgcagctctgtgcaatattcctcctacagcctcctggagcagctgatcttcctacttcaccctccgtcaattctccttgctttgggtgtggctttctttctctgagtcttgctggggccacagaaggctcacgaggcatgcaggcctctaccatctgtctctacctttgaggacacactcattgctacccccaccctgtccatgctttctgccccctctccttagggcaacttccaactcaccattccctctcccagcctttcatcccaggctgtggtccaaacatcctccacaccatttcccttcaggggctgcaccaacacatcacactcataatgtccctgagaaaagttacctttcttctcaacctactgatagaaaaagaactctgcagctttcattatcttctcaagcagaagcaaaactataaattgatgacaaagatcacctcatgaaagagaaaaaactccttagtgttgaagtgttttaaaatattctaaataactcatgagtcaaaagatactgaaaggtgaaatacaccatggtctgttctgatgcaatgcatgcttctttgatgcacattctctcttaagtgcttggtaacaaactcatttgtccagggcctgccctgtaagatgctgcctcctcttacgggtatctactctgacattagggtagctgctggattttgttacttagtgggttattaggtagcacatatattattataatacattttaaaatatttttagtttaaaaatttcaaaataatttgtttcctttgtaatagtttttttggttttgttttttgttgctgttgttgttttgagacagagtctggctctatcgcccaggctggagtgcagtgacacgagctcggctcaccgcaagctccgcctcccgggttcacgccattctcctgcctcagcctcccaagtagctgggactacaggtgcctgccaccatgcctggctaattttttttcctattttttagtagagacagggtttcactgtgttagccaggatggtctcgatctcctgacctcgtgatctgcccgcctcagcctcccaaagtgttggaattacaggcgtgagccactgtgcccggcctttttttgtattttttagtggagaaggggtttcaccatgttagccaggatggtctcgatctcctgaccttgtgatccacccgcctcggcctcccaaagtgcagggattacaggcgtgagccactgtgcccggcctgtaatagttttatttcatgcttttaaaaaccttattctgagaagggatccacaggcttcactagattgtcatgacaaaagttatgaccccccccacccccgaccccgattaaagttcctttagagcagattttttggtgataaactcccgtttttggtttatctgtaaatagcttacttcgttcgccttgatgcttgaaaaatagttacgctggaaacaccctaggttgacagttgcatctctcaacagtttgaaactattattccactgttttctgactgccattgttgcagccaagtcagctgtcctcattctctaaagacttttgagatcatctccttgcctttagtattctgaactttttgcctggtatgttaggtgtggatttctttttaatcttctttgagagatactgtgctactgaatctgtgaatttatatttttcattcgttctggaaattttgtagctaatatctcttcagatattgtatcttcgctattctctttgccagggactccagtagctgtatgtttgtccttcacattccatcctccaaatgtcttagtttttcttccacatattccccacacatgtcattcatgacttcattctggttactttctttagctgtgtcttccagatcatcaattgtctctgcactgtgtctaatcagctgttgaactatataactgcacttgtttagaaaagttcagtgattatatctcaatatctagaaattcttttatttccaaatgtaactatttatttcaaatagttccttgttgtgtgctcatctatatgactgtgttgataatttctttaaatgtttcatacactaatgttctagattccaagacatgttgtcccaggagggtatcaaagtttgccctttgttgtctcattgtgatttgctttctttgatgcttgagcgcttggaagtgtttgactgtgcatgcattgcttgctgttcatcagtgaacttctgtggagccaagttggaaaacttttccctagagaggcatagttctgccagtaacaggaatgcacccaggatttggaaacactgtgatgctcaagggcctcagctcacagcacagtagaaatcccaggccaagcccctaccttgcagtgggcaccaggctcagccgcagtgctatggtggacactcatgctcagggcaagtcccttctccagccacataccgcctgacgctgctccctgtcattgtgactccagccacctgccactctggcctcagttcattatttatttgtttgggagtagggcagtggaccttgatgatctgcaatgcatcaaggagcatgtcttttgcagtgtatagttgttctataggagaagcatccttcaaagtgcctactcagccaaaatgccagaatcagaaggaaatcccccattcctggtgtttttattggtcccataaatacaccaataaagcaatgaatagaggctacttttatttttttttaaattaacaaatgttataagttatcaaaatatgaaactttatttagctaataaaattctttataaattccaaagtattccacatatcctattatttatttactcttttagccccagcaactatatttctcaaatcactttactttcaaaaaaacaaaatgttatcccaaattattctttccctccattttcccctggaaaaaaatattactcccatccaaagcctttctaattcagtagctttcctacatgctggtaagaaactgtaagacaaggattccattcacaaaagcaaaaaaattaaaaactatccaagaattaacttcatgatgaatgtataaggttttttaaaaggcaactacaagactctactgagacataggaaggaagatttttagtaaatggacgtatataccatgttcccaaatgaggaaacctaaagataataaaaatgttaatttctctatattcataaattaatttagtgaaatctctatcaaaatcccaatgggattctttgaaggttgacaaaatgattcaaaaatttatctgaaggaaaaatttttccttcagatagtagagaagaaacaatgtcattgaactatgtggagggaaagaggtttatgtattactggacacaattttcatcccttcattattttaagttaaaaattcccaggaacaaaaacagtttagaaagccacaatagttataagtggctcaagaacaaacagacctgtaaagaacagaatataatgtccagaaagagacttaggcatatattagggttttaaaaaattatttgttttttagattgtggtaaaatgtacatacataaaatttaccatttaaccatttttaagtgtacactcagtagcattaagtccattcaccttgtgcaaacattcccctcatccatctccagaaaacctttcatcttgcaaaattaaaactttgtatccattaatttacaccgattccccattccctcccccactctagcccctgacaaccaccattcttctttctgtctctatatgagtggaatcatagttttatccttttgtgacaggcttctatcacttaggataatggtttcaaggttcatccatatgtagcatgtgtcagaatctctttttttttttttttttttttttttgagacagttttgttctgtcgcccacgccggagtgcagtggtgtgatctcagctcactgcaagctctgcctcctgggttcatgccattctcctgccttagcctcctgagtagctgggctacaggcgcccaccaccacgcccggctacttttttttgtatttttagtagagacggggtttcaccatgttagccaggatggtctcgatctcctgatctcgtgatccgcccgcctcggcctcccaaagtgctgggattacaggcctgagccaccgcgcctggcctctccttcctttgtaagtctaatagtattctgtacgtatagacctcattctgttgagccactcgtctacagatggatgcttgggttgcttccaccttttagctatgaggataatgcttctatgaacacaggtgtgcaaatatgtctttgagacccttctttcaattcttttgggtatgtacccagaagtgaaatatggtaattctatttgtaataatacagagtggaaaacagtataaacctcctcaataattacaaatagaattaccatatggctattatttttataatagccattctgatgggtaggaagtggtagtcattttgattttttctcttttttctttctttttttttttttgagacagggtctcactctcacctaggctggagtgcagtgacgtgatcacagctcactgcactttcaacctcctgggctcaagcaatcctccctgctcagcctcccgagtagttgggactacaggtgcatgccaccacacccagctagttttcgtatttttttttctcaagagatgggggtttcgccacgttgcccaggctggtcttgaactcttgggtgccaacgatcctcctgcctgggcctcgaaaagtgctgggattacaggtgtgagccaccacgccagccattgttgtgattttgatttgcatctccttaaggattagtgatgttgagcatgttttcatgtgcttattagccatctgtatctcttctgtggagaaaggcctagtcaagccttttgcctatctttgaagctttcctcccagctttattgaggtatgactgacaaataaaaactgtatataaaatgtacaacatgattctggtatacatatactgtgaaatgattaccacaatcaagctaaccatatccatcacctcactagttaccatttcttctgagtgtttgataagaacatatgaagtctctttcagaaaatttcaaatatacagcacattattattaagtatagtcactatgctgtacattacgtctccagaatgtatttcttttataactgaaagtttataccctttgaccaacatctcccctttcccctctctcccccagccccgggcaactacgcttctcctctctgttaccatgagtttgactttttttttttagagtctacggacaagtgagattattcagtattcatctttctgtgtctggctaatttcacttagcataatgtcctctgggttcatccatgttgccaaaaatcctttgcccatttttgaattgtgttctttacttttttgttattgagttttaggagttttctatatgttctggataataatttctgatgaaatatgtgattttccagtactttttcccattctgtgggttgcctgtttactctcttaatagtgtcctttgatgcacaagtttttaattttgatgaagtccagtttgccacttttcttttgttgcttatgcctttggcatcatatccaagaaatcactgccaagcccagggttgtaaagcttttcccctaagcttccttctaagagttttataactttagctcttatgtttaggtctttaatccattttgagttaatttttgtataggatgttagttaagggtccaacttcattttttttgcatgtgaacacattaaattagtttttacaatttaatttatataattcagttatacaaggagtgacatagtaactgatgggggaaaaggctattcaataaatggttctgggataattgttaaatgtaaataaataagcagatagagaaattaaaattagttccctcccacaaaccaaaatacattacaagatgattaaaatattaaatgtaaataattaaccacccaggttactggctaaaactcacagaaaggcaactgctcctcaaaaaaatttactgagaggccaggcacagtgggtggctcacacctgtaatctcaacactttgggaggccgaggtgggcagatcacttgaggtcaggagctcgaggacagcctggccaacatggtgaaacctgtctccactaaaaatacaaacaattagccagacatggtggtatgtgcctgtagtcccagctactcaggaggctgaggtaggagaatgtcttgaacccaggaggcagaggttgccgtgagccgagattgtgccactgcactccagcctgggcgacagagtgagactccatcttaaaaaaaggaaaaaaaaatttactcagaaaaacaccttataagtaagtaatcaataaaatgcaaagtggaataagaggtcccttgctgcctgtcaagctagcagtggttagaaagaacagtggtcctcacttacagggctgtagagaatgtacatcattaagaggtgcgatgctgtcaactggcaaaaagtataataaacaaagcatgggctctatgcaaataaattcaaaacccaggatgacaaagataacttgctaaattactacaattgattccccaaaagaccaaaacactaactgttcccataaacaccaagaaattggaaatatgctcaaacagctgtaggcaaagtcttcaaaaacttctacgtatgaagatttccaaagctgtttaaattttttctgagcacagagggaaaaaagggggaacttccaaattgtctttataaaggtcagtgtaacaatcacaaacctgtaaaatatcacaaaaataaggaacagaccagtggcttttaaacagaagtacattgtttttattttatttttcctgtgctggatcaatatttaatgaatttcccccatgtatcaggcattgttggactctttcagatatttaactccttccccctcattatttatttggcaaaagttacattaagttattccctcccctcacaaagcaggttctccctgacttcaagggccaacatccaaacaaaaccaaacatgaaagacagagactcaaaaacttagcattcctcatctactacacatactagatataaacacacaaatttaaatgccaaaaactcataggacagtgcattaaaatgataattttactggtacatcatttttaaataaaaggttagaaaacagaattcagcagtacatttaaaagaatgaagaacatgggggttcacgtcaggaatgaaaagatggttctgcatattaatgtgacgaaaatgaaaaattctttcattcagtagatgcatggaagacgtccaatagaatttgatctccatcctctcttttaaaaaagaactcttagggctgggggcagtggctcacacctgtaatgccagcactttgggaggccgaggctagcggatcacttgaggtcaggagtcctagaccagcctggccaacatggtaaaatcctgtctctactaaaaatacaaaaatcagctgagtgtggtggcacatggctatagtctcagctactcgggaggctgaggcaggagaatcactggaacccgggaaacggaggttgcaatgagccaagatcacgccactgcactccagcctgggtgacagagcgagactccgtctcaaaaataaaataaaataaaacaaaatgattctgaaagtactcgtgtggtatgcagaattatgagatggcccccaaggtccccactccctggtgtacctgccctgtgtaatcctctcccttgggccgtgggtgggactgtgaatatgtatgtgattaggttacgctgcctgacaatggtggatgggaggtcccaaatcagtttgctgttgagttcatcaaaagggaagttctcttgggtgtgcctgacctaatcaggcaagacctttggttctgggcccttggtgaagtcccaatttgaggtgtaagaagttgtgctgctggccttgaagaagtgggctgccatgtggtgagatgcctctaagagctgagagcttccccacccacagcttgcaaggaagcagggctgagtcacacaacccccaaaatgaattctgccaacaacctgaaggagtttggaagtggatctttccctcgtaaagcttttggatgaagatgcttccagcctcaccaggatttcagcctgcagaccctgaggacaggacccaattaaaacactccagagtcccaacccttagaaactctgaaataataaggttgagctgtttgaacctgctatgcttgtggcaatttgccacataacaatagaaaactaatatatctagctaataacactaaaaaggaaaaataaaagaaagttataaacattggaaagaagaagcaaaatcattactatttgaaaataaagtgatcacctaattagaaaacccaaaggaattgattcagaagaataagaaaccataagaaaattcagtatgttacctggttacaaaatcaatatgttgaaaattataatactatatatagttgtcccttgaacaagaggggtgttaggggcaccaacctcctgtgcagtcaaaaatctatgtataacattttcactcctccaaaacttaactggtaatagtctgctgttgactggaagtcttaccaatcagataaacagttgattaacacacattcacattttggatgtcgtatgtactatatgctgtattcttacaataaagagaaaagaaaatgctattaagaaagtcataaggaagagaaaatatattttactattcattaagtggaagtggatcatcataaaggccttcatccttgtcatcttcttgttgagtaggctcaggaggaggaggaggaagaggagggctcagtcttgccatttcagggtggcagaggtggaagaaaatccacatataagtggacctatgctgtttaaacgcatgttgttcaaggtcaacaggatcaatatttattgtgccctgaatatatgccagatatacttactaagtttttatactttatcctgacaaccctaattagtatgtgtgactcttgtgcccgtgcacatatgtgaaaattaaagcacaaagagattaagtgacttgcccaacgttacaatgatgggcagggttaggacacaagctcttaaactatagacaaacagctttcctacatatgtgcaagcaaagactggttagaaaagagaatacaattaaaaattccatttataatggtaagcaaaaaggcagaatatcttagaatacacagatttaataagaggtgagcaggagcaatatcaaggaatccttaaacatctactggggaacctaaaagacttcatgactagatgggagggaaattcattttttaaacaaaaagactaaataatgtataagttccatgcaactctaattaaaataccaaaaaggggaaaagaaaatctacgcaataagaagtgctagggcaactggctagccacttggaaagaaatgaaacttaatctctacgtttcaacattaaaataaattccagagaaatcaaagagtaaaatataaattaaaacataaatatttgagaaatttgtaaaagaatcttgaagtaagccttttaaggcaccacacaattttaagacataatagaaacaattaataaatttaaaatgtatacgtttatggctaaaaaaacccacatttgtttgtggtaggaggaatctgtgttctcaatcccagggcctctctgcatctgcattagaagaacaagtctgtgcctttgacgtgtgaggtcggaggctcctgcagagtgggtggagtcccgtccccatcccagaataaacttggccatgggatatgcctggtggtgagtggaagtggcacatgccatcgccccgggccttctgatgcactacgtgctacctcttgccctcctccttgcccaggtggccactgccccttcaagcctgggccccggaatggacagatggcacagacacaaaccccatgagaagcttgcaacccaaagtggagccaccccagctgacctgcaaacccagaggagaaaataatggctcgctactgtcaagcactgcattttggtgtggtttttaatgtagcattattctgaaaagggccaatgaacacatttatggttaaaaaaaacccataaaaccaaaggctggtttcaaataggaaaaatatttataatacataaacagacaaaaggttttcttaatttacaaagagctcgtataaattaataaaagaaacaacagaaaaaaatggctgaatacgatgaataggatgtttagatttttaatgaacaataaacatgtaacagaatgcgtagacctactgaattttctaaagcaagtgaaaacaataagataagtatttttttcaacgagactggaaacattttggtgaagttttggtaaaacccagtgatggcaaagggcagaggggaaagaaagttcctcttaaacatttcttatgttggcataatttgatgtagccttccttgggaacaatttcatagcatctctcaaaataaaaactgtacatacccatactcaatggtttcaatcctgggaatttaacctgtggatatactaacagaaacaggccagcctatttacacaaggacgtttactacaaaaacctgaaccagtgagtagcaataaagggctagttaaaaagacttcggtatttacatagaacatgaatatgtgcattataaagtttgaggtagatctatttatgccactgtggaatgatctcgaagataaataactgacaagcaagacacagcccagtgtgcactgaaggatctctgtgtaaacaagaaggaatggatgaatgcatttactacataaacattgctctcttggaacgacgcacaagaaacctaacaatcggaaactagattaaggaggaggcgagggggaacttgcttttaaatgtgtaactttctgtaatattaacctttaatccatgcatgtattatgttaagcatatttaaaactctgcataccattgaacctagaattctacttctaagaattcccagtattaaccaaaggattatgtattttggaaactggaaacaaccgaggtgtgcagcaagagggaattacatatattcattgggtccttcctagttgctgccattaaatcatattatagaagaatatatatatatatacacacacatatatatgtatattgtattgtgtgtgtgtgtgtgtgtgtgtgtgtatatatgtatattggagacaaggtctccctctgtagcccaggctagaatgcagtggcatgatcacagctcactgtgacctccacctcccatgctcaagtgatcctcccatttcggcctcccgaatagcagggaatacaggcatgcatcacccggctgatttttgtatcttttgtagagagagggtttcactatgttgcccaggctggtctcgaactcctggctcaagtgatcccctcgctgtggcctcccaaagtgctgagattaaaggtgtgaaccactgtgcccagccacaggagaatatttaatgccatgtagaaacgttcacactaagtgaaagaagaagaaggaaaagcaggttgcaaaatggtgtggaaagtgcataatttcccttctgagaagcaaacaaatacataaagaaaatcagcagctgcatctcaaagttaccatggttatctccagacagtgagattttggcttcctctttatttttctgtttcccatggttgatacacaacagagaaaacgcactattaaaacccaagccagcgacagctggttctgcctcctaagtgaggaggcataacccatgccagtgggtactaactccctctaatgttcccatcagcaggcgggagaggtggacggggccagacaaattccaccacttcaatgtgagggccgatggcttcagaacaggtatggaaaggctctggaaacaatggcggccagtctgagtgagaggcagcaaaccagaatccctgcacagtgacggggtccaaggtggcaggatgaccaacaaggtgtgtaggggagggacggggcctgatctgcacagaaagtggttagccaggtggccatgtacacttctatgtgggctgctgctccttgatagagaataatgagaatttcagacataaatgcaagctacaagaataaattccaaccaggacccaaacgtattcaagagcctctgcccccctccctttctcaacccattgtcagaaaaaagtatgaagtgggaaggtagattgccctgcttgaaaaagagtattacataaaccatttgcaaatgacttttattctcttcttttagaaatctcctcatggcacaataataaaaacaatgtatttgttgatacagaacattaattccattaaaattgcattatgtgtaatgaaaagctatcagagtataattatgcaagcaaattcacagactcacatcaacttttaaatccactggaactatacaataggaactgaagctgtctggtagacaaattgctctttcttttccaaatcattatgaataaaggccactgtactaatgtcataaaccgcacactatttatgcaaactctcaaatccaggactgttccctagaggtgcctctgcctggtttttcccaggaccaacctgttctcagacccagaggctgtgctcccattcctgacttagccccaaagcaggctcccttctcggaattcttgcccagagagcccagttgtaccctgaagggagcctggttgcacccccaaagggttgcctgaatccgcacactctcagccctctgccccagcctgggagctgtgctctgctctgctgcccctggctggccgctgcagggcccgcaggctgctctccctcctccctgctgcaggtactgcacccaggtggccctcctgccatctctgctcacaccaggcagcgccacccacagagactggagtgcagagcccatctcctgtccccacgaggttctgagaggaggcagagggccaccaggacaggggaggaagggggcacgaggctggattcctgcaagggcacaggagtacatccagtgccgcccactcccgctgatgatagccccggtgaaaagacacaccctgggaaagggactcagtctatgcccctcactcatcacctatgtccatccctgggtttagacacttctaggatccccaaacacagtagggatatggacaactcgtgccatgctggtgacatgaagggaacccccccatctgactaagtggtcccagcacccttgtaatagccgtctccactccccagtcctgctcccctttcccctcactggcacaggcagaactcccctgtctggtcagttctgggtcgctgagtcccaggaacccccttcagcacccagcaggctgacactgatcttactcctgctttgcagaaggaacaccctcctgccttggccgcccccttgcttcctcccccactcacactccccagctgctcgttagtaagggctccctcggcccatcatctccccatacctcccctcccctcctcgcagtatctatcctgggagagcctgttccctccctggctccatcctccagggtaccctaagcctctctcagcctctcttcctcccagatccctgtgtccacccactggcctgatggaaacatgacggatgcctccccagcagcctaactcaatacagccagtgctcctggagcctgccctacctccacaggaggccccactcacccagatgtgcctgtcagggtcccagataccccacgtccctcccccacccaatctcactctcaaatccatccaaatcagggacatctactgaccagctcaccctgggccccggcccccagttcctccctccacctggtacctggctgccacctggcaggagagctactgtaagagccctacaaagccctccctgcctggactcctggtcacttctaacctgttttccacactgcagaatcatctttttaaaatgcaaacctggctgggcgtggtggctcacacctgtaatcccagcactttgggaggccgaggcgggcagatcacctgaggtcaggagttcgagaccagcctggccaacatggtgaaaccctgcctctactaaaactataaaaattagccaggcatggtggcatatgcctgtaatcccagctactcaggaggctgaggcaggtgaatcgtttgaacctgggaggtggaggttgcagtgagccaagattgcaccattgcactccagcctgggtgacagagcaagactccgtctccagaaaaaaaaaaaaaaaatctgaccatgtcactcgccccactcaatgacactgtgccctttaggggctttctttatcccttggagtaagtcccacatcttccagctcagaaggtccctgcctacccttcctgcttcatccaggtcactccatgggtggggtcacctctgcctccccctcaacccccaaacagctaattacccagactgggtagcaaacagctacaggaccacggggctacggcaccagcaccccacagtgccgctcactcatgcacctgcctttggctgctcagcaggtcctgggggcccagagcacgcttgtttcatctgcacagtgcccaccggagcaagggcctggtgccatggcacacatgagagtgaaggctgtcggcacgcacaaggttggccagcgcccacctccgggcgggagactttgtgcccatgctcctgaccagcttcacagccccacggaggcagcacggtcctgaggggcagtgtgctgacttttcccctttattttataaccaaaacaatgcaagttcaatatagaacaagttaggaaaggcagataagctgaaggaaataatgaaaccatctacattcacacggcttctcctctaactcctgttaacatgtggctgggttctatttaaatcggtttttataaaaattgggtcatcatgttgtcaataacctttccacattaccatataatgtgtcatgatcatgatggcacaccctgtaggtattcactgacatcaccttaatggctgaatgggactccattgtataaaaatacaaaatactcatgacctattattctataaacatttggaatcacaaacgtatgtgaaaaatatattttttaacaagcttatgaaaagataaacataagcctgtaatcccagcactttgggaggccaaggcgggtggatcacttgaggccaggagttcaagaccagtttggccaacatggcgaaaccgcatctctactaaaaatacaaaaaattagtcaagcatcatagcaggtgcctgtaatctcagctactcggatggctgaggtaagagaatcacttgaacctgggaggcaaaggttgcagtgagccaagatcatgccactgcactccagcctgggcgacagagcgaaactctgtttcaaaaattaaaaaaaagaatattaaaaaatatattaaatatatgaatatatttttaaaagtatttcattttttctgatctagtcattcttacacaatctgaagtcaaaattgttctgtagagaagctgccacttacaacaaatagttttgcttgtttcttcagtttactttcacatttctaaacttgatgctttgactgacttctgactatgaaaattgaggattctcactttcccctccaacacacagcagacacagccaaatgcacacactcgctctccctctcctcctcactttcccaatccaaatatagcaacaacccaccttttgatatttcagcattcagtattggcattattatgactacgtaaaatgtcacccataactgagccacaaggagtactacaattacagtgcctttaaaaaaaatcacatcacaatatgtaactggggttaattgcctcatttttcacttacatcttctacacagtcacacatgatttaacaacggagctatgttctgagaagtgcgcccttaggtgagtccatcattgtgtgaacctcacagaatgcacttacacaaacctagatggcgaagcccactacatacctaggctgtatggtacggcctactgctcccaggctacaaaactgggcagcatgttactgtcctgaacactgtaggcaactgtaatacaatggtgagtactttgtatttaacacatctcaacataataacggtacagtaaaaacatggtattagaatctcatgggaccaccattgtatacacagtccgtcattgagggaagcgttggtgtgtggtgtacgactgtatatctatcaaaaattcatcctagctctccaacagccctgaggtctccctcaccatgtatgagcacatgaagtctatcaaaaaatgagggagcaaaccaagaaaagagaagacatgggctcaagaaaacagaggctctagcccaggagagaggcgaaggggagtcgaagacccagggaagtccctaggagccatagtgcaccaggccagggcacagccaggtaaggagggagcaggtgacctgggtccaagaaggacatatctcagcaaaccagagtggtttgctccccatttttttgggttggggggagcccgagtctctctgtcacccatgctggagtgcagtggctcgatctccgctcactgcaacatacacctcccaatcaagcgattctcctgccgcagcctcccgagtagctgggactacaggcacccaccagcacaccccactaattttttggggttttttttgcatttttaatggagatagcgtttcaccatgttggccaggctggtctcgaactcctgacctccaggtgatccacccacctcggcctcccaaagtgctgggattacaggcctgagccactgcacctggcccacattttttgatagaccatatcctccactaactttcagagaaaggatttacagtaggtgaaatctgagggaccctacacgtttaacatgtaaggacagaaattttaggttgcagattattttgtctcagaactttttaggcaacgatctaatatgtgctgatctccatggtggctccagagtggtctgattcatcagcagatactggcaaggaccagctgtttaccaggcactgttctaggcacaggggatccagcagtttaaaaaaaagacatgcatagtgcctccctcatgacatcctggggagcagcagaggagggagacacaaaaataagagtgaaaccacatggcatgttacacagaatgaagaaaaataaggtgggaaagtgtgggctcaggagctgggaaatcctgggcttgtaggggtaacagatcccaaaaggaggaacgccctggtgggatggatgccggttcctgatggggatatacaggactctacaatggtgagacggtctttgtttttattcactgggtgaagtatgagaaactgatctgaatctgcaatctcctttcagttctgagaataactcctgtatcattttgcaatgatgattctacttcctttggtctctgcaaagcctatttatattctctggctgaccctctcatttactgtcttccctatttccaacttcctggtctttttttgttgttgttcagttttctgagagatttcccccaatttcatctttcaagcctttgatgatttttaaactttatattctgaaatttttcaaatagaaaagtacaaaaataagaatgttcaatccatctacttagcctgtcacgttaacaattttactatatttgcttcatctctttttctttgcttttcaagataaattacaaaccatgacattttaagtttttcaatatgcatacctaaaatacaaggacatttttctatataacctgtgaggccattaacacatctaaaatatactaattattaatagatcatctttgtatgatttcatacccaattcctattcaaatttcccagattgtccccagaataacttcttgcagttaatttgttcaaactagcttccaatgcttaggaatttgttatgtgcctacatggttgtaattttgttaagtagctttaaattttcagcttgttctttaacccacatgtctccggttttcagggtaggcaagggttttaatacaattatggtttcatcccttcacacatcccacatctctttctttgctagtataatctagaattttagattcaaactcatattacattgttttcatattatactcagtatcttttttcctttataaaaattaatttttcttttttttttggagatggagtctcgctttgttgcccaggcaatctcggctcactgcaacctccacctcctgagttcaagcaattctcatgcctcagcctcctgagtagctgggattacaagtagctgccaccacacccggctaatttttgtatttttagtagagacaggtttcaccatgttggccaggctggtctcgaactcctgacctcaagtgatctgcccaccttggcctcacaaagtgctgggattacaggcatgagccaccgtgcccggcctatttttctttttttttttttaaagacagggtctcaccgtgttacccaggctggtcttgaacaccctggctcaagtgatcctcctgccacaacctccgagtagctgggacttcaggcatgagccacctcgcctggctatattctgtgtctttcgatgttttttaaatttccactttccagttataactagtttcagtgttctgcattagttctgcttagccatgattccaccaactcaagctgctaacttaatagctcaaacgttgaatgacatcttcacgagactcctgtgagggtccccaaagcccccgatacctgagcatatcttcagggctcccaggaccaatatggactgctcgcctgctcagctatcatcacgtctgaagagcaggtcgccctagcgcaggtctggattcacagactttcccctcaatcactgcagatgctgcgtgcctgccctctgctttatcatagcagagaactctaaggcctgtctctttgtttgtatgtttgctttgctgaaaataaggtcccctacctagatgcttgtggaatcccattcttgaatttgcattgataatttcctttcctttctctctgaaacttttctggcatacttagttcatctccgcaagacagtgtgtttggtgttgcttgtttttgcactttacaaaaacagtgtcatagaaaaaacatagtattttttcatgtggtctcacaggcagagaactaattggctcctgcactgcaggtctcactcccctgcaggggctgctctggtggaagccagagcagggctgccccaggagcagccctggggcaacagagacttgaggcgacgggtctcggggaggcaagcctgaaatgtgctcggtaactgcactccagtcccctcaggagccagcacgatcacccgccgtagccaactgggtaacacacttggactagctatccttcctccctgcctccctctgccttcctgactgtgctctgcgcaaacaagagagattcctgctagtcctgctctcagtctgctttcagggtcatccaggctaagaacattcacgttcctaagattcctttatcatgttgttgcacacagctatagtttattcactttcactgtggtataacaacagtccatttcgttagaccacagaacttattttgtttgtttttgagatggagtcttgctctgttgcccaggctggagtgcagtggcacaatctcagctcactgcaacctccgcctcccaggttcaagcaattctcctgcctcagcctcccgagtagctgggattacaggcgtgcgccaccgcgcccagctaatttttttatttttagtagagacgtggtttcaccatgttggtcaggctggtctcgaattcctgacctggtgatccgccgcctcagcctcccaaactgctgagattacaggcatgagccactgcgcctggcctatataatttattaatatcccattcttctgctgatgaacatctgcactgtttccagtttttgctatcatgtactattcgttgatgactatcctggtgcacgtgggcaggagtttctgcaaggtatatgcttatgagtagaactgcaggtcacggtatgtgtgcatgttcagctatagaaaagaatgccaagttgtattccactgtattccagagtggtcccacccatttccactcccaccaagaattctcctgatccacattctgtccaaattggcattgtcaaacttcttaattgaggccaatctagtaggtgtaaacgatttctctccacagttgaattttacatgtccatgctgactggggcatgtgttgacacgtttattgaccctacatatgcccacttccatgaaatgcctatgtaagcattttgtccacttttctattgagttttgtgcctttatcctattgatttgtgggagttcactacatgaaatcataatcagttatgtgtattgcaagcatctccttccagttgtgtttttgctttcttcgtgatgtctttcaataaaaagaatgtttaaatgtacttacctttcaaacatatttttcagctttggcgtttctctgtcttgtttaaaaaattctttccaaatttcttacatcttacattttattctgtaaagttccaatgttttgctttcacagttaagtgtttaaaccacctgacactgattctcttgcatggatagccaatgatcccagaaccatttatggtagactccctgaattctgctcctggcctgccctgcatcgtttcatatatgcttcaggctctatcttatgttttgctgattgcattgtcttcctttgcacctacacttactgtctatagcttaaaaatgagtcttatacgtggtagcataaattccccccaaattcttcaggagcctcttgactttccttggcctatggctctgtcatataattttacaattaggttgttaagtcttaccctcccaacaaaaacatttgtcaggatttttaatgaaatcaattgaatctgatttggaaaaaaaaaacagccatcttcacagtattgagttagcttagactagctctctcaatatggtatatccctccatttatttaggttttatttaatgtctttcaataaagttttacacttttctgcatattcaaattacatattttttcttagatatagttctaagttccttatttttgtgctattgtaaataatgtccttaaacaatttacattttctctctgtggctgaagtataaagatacaattgatttttggtatattaaccttctagctaaccaccttgccaaactcattatttctaattgattgtagatggcttattcctgattttaaagggaatactttcaatgtttcctcattaagaataaaacagttctattaagtttgtatatgtattttttctataacttaagttctgttacgtttttctataaatctgtccattacatctgagttatcaaatgtgtagtctctcatcaactttttgatctcttctgtatctgtaattacatcttccttttcattcataataatggttatttgtaccttcttttttgttcttacacattcttaccatatttgtctattttgttagaattttcaaggagctaccttttggctatgtttatcctctttattgcagccttatattctatttcgttaatttctattcttatgtattatgttctttaaatttattcattcttctttttctaagtaaatctgatcacttcattcctattcttatgtattgtgttctttaaatttattcattcttctttttctaagtaaatctgatcacttcattcattttcaattgtcaatctttctaggtacctaaggctattcatttgcattacaatttcttctttgattaatgagttattaaaatctttttttaatttccaaatatattagggtcatttatccttttgttatttatttctaacttaattaaattgtggtcagagaatgtgatctccttgatattcattctttgaaatgttttgatatttactctacaaactaaaaaactgcaagatcaatttcttaaagatagtccctgtttacatgagaacatctctgaaagctgcagaattcagtatatgtaaattatacctggttgtgttctttaagttattacataatttttaattttctgtctgatagatcaacaatcaatatgtattgaaatttccttttcatgacagattgatcgatttctacctccatttttatgtgttttttctttatacgctttgcagtggtttaatcaaaagtatataagcataaaattgtacctatttgttatatgtaatgagcctctctctaacaaggctttttgactgaaagtcgattttgtctgatattaaaatggctctgccaatattcttttggttgacatctgcccacccaaacaactacacaaaaatctacaatttccaaactacattgtgaccagggttcattcatcacaacccctacatacgtacggtattttgcttgtgaactctcttcccctcttcctaccaaattttcttacagctttgaaatttgcctggacttcctaaaatgacaatgtcccagggaaatgttcaataatctgggtaaggagagacacacataggctcaaaataaagggatggaggaagatctaccaagcaaatggaaaacaaaaaaaggcaggggttgcaatcctggtctctaataaaacagactttaaaccaacaaagatcaaaagagacaaagaaggtcattacataatggtaaagggatcaatgcaacaagaagagctaactatcctaaatatatatgcacccaatacaggagcacccagattcataaagcaagtccttagtgacctacaaagagacttagactcccacacaataataatgggagactttaacaccccactgtcaacattagacagatcaacgagacagaaagttaacaaggatatccaggaattggactcagctctgcaccaagcggacctaatagacatctacagaactctccaccccaaatcaacagaatatatattcttttcagcaccataccacacctattccaaaattgaccacatagttggaagtaaagcactcctcagcaaatgtaaaagaacagaaattataaggaaccgtctctcagaccataatgcaatcaaactagaactcaggattaagaaactcactcaaaaccactcaactacatggaaactgaacaacctgctcctgaatgactactgggtacatcacgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagacctaaaattgacaccctaacatcacaattaaaagaactagagaagcaagagcaaacacattcaaaagctagcagaaggcaagaaataactaagatcagagcagaactgaaggagatagagacacaaaaacccttcaaaaaatcaatgaatccaggagctggttttctgaaaagatcaacaaaattgacagactgctagcaagactaataaagaagaaaagagagaagaatcaaatagatgcaataaaaaatgataaaggggatatcaccaccgatcccacagaaatacaaactaccatcagagaatactataaacacctctacacaaataaactagaaaatctagaagaaatggataaattcctcgacacatacaccctcccaagactaaaccaggaagaagttgaatctctgaatagacaaataataacaggctctgaaattgaggcaataattaatagcttaccaaccaaaaaaagtccaggaccagatggattcacagccgaattctaccagaggtacaaggaggagctggtaccattccttctgaaactattccaatcaacagaaaaacagtgaatcccccctaactcattttatgaggccagcatcatcctgatacaaagtctggcagagacacaacaaaaaaagagaattttacaccaatatccctgatgaacattgatgcaaaaatcctcaataaaatactggcaaaccgaatccagcagcacatcaaaaagcttatccaccatgatcaagtgggcttcatccctgggatgcaaggctggttcaacaagtgaaaatcaataaacgtaatccagcatataaacagaaccaaagacaaaaaccacgattatctcaatagatgcagaaaaggcctttgacagaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcataagacagggatgccctctctcaccactcctattcaacatagtgttggaagttctggccagggcagtcaggcaggagaaggagataaacggcattcaattaggaaaagaggaagtcaaattgtccctgtttgcagatgacatgattgtatatctagaaaaccccgtcgtctcagcccacaatctccttaagctgataagcaacttcagcaaagtctcaggatacaaaatcaatgtgcaaaaatcacaagcattcttatacaccaataacagacagacagccaaatcatgagtgaactcccattcacaactgcttcaaagagaataaaatacctagaaatccaacttacaagggatgtgaaggacctcttcaaggacaactacaagccactgctcaatgaaataaaagaggatacaaacaaatggaagaacattccatgctcatgggtaggaagaatcagtatcgtgaaaatggccataatgcccaaggtaatttatagattcaatgccatccccatcaagctaccaatggctttcttcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagcatggtactggtaccaaaacagagatatagaccaatggaatacaacagagccctcagaaataatgccgcgtatctacaaccatctgatctttgactaacctgacaaaaacgagaaatggggaaaggattccctatttaataaatggtgttgggaaaactggctagtcatatgcagaaagctgaaactggatctcttccttacaccttatacaaaaattaattcaaggtggattaaagacttacatgttagacctaaaaccataaaaaccctagaagaaaacctaggcaataccattcaggacataggcatgggcaaagacttcatgtctaaaacaccaaaagcaatggcaacaaaagccaaaattgacaaatgggatctaattaaactaaagagcttctgcacggcaaaagaaactaccatcagagtgaacaggcaacctacagaatgggagaaaatttttgcaatctactcatctgacaaagggctcatatccagaatctacaatgaactccaacaaatttacaagaagaaaacaaacaaccccatcaacaagtgggcaaaggatatgaacagacacttctcaaaagacatttatgcagccagaaaacacatgaaaaattgctcatcatcactggccatcagagaaatgcaaatcaaaaccacaatgagataccatctcacaccagttaggatggcgatcattaaaaagtcaggaaacaacaggtgctggagagggtgtggagaaataggaacactctttcactgttagtgggactgtaaaccagttcaaccattgtggaagtcagtgtggctattcctcagggatctagaactagaaatactatttgacccagccatcccattactgggtatatacccaaaggattataaatcatgctgctataaagacacatgcacacgtatgtttactgcagcactattcacaatagtaaagacttggaaccaacccaaatatccaacaatgatagactggattaagaaaatgtggcacatatacaccatggaatactatgcagccataaaaaatgatgagttcttgtcctttgtagggacatggatgaagctggaaaccatcattctcagcaaactatcgcaaggacaaaaaaccaaacaccgcatgttctcactcaggtgggaattgaacaatgagaacacatggacacagtaaggggaacatcacacaccggggactgctgtggggttaggggagcagagagagatagcattaggagatatatctaatgctgaatgacgagttaatgggtgcagcacaccaacatggcacatgtatacatatgtaacaaacctgcacgttgtgcacaggtaccctaaaacttaaagtataataataataaaatttaaaataataataataataatctacgtaaaaaaagaaatgttgatgtggctgaaatatatatgtatgtatcttgcaaatataattcatggctattttccatataaatcatctcaaatcaagatttgattttctctaacagatctggtctgaaaagtatagttatgaacaggagtggagtcatgggcattcactgcttctttaattgcattttctggaaaactctacagttctgtttttaacatttgatcacaccatcagtagagctacattccacaaagcaattatgttttgctcagcaaaatatcagaatggaataatatgctgcatattaacaactgtaagaatagaagccatttagaacattttagaataatgattgaggtcatttgttcagaatttacagcaaatgtgttttaaagacccactatcatggagtccactgtgaagtctaagttatgcacatcagaaactacaaatgcacaaggagcccagtattttatcaaaacattaatatcagcactattaaaaaccaaaccttttatccagcaccccctgcttaccagctctccccatgtacaaatgcattagcatttaatgcaatatgctttccttttctttaagggctttatccagatatctagaaagtagtaaagtggtagcatttaactaacacaggagtggcaaacaggtggcaactcccttcctcgacccagaaggacaaggctcatctatcaccacaccctccgtgcagagtacagaagccatcttagaatccttctaacacagtattccaggcaccatgacttagaatttgtgttggcatgccagatcccacctacccgaaggtgctatataaataggctagggcagctaggggaatacagttatatgtcttattcacaattctaaaaggcagttcgtggttgcacaggtctttcgcttccaggtcggatggagtagttagcagctcatcagtgtccccagtaagaacaacaggaaaagctcaataaaatatggaaatcaactctctgaaaatggctgagagtgacaaaattcaaacaggcttgagagaggaatgaacctccctccaagaagggagctaaactctgaagcttcttttatcctagaagtgttccaattctgggcacaagcagcagcctgagaactctggctatgcacctgctgaaagccagttctgggggaaaccccagcagggctatggttggagacttggggtccaagcacatggttgggttttcccctgggatagctttccaattctgagggtaagagacttaaattttaacaaaaagccactggaaggcagcctcaaaataaaaattgtaattaggaaacacaagagagaggggctgtgacaaatatagaagactctcatttgaaaaccctaaaaggcaaggacaaacaacagcaagactgaagcttaccagggctgcaaaccagctctgagtcagcacagtccttgcttcaatgaaggtgatgaacaccagataatctggacaataaagttagctggctgacttcaaaacaattatagttattacgcccaagaaaacagagaaaaagatgaataaaataaatgaaaagaagaatttcaccagataactataattggtaaaaattaataatcaaagagaaaatataaaactaaaaaatacaacatctaaaatgagtaactcaacagatgggtttaacagcaaattagatacagaagataagactagtaaacagcaagacaggtcaattaaaacgaatacccaaactaaaacctaaggaggaaaaaaaaatttaagaggattagagagacacaggacacaatgaatgggcctagtgtatgtgattcaagtcccattcagagaaaaagagaacagggtagaagaaatgatggccaaggattttctaaaacaaacaaaacagcaaatctcaaatcgttcagtaagcgctgcaaagctaagctggccatttacacaaaagaaaaagaaacctaaataaaaggaaaaatcttaaaagcagcaaaggagcagatctggacgcacatattaccttcaaagaagtaacaaaaagactggtagtcattttctaacaaaattgatggaaaccaccttttaagtcctgaaaggaagtagctgccaacctagaattctatcaccaagaaaatatccttcaaaaaaggaagctaaaataaaaatgtttctgagacaatcacagcagaatttgtcaccagcaaacttacactaaagaaaagaaaaatgacctagagaaaaacccaaataaggacgaagaaatgaagattgatgaaagggatgaatgaatatggactgcgaccaaactttggaagttatgaaaaggacagacaggcagtactgatttagccaaattaagaaagatggatcctaaagcagcaacagcagcagcagagaagagagaacaacccattgtgcacctcagaaccctcaaaagattcaggcacgagtctcaatgggcacctctggaagtggggctaatttggtgtagaaggcttgagggatttgggggctaatcaaggaagtagatatgctgaaaggaagcagtaacacatgcaagctttcttaaaaggttatgtgggaggggaagtccctcacagtatgacatccacaggcttcaagcaaggggtctatccagaaggggaagaggacaagggaactcctggggaaagggggtcagagaggaggctgacatagccaggtgacagtctgtagcagcacagcagggggtcccagggtcagagagctttgatggtagcagtggcttggagctttataaccacaaggctctatcttaccagaggccagctcaccgggtatgcaaagcagtcaggctcttaatggctaaaaatctgctaattcaggctatttgaaaaaaattagacgtgtaaaaatttgagtttggtaccagtgggcttctgagctaacagatctcagtctgctatgaagaaataaacaacctagaggccaatatatagtggccacctttggcctctatatgacacttgggaaggagggctaagataaggaatggaaatttggacagctacttgaaaacagatttcccagccctgcaccctagcagaattctgaaggactgttcccctaaaaacatcaaaacaggtctgtgctgtggactgaccagccccagaccacaatgcagcaacatgaggcaacagaaggcattctgaggctggtcccaccatgccctctgcccctgcagcatctttttaggtgaaactaatgcagaatgtgctccacaaaacaaggcagcaaagtcagaatgaggaagacctgagatgcagaaaatgacccagtggaattccagagatggcagaaagagggaacccgggctgacagctgtgtacaggcctagaaagccaccaacccaagagaagaaaatgagtcctggagaagaaaatgggaacagaaagataacctactagagctgagctgagtcagtattactgagaggctattgcaagaggagctattgattaaggcgaggcaagtactgacttcaagagtaagttagtgaaagtgaacataccactctacacagctctgcagtgaataatatctgcataggtataaatccaaatactgactaaattaaacttgtaacatacccactctggaggatgaggaaggggaaccagagagaaaatgaaaagctaaatcctcactgccataattagaaacctacaatgatatctacaaccaattaatcaaagatagcagaatttgtatcttatttagaaatgtggagacgtagtaagtcccagggaaaaaagctgaattaaaagtagttgcctctgcacaagttagagcagggaactactgggttttcctatttgctatttgactttttaaactatgttttcatttcattagatgacataaaaattaactttaaaaacacatagacatgaatatttttccttagtaatatgaaacttacaatgctcaaactacgtaacactagcatctataaaacctacaggaaaacagctgatcattttacatttaacttcttttaatataaagagagcttactctcctaaattaagccaaaactcccagatctctcaatttttcatggtgccatgggaaaaagcaaatctgatgtttctaccctcaaaataccaaaaggattaacatcagctaatttcttcaattatgacttcatgagtaacggactctaagtcctggacagcagccaacatcctgccagatgctaaagacagcatggtggaggcctgaaagagaactcagaatgaggacatggggccgggcacggtggctcacgcctgtaatcccagcactttgggaggccgaagcaggtggatcacctgaggtcaggagttcaaaaccagcctggccaacatggtggaaccctgtctgtactaaaaatacaaaaaatttagccatgcatggtggtgggcacctgtaatacctgttactctggaagctgaggcaggagaattgcttgaacccaggaagcagaggttgcagtgagccgaggtcgcgccattgcactccagcctgagcaacaagagtgaaactccgtgtcaaaaaaaaagaaaaaagaaaaaaagaaaaaaaagaatgaggacatggccactgactggtgctgagcaggttatctctcacccaggatggggaccccacataccattatctgctctcctgcctctccgggggctcagcaacactatggcagtggactttgaattacagagcagaaagaaaggttaaattcttggacttgaataaagagaacggcagggtaaactctaggagtttgtagggggaaagtcagcaagtttgcgtgttaaataagggtagagtacaagacaactatcccagtggctgtaaggccaaagaactctgaggctctgtaatgtcggaagttgctggctctctgctatgcaaggtaaccctacccccaccctctaccatctcacctacaaaatcatcagtaaatttatctggacaaagatacctttgtaagagtagaccagggtggagtgaaggtgacaaggactcacaaaggttttgagtgtgaaacttaggtaagagagaaagaacagtgctgagacagcccctgagcatgatggatccagggggatggaacttgtactccatggaattagaagtaagtatggagagagtttgggacattgtggccaatggaaccggtgtacctaagaaggctaggggatcaagatggaatctgagatgcagaatccaatgtataatttcgggataggtgagtgtgtctttaatgttttacaaaatattagtttatcaaagaacacatataaaaatgggttccacgtcaacgaggtctgaaaacatgacatagtatacccttttcatgcagagtcacggtgcacatgagaataacacagtcaagctaaaatgcacaccacaggaaagaaaatgcttcaaccctgaataaccccgcctgccccaaatgtgaccttggaatctttttaactcagaatacacatttaacatcttgtatacacagttgtttactatacatgttagtgaaaatgctggcataggaaattatagtgggaattcagagagagataagttagggtttttttccttcacaatgaaaattccttcttctgactatacatataaatagtacaccctaatgctgctaaatttagttaacatgaaaaattctagagaagaatgtaaaattcacccacaccaccatacacaaagataaaccaatggcaatgtttaaatgtattcatacctagattttttggtttacaaagtttatttgggccggcgcggtggctcacgtctgtaatcccagcacttcaggaggccaaggcgggcggatcacgcggtcaggagatcgagaccatcctggctaccacagtgaaaccccatctctactaaaaatacaaaaaaaaaaaaaaaaattagccggacgacgtggcgggcgcctgtagtcccagctacgccagaggctgaggcaggagaatggcgtgaacctgggaggcggaggctgcagtaagcagatatcgcgccactgcactccaacctgggcgacagcgagactccgtctcaaaaaaaaaatttgatttttttctaaggactccgttcacagtacacagtttttcctttaaaaatatatcacagacgtatgtggacacccatcctccaatgatgtacattcagactatctcaatgggaaaaaaaatgaggcttacattgtgtccgcaatttattcttccccgtgggttcttggtcttgctgacttcaggaatgaaggcgtggaccctcacggtgagtgtcacagctcttaaagatggtgtgtctagagtttgttctttcagatgcgtctggaactttttccttcccacgggtttgtgctctcactgacttcaggaaggaagctgcaaaccctcaatgtgagttatagctcataaaggtaatgcaaacccaaagagtgagcaacagcaagctttattgccaagagcagcaaaaatacaaaacctctgcactacctaagtggaccccatggggctcccaccgctgactgggtggcttttgttcccttatttggccccgcccacatcctgctgattggtccattttacagagcgttgattggtcccttttacagagtgctgattggtcccttttacagagtgctgattggtgtgtttttatagagtgccgattggtgcatttacaatcctttagctggacacaaaagttctccaaatccccacctgacccagaagcccaacttggcttcctcttttaatattgctattgactctattctgcccagtctgggtaggcgccaacctctcaggtgaaaggagcacaagagaaggtaaaggctgtcttgacctgtagtgacccaacaccaggtcatccacaacagggagaagaggtactgagaggggccctgcaaagtcctggtttatttattccgttggtaaccatgaggcagaggagacacaccaggcagtgccccaggaatcctcaagctcacagctttttcaacacatttccttttctttacaactggagtctttctgaaagttgtcttctgcacaaattgctaccaaaatcctcgccagtgtctctcccactgcaggcacaagaccagcaagccttatcatgtctgtgtctccaagtatcttgttcttgctgaccaagtcatggttttctaattctactgacacagtacattctatttccatcatcaaaacccatcagacagatgacagatctgcaaacaccataatggggtgattatacttttatgactagtttttgttgttgttgttttgtttttgttttttgagatggagtctcgctctgttgcccaggctggagtgcagtggcatgatctccactcactgcaagctccacctccagggttcacgccattctcctgcctcagcctcccaagtagctgggactacaggcacccaccaccacgtccaggttttttgtttttttttttgtattttttaatagacatggggtttcactgtgttagccaggatggtctcgatctcctgacctcatcatctgcctgcctcagcctcccaaagtgctgggattacaggctgagccaccacgcctggctttttatgactagttttaaatcttctttatcctgtttggagttatatttttgtattgcattctatttgatcatacgtggacagtcctactttcctttacttggccactgccagatagctctttgccaatgccctggtctgttattttaagctatttgtgtttgtttgtttgccaatagtatctatctgatttttgctttttaccccaatctaaaagtgctgtcttttaatagaggaaattaagtaacacctttagcgtggtagctaacataactgaattatttcctagcttatttactatatttccttaatttttgtttctctaattttcctgtcttttgctattttgttcaatttttgttgtttgctttttctaatgatttggaaattatatatcaattttctaaccaaaattttaaatctatgtttgaaattatatatctaataagtatatatcaatagcatagatatctatagtctctatgcaacatggcaaaattttctacctcaacctgcctcccagattttatcaaaacaaccacattagtgtcaacaattcaaacttaactttatgtttcattggtttaattgcttacttctgcagtatttataccaatgcttcctgtttatctttaataactaaatataattattaaatttatataattctataaattattgaatttatataattattacataaagataattgattattttaataattaaataattgatttattttaataacaagtaaaggtattaaatatttaataataattttcctcatttggcttgtgcactacaagtcatttcctttattcagaaatggtatgcagaaatttggagtccactgtatttctgaaaatcactttcatgtacccattcacatacatgagcttagaaatcttgcatacagaaagcctagaggaatcttgcttaacaacctgttccttctaaaatatgcaaatgttgctgcattatcttctagcatttgactttatggattaaaatctagtattaatgtgattattttctgtagcctgctttgtcttgtttaacgcttatctttgattttttttgattactgaaattcagaaaatgttctattacatgaatcaaacctaaaacaaaaacatctcctatatgcctgtctgacgtcttacatgtatcttccatgacctttagcttttctctcctaatttccccatcttgtctcattcctctcagttgaaaaatagatcccccaggtgatatcctaattcactaatccaatgttggtcatctggtttccttctcacagtaacattttcgtgtcctccgtctgcctccactgcacttgacagtctcttcttttgcaatgtggcacctctcagatctcacaggtcataagccagagttgttttgaagttttattccatttctctgtttcactgtgtgccatttactccattggcttttggagttggtatgtgatatatcctaaacattcacaaatacttcaaaatgctatgcacactgggcgccgagtggtcagtgtgatgcccaaagcttggggcagtgcattacatacagaagtagaagagaattgtccaatcagaattaaacatgatggctttgacctactgtctgcaggaaataagtgatgagagaaggccaaagaaaactgtagccatgtggcctccagatggaccttattatcttatgggtgcttggtttctttttgttctttgaccctaggtgatttattttgttatatttaaagcaaactagcaatttctgctctataattaaaagtatgtgtatgtctttataaacactgagtatatatactattaattgctgttgttatttttccattctcaaagctttccaggcctaatcgttatcctgcaacaactttcaaagaagtgagagcaatgatttcctctcctccactgttcatacgaatcatggagaagcggggttgaaaacgaagactgcctgagccccaacccccggagtccaacttggggtacctgagatatagccctatctgttagtttcctattgctgctgcaaccaatgaccaaaaactcagtggcttaaaacaatacaaaattatcacctttcagcttttgaggtcaaaagtccaaaatgggttgggttggtaggactgagctccttctggaagctccaggggagagtccctttccttgccttctccagcttccagagactgccctcagcccttggcttgtggccccactgcactcctgagttctgcttccatcctcgcctctccttctctgactctcctgcctccctctttcccttatgagggcccttgtgactaccttgaacccattcagatacccggcataacctccccatctccaaacccataacttcaccacatctacaaagccccttttgccatgtaaagtaatacattcataggttccagcgattaggaaggacgtggacatcagtggggttgggggtacgagtctccctatacacccagaaacctgcactttgaacaagaaccagcagactgcctggtgagaaacaccaaatcacacccactacatggtggctggagctttttcctttaggacactcttcagacccatcaccttaaaagtccgaaaccaacagagtgataaatatcataatataaacaaaacaccatccttgacaatttattaagataaaatattgcagtatgtacctagacctacccagaattcatttttaagtggaaagttaaatgacagaacagaaatgtctaagaatcattggggaaaaatacaagtcaaacccaaagccaagtccactttccacagcagaatcaagatgacaccctgtggagactccgatacactcaaaaaacatacttccatgtttgtttgtttgagacagagtctcactctatcgcccaggctgcagtgaagtggttcgatcttggctcactgcaaccgctgccccatgggttcaagcgattctcctgcttcagcctcccgagtagctgttattacaggtgctcgccaccacacacggctatttttttggatttttagcagagatggggtttcaccatgttgaccaggctggtcttgaactcctgacctcaggtgatccaccctccttgcactcccaaagtgctgggattacaggtgtgagccaccgtgcccagccacttccatgttttaaagcttcacttttccatctgtcttaagctcttttcccaaaaaaaaaaaagtaaaatttctgaattgtttaaatacattattaggaaacagaacttaaaaggccagtcctcttagtacatgcccaaattccaaatgtgtcactatttctataataaatagcgccagcactgacagacttcataatgcagggtttcctgtgctgccattcaccagcacacacaaaagtgagagtaatgaaaatgtcaggaaacggcatcccatttagaaaccaggaaatacaaaaatgcagctatcagtcatccctaaggctggccaaataaaaggttttaaatatagtcacggatcaccagtgtcacaagcaacaacattcactgcacagagaggcagcagaatttgcagcattgaggatttgctgggtggctgatgagatctgcccactttgaacttgctctcaactgacatacccagatctatttttacattagctgtcaaaatgataggtctcctgcatcctatgcctgcactgttaattatctatctgcctatctgtctatccatccatccatccatcttgagatgtctatctatccatccgtccattcatctatcttgagatgtctatctgtccatccatccatccatccatcttgagatgtctatctatccatccatccatccatccatccatccatccatccatccatctatcttgagatggggtgttgctctgtggcccaagctggaatgcactggtgcgatcttggctcactgcagcctcaacctttcaggctccagcaatcctcctgccttagccccacaagtagctgggaccacaggcacacgctaccacacctgggtaattttaaaaattttgtagagacagagactcactacgttcccagggctggtctagaaattctggcctcaagcaatcctcccacctcggcctcctaaagtgctaggatcacgggcataagccaccatggccagccaatatttaatttttgaatttgggactcccacgttggagctgggattttgtacttacatgtatactctctagcacatgtaacccattaaaaacatcacctgctttgctggttgcagtccttcctcccctctgtcctaattctgacaggatccggtagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctccatgatggggtgaggatgagggaaggagtcccagttcaagaagccgttaccaaaaggcactcctagcgagccaggtggcttcattcatccacgcctgatgtaaagccacccacataccccatctatacaatagggctgggcgcagactttcaaatacctattgaacctttacttcctctgaaacccagaagcctgtgttacagacctcaaccaccacatacacattgtctctaaggagaaatcaattccgtggggaaaacctgggaatggaggaagcggaaacaagaaagtgggaagtggggaaaggcaagaaggctttctttcagaaggtgagttagagataccacctgtctcccccattgataaaaggctcctcccatggctggctccactcatcctgccagcctcatttcaaaggccacaggctcagagaggtccctgctgagccccgagtccacagcacagccctggcccctctcgatggccttgcagttttatcttaaacatgtatctctgtatgaaatggtttccttattttttgcctgtctctcctgctctaggacgtgtactcgccaggcagaggcctggtgtgtcttctccaaagcagtatctccagctcccagcacaggcctggcccatagcagggactatgatcattatgaatgcattgagaagccaggcatggtggcacatgcctgtaatcacagctactcgggaggctaaggcaggagaatcacttgaacccgggaggcaagcagaggttgcagtgagccaaggtcatgccactgcactcccgcctgggcaacagagtgagactccatctcaaaaacaaacaaacaaacaaacaaaaagaatgcattgagagatgggtgggggaaggatgggaggaaggagggaggaatggaggtacacccatcactcggtaaaacaaggcctaatctgacctagatttaattatcctggagaccacccactccccaaaaaagggccaatgaccactctgagtcggatggattgacataaggagagagaggcagtgtccaatgaaactgtgctagagatcctcatggtccccaggttcctggtcttactgacacggctccggtgagctcccaccctcccagatgtctttctagtaactcctttgtgcgtagctacccaaagctggtttctgctgcttgccctaaatataccccattccaggagcatgtattcagggtggctgaggcacactgcgggcccaaactgttttcaagctttacatctgggcactctacctgtttaatcctcacaaggacctaaagagggaaatgcaattataatctggtattctaaggataccagtggccgggttacgtaaccccgggtaaaatcacgctggcagtaacaggggagcctcggtttatacccaggccataaatttccctcctgcgatgccacgctggcccctgcacgtatggtttattgtgataagtaaagaatcctatataacttatggtttttatgaatctaaaattttgatgaaacaggtctgcttggagtaggatccagctgtgtcattttgaatcttgtacaactgttagactgctttgagtcattctcctaaaactgtaattttattttaaattatatttaaattaattaaaaatataattttataacttgccccggagacattttacagacatgcttttagcaaaaatataacccacaaaataaaagttactttgtgaaaccctctcccaaaatttatataacatatataaccatttttcttaaaattatttttagatctaagcaatggtaaactcattagtctgttcataatatgattttatactccctggcatctgcaagcacagaacatagagaactcagcttgaggaaaaacagtaagcaaattaaaaagtaaaataaatcttagcctatgttcacacactcaaaatttaaataacagtttttctaggggaaaggagtgggaggtggaggcagagagatcaatccatttgcctctcactccaggtctgagaaccctcattttctattcttcaaattaatgaaatgaacacaagaccactctgatgaggaagtctgaaataatggaaacgccgtggcatttgcattccctttcaatgtgaacaggctattttgatagttagcaaaaccaggacaaattgcctgagatttcatcctttgttgctctaaaatggctctcgggctgtaataggccatatcactgcaaaatgcacttacctttaaataggcaggcaaagtggattgtgttaaatataaaattagtgacatgttctctcaactcatggagtctaattctaattcaaaagacttctgctcacttcagacaatgcctgttccttcttgtttataacctcaattccaattttctgcaattcaaataaatcccacctacagccctgggctttggtctcacccacctctgccccagacaccaggctcagactcccaggccctctgtctgccccgcacgcctgccatgtctgagctcttgagcatgggtctgtactgcctaggaggctcttcaccaggtttccacatcacggatgcctcgtcaccatcctggcctgggcttaaacgtcatctcctcccagtggcttggcctgaagaactgctctgatgtcttcttccccacatttgcaccatgtttgatcatcttactctggctggttagtgctgttcccatcagaccctctccccaacactgtaagctttgctgggatcaggaccctgggtccccagtgcacactgggggaatccggctgcagctggtgactcaggctgcaggagcccatgcccagggcagtgcccctgaccagtggctagaaacagcatggcagcccacacctacagggcctggcagacacctctgtcccagcatagcttcacccctcccctcctcccccagctccctgctgcagcctccccagaccctgagatccacgcagctgtgaggagccctcagctctccctgcaggcctggagttggccggctccactgctggtccagccctggctcctgcctccagcctcactcctgggcatctacccccaacaggcaccgggtataatcacctattctctacctgctcatcgcacgcccacctccatctgcaggtctttatcatggtgtaaggctcccctgggtaaagttctccatgagcataagaggcatcttttttacaactgaatcccagcacaaacaggtctcaatcacaccactgccctctcatgagccaaggaacctgcctgggccagcccccgacggtcctggcactctgtgtactggacccagccccagcactggtggctgtgactgtctcctccccacagcatcacaggtgggtgagtgtctagcctaggagggtaggtctcagccaacctcagttcactgtgtcttcaggttgcattttcattgtagtgaatactcagaatggaataatgcaatgaagggctgtgtcctgtttcaaatggaccacaggtgccccttcccagtttgctcctttcctttttgaactaatggtagaaaattccctttacccttagaaactcaactccaacagtgatttagctacattttattcttaaggctgctcatagtaattcacatatccatgagagaaagaccaatttacttaatggtacaaatcttattccccatcacataacacagctggtcaaaaatgcattctttcaagccaagatgaaataattcccagaatgtcccttttagtcaaatttggctcttgacaagtctagagagaatccccataataggcttcaaaggctggccccacagcccccactggcagctggtagggattcccagtaggggaagcctccccagaccccttctctgctactggctgtccctcaaggggtctcaaggtctctcagacaccaaacacagactcctccatgggaaaaaaaaaaaaaaaaaacagctaccttctggccctaggatctgtgcattctcctttcctaaagcgaaccaccctcatcctctcataaagaaccaaaaagcacgtcattcacctgatggctctacaccaccaaccctgttactctattcccatgccctgcttctatgtatttgttgctgtaagacttcttactacccagcattacattgtcaatttgtttgtctgtctaccctctgtctatcctagagaatgtgagcttagagtgtacaacagtacctagaaacggatgaccaaggaaatctgctgaatgaactaacgactgtgtggttaccgtggctctagctggcatgccactttaggatatatcttgagttttaggaattcaggaattcctgcaatctttcaaagggatcatggggcttccctgattgcagaattcagcaatctatgagcgagtatctatgcatttcattgcctctgctttggaagagactgttgttctgtaataggtctggtattcattaagcctttcaaaaagatgttccctggtgcataggtcaacattgcaaagtgtttccttcgccttcctaaacaagcctcacataagaagctatgtgattactggatgtttgggtgattaaaaccacatccttgcctttcctcagcatcccttcacctgttcagtgtcccacactaatccacagctgtgcaatgtatcataaatcagactcagagtctctggaagggtcatgtgctgcaaattacagaatacccagatcacacagacacatccacatggtgcaaaataaaccatgaaggagaaaagaatctcactctcgcaggtttgacctgaagcatacatgacatacatacatagagcacacatgaataaccaaactacttccactggagttaaaccttacagctcatccatgctcctcaagcagagatcagaggacactggggcagggcagggcggtggcagtgcacatggagtctcacgaagcttgagaaacaatgccttagacggtgaaaaaagtcttgtgttaaaaactaacatttcaaaatggaattttggtaaaacaatcaagaagaaagcatggcagaccatggcccgagtgttaggcagactccaagactcgagtttctcaaaatgggagtttgtggctcccagggaatctcagctatgatccaggttgagaaactgctctaaacccagtgagacttgtttcctgcaactatttaactgtggtctgttttgagagtactgtacacctgttttcctttcctccccattttcccctcttccctatcactctccaggctgcgccctactaactccatcctgcttgacaaacgtgtttgcttctttcagtgacttttccctcccattttcttttttggaaagtctgcctttgtctggcatttgtgtttttaagacagcaagaaacgtgagctcagagatctgcatccactctgtgctccccactggctccggggtgggagcagtcttcccagtctgcaaaccctcaaaggggaagtaatataaatttcaaatgaggacaccctcctaaagaagcagctggacccacattttggtacatctgcctggcactcccaggaatgagcagtggggaccatgtttgaccagcatagtgcatcctgggtgatgcttggggcaaattttcagcactgcttgtttaatttttatgtttgttaatatcctttttaggggatgataaaacttacccaagccttcaaaccatctttatagtgtagttttataaattgttatttggttctaatcaaactctgtgggagggaaaggtggacataaaaataaggcccttggattctttcaagagaatgttgctgcatatatatatacacatatatatacacacatatatatgtatatatatacaatatgtgtgtgtgtgtgtatatatatacacacacaaaatgtaaatggaactctaaagatgctctttcactgtggttgaaagtaagtatcacatctgggtaagcaactcatcccagtttgccctggagttttcggttttagtgctggaagatggaagacctccatcctgggaagtccctcaggcctggttgctcatgctatttttatgaaacatgacagcagagcacaggcatctactgagggaaccattaagccctttgctactgatgagtcaaccgatgtactagagcagccaatggcaacaaagctagatctgggatctgggcaaagtagaactcaggtgtacaaggaatgatcctatctggtgatttcactcctggggtgagaacatgcagagttcctgccattccatcgggcagttcagatgtcggagatcttgccatttgtcattttctctacaatgtcaggaatcatattgtaaaacacctgacactgacctggagaagaaaaatgtagctgtttaattcatgtgtaacatactcagattatcttatatgttagcaatactccattaggtctcgtctacctgcaaagagccctgggtcccatcgctgaggaagcgcctctactcaccctccagaggacatggacttcctgaaggaaaacagcactgcccatctggcactggggtcaatcgtttttaaactttaagagaactttttattccccaaagacattcctatgcagaatctaatatataaaacagacaaaagtggtgttctgtgagcagagatttcttttataagttcagatgtaaaatatgtattacatattcagtcgagaacaaaaaggttggaaactggcattatagagggcagctgaagtcataacagcctacaaaaatcatctacttctaaatttaattttggctgcccagtatcaagaaaattctggaaacaggttttactttgtaattttaggataccctcaaatgaaatgcattcggaagcttgaaaacaaaatgcaagggaacactgatgccaatgctgaatcatgaagagaaaccaataaatgacttctccactcgtttaagtattaattacttgggagaaaatgtttttcaaacgtatctgtaacattacggaatttccaacgatgttatattttgaaatatcaatccagtctttagacagaatttcaaacggtcatatttactttgttttccatgctgacccctaacctcctgtccaagaactcagaaggcccaaaaagatcaaatggacaggaggtgggggccaaacaaaaatgacaatacaacttcctgcttcaatcttaaattgtcttttagacgttacattccacttcattagttatccgaaaccaaagtccatgaagctgtccctgacttttcctatcccttccgaacatctcccactagtgcaaaaggccagggaagaatcaggtcattgaaaagaaatgatggctttttccagtaaacaatgatttcttaaagcctaaagtctacaatggactataaagctttccctatcaagtacataagccaaaggctcacatttaaagaaaaaaaacataactgcaatattgttgcaactagctataaaatgtaaaaatttaaaaagtaaacgtctaaattactaaaataagctgatatttagattctaagaggagatcagtaaccatgctcaagatgatcctaaaaacactgtcttctattaattggcctgttttaaaagtaacagaacacttcatataatattgcatctccaacttctattcttattcaccattctgaaactagactgagaggttggataattaataaaatcacccctttcccctggctcttgattatccttcatcagggtcatgtttgtacttctcttgtcgattgtaatcatttatttgaaacagtgtctcagcagttcattagcttttcattagtgcctgtaggttggataaaatgtgcttgaatttccaaagtaaatgcaaatccccttggtaatccagcaaggacatgaattcccagaacattttcaagtaagacagctccaatcagaacttggattttagtgaaaaaagtggtgtcctcctgaatggcagagaacccacgctcccatccagtcctaaacatcaattctgaaaatgaccatcacagtttggcttcatcttcaacctgaccgtggtattcaggaatgtcagttacttaattacaaacaaggagggcaagtcaaaagaattcaacacaaattttaaaagccaatgtatcagctactcagtaagttaaaaatatggctgccaggaccccacctggacagtcaaactcagcagctccagccttgaacacaagagacctggatccgcatcctgcctccggccctgggcagctgtgtagacctacacatcacaagctgagcttggtgtctgtatcttcaaaaaaggaaagatgatccacagttctgagactgggatggagatcacagaaataatgaaggggaagtgccttgcactgtccccaacacatagcaggcctccacaaatgaccgctttacaaagatcacagatgcagcctccccagtgttaaagtatgtcctcagtggacagtcaaaatggactccccgtggctaactgacgtgtgcaaaacgaaagcagagccaggtggccatagttgggtgaggaaaaggtcatgttctctgtgttctcagaaatatattgtaaaagtgtcacaggacctccctttctaccatccagtcaaaccagttcctgttgtcagtgctgaaatagagtgtagctggaaatgccgcagctgaccacccagagaccccctgaggccagcccatgaagacagacttgtgatgtcctccttaaagaccatccaacccggcccctgtacctgaatccccagctatcctgtggtttgcacctttatgaccttctatccccagtctctccttggagtacatttttgttttttgctgaaggctgtctctcccaatcttcagattgcttttagaaaataaagttatccttttgcctccgcagatctcactggtcttttgttaacacccgtaagggaagatagaattgcaggactgaaatgcatgccatgagacagaggaacaggtcaaacaggttaaacagaaacacacatgaaacaaggttatgtactaaccagttgaggaaaatgaggccagaggcaacaggaacttaaccatgtacatgtgtatttcccctgaaggcaatggctcagtattcactaactgagtatccatgatgacttcataaaacaaaactgctgcaaatgatgagaactggcaatacatatatttcctagttctgtcccctaatagagcatagaagcaatgatacccaatagtaaggagctcaactagcaccctggttttctaataccaaggcttcagacgatccaatcactctgagctatgggaggacattctctgataaaaggagaaacacataagcagctgatggtaggggcagggaaagcatcagaatgtaagatgaaccaggagcatcttatagtgctagaaaattggaattacacacacacacacacacacacacacacacacacacacacacacacacaaacagtagagggtgggagaagatgaagcaggagccaaatggccaaaggtcaaataacttgagcaacaaaataaatacccacactattgaattacaacctaaaggccaaaataaatagacaggagtccatattaatgtcacaatgactaaattaacaatggaggaagagaccaattttccttaaaaaagaattccaaatcagaaatgtgaaaaacaaaggagggaaacagaaagtcacccccagaacaccagggtgattgctgctgggcccagatccactctagaatgctaacatcagtgcttgaaattttaagaagaaacaggacatttgcaaggcctggaagtatctcccccagaatatttattaatcactatggctttaactcacgtccactaattctttgacacgctctcccccaggaggcaaagcttaatcctcctcctcttgagtgtgggctgaacttagtgactggcttctaacaaggagtaagggaggggaaagatggtgacttcacagaggagacatctggcagacaccagcttggccaggtgatcaaggttaactcaccagtagtaagtcacatgttgacatcatgatatgatgtgatgaggggggtaccttacctctgtggtggtcttcctcatattcgtaactccagtctaacaatgagaaagcatcagacaaacccaaattgagggatattctacaaaatacctgatccatatacttcaaagtgtcaaggtcatgaaaaacaaggaaagactgagaaactgagattagaggagattcaagagatatgatgattaaatgaaacatggtaccctggataaaaagaccattagtagaaaaattggtgaaatcccaaaaaagtctgtagtttagttatttttagttttgacaaatgtatgatggttacatgagatgctgatttttgagcaactccccgcttctgtgttaaatgattaatacaggagtcccctcacttccttttcctgttctaatgccagataccagccaaagcacatcatttttgcatcatcctacatgtggggaaatattttttattctgcatatcatagaatagtatgcattgatcataaaattttctgcagtagacttgagttaacttttcacctataaaattacaaccctcactcgtttccaacattagcatgaagaaaatggttactcccaggtttccacatcttactggagaaaaccgcaattaatgtcaccacaaatatccagtttccaacgttagctcagctgccattctgtgtgttcctgttcctcaatcatactcaattcacctgtggttcccgtcctgcctctcaccacagggtcggctgggcccaggatgacaaggggcctccctgcctcttccactgtcaccatcctctgcctcagggctgccatcatcgctctccctccttttcctgaatcccagcaccactggctcctccagggcccgctccaggggttatcccctcccctgcctccactctgtctctactcagtcctcccacccatgagcaaacacagccacactgtctccccatcccaaaaaagaacgttcctcagttcctcaaaacattaaacacagaatgaccatatgatccagcaattccacttctgggtatatacccaaaagaacaaaagaagggagaggcatgtgtacccccatgttcacggcagcattactcacaatagtgaaaaggtggaggcaaaccaagtgtccatccacaaatgcgtgcattgataaaatggagtccatccacacaatggagtgttattcagccttgaaaggaaattcagacacatgccacaacatggatggaccctgaggacactgtgctgagcaaaataagccgatcacaaaaggacaaatatgtgtgactccacttctgtgaggtacctacggtagtcaaattcttagagacaggaagtagagtggtggttgccagagcctggggagaggagggaatgtggaattcgtgttgaatggtgactggatacagagtttcagttggggaagatgaaaagcgttctgtggatggatggtggtagtcatacgaaggtgactaataatcccccaaatgcccaatcccatcacccattctcagaactccatggcatttgacactgctaaccaacttctacagcattaagcccgctgctccccagctctcgttctgcaattgttgagggacagttatgcgcacgtgtgtgtgtgtgagaatatacgttatgaattatactgggtgtgcatttatgtacatatatgcatatagacgatatttttttaattccacttactgaacatctactaccattatcagaaattacacaagtatttacatgcatcatcccatataatccccccaaattgccctgtattgcttcctgactccatctacaccatcaccagttttttcttggtttctttgctggcattgtcatatggtggagtccttggggttctgtccctcctcatctgcccaggtgagctcacgcactttcatagctcaccgccatctctgtggtgatggctctgagtcttcctttccagtccaggcccatctgctgagctccagacaccacacccatgtgtccacccaacatttcccatgagcctctcaaagtcaggacagccaataccaacccagttctctctccatccctccctcccaattcctctccagcatctatgctccttgttttataacctctgttgctgttgtccccctgaagcaccaagggaaaggaaaagcctcctcactgggattcctaatggaagcgtttgcacacagtgaccctcccagcacggaccccttgttaatagatgggtaggaagcaccaggaacagagtatgttcaaaatcagataagcgttataaaaactggtatggggtcagagtggagatcattttccaaaccaactattcgaaccaccccatcgccatctgggtaaagactgggttgtgcctccagcaagctactctgacttgggaagaccgtgtgcaactatctttgggaaacacagccgcatgctccttggctggaaatgatcagaggctctaaggagtgtaaaaagggaacacaaccctgattctaatttttattcttggagaaatcacgttttatttttcatatcaaagagggggaactctgtgggcagagtactctgccgagaaccagttctgttctgcaacttgtcccaatcatcaggaaaacacatgttccagggaagcccccatcagggcacacacagccccaaatcagggcatgctgtcacttcctctcattccctcgagagcccacctggccaaagaggctccagtggcctgattggagggcacatcaataatatggagggtccccgtgccccccgacctggaaagtcagcctcagcgatggggctctcggggcctcttaaaatgggaaaaacagaagatgaaaaggctgtttgcacttgtcagcaatgctggcactgctcactatccatactttaccctccccaattaaaaccacacacttgatctgttcacataacaaagcctcccttagagcccccagaggtgcctgctcccaaaacagcactgtcagggcacagcctcagtcctcactggacagaaaccaggggcagggaccaatcctctctctgtcccagccctttcaaaccaaagacagcgtctctgcgaaggagggaagccgcatgttttcatgctgagatacagtgcagatttatgatcggcacctgtgaggtcctcaggtacctcttgctggaacagagcaacaggtttctaaaggttctggcccttggcctctacatttgtcaccactcctgtggtcactcttcagtggaagttgctcaccagcctccttgtcccacatgtaaaagccaaaaggaggggccctacagcaccactgtcattggaatccttccaacattccccacccaccttatgcagtgggaagacaaggttcctaccagaccctccaaagcccaggaacctctccctgtgctgacatccaaagatgcccggcgttccaaaacaccagaaatccagggaagaggccctaccttggggatgagtacattaggaaatagccaaggagcaggattaagtaattatacactagcccaccaggaaaccatgacactgaacatcccatggggcccacgggtctggtgggtgtttctcgcccactgggggctggataagtgagcatgagggtgtgccccaagaagtgtccgaggcagagctcaatcctttagaggtttattttgccaaggttgggatgtacccaagcaaaagaaacacaagttacagtagggtctgcggcctgggcttttctccaaagaggggtctgagaaagagcaagcaggaggggaaaaggagagaggggtgcccatgaggcaagtggttacatcctcggaggctttgattggcattcagtgaatctgcatcttacatataaaaagaaggggccgggcgcggtggctcacacctgtaatcccagcactttgggagggggaggcgggtggatcacaaggtcaggagatcgagaccatcctggctaacatggtgaaaccccatctctactaaaaatagaaaacattagccaggcgtgatggtgggcgcctgtagtcccagctactcaggaggctgaggcaggagaatggcgtgaacctgggaggtggagcttgcagtgagccgagatcgcgccactgcactccgcctgggcgacagagcaagactccgtctcaaaaagaaagaaagacagacagaaagaaagacagacagaaagaaagacagacagaaagaaagacagacaaagaaagaaagaaagaaagaaagaaagaaagaaagaaagaaagaaagaaagaaagaaagaaagaaagaaagaaagaaagagaaagagaaaagaaggggataggggaaaagccaagtatgcattcttctcaggctcagcaaatctacattttatataagcaagcatgtgaaatcacggctatccgttgcggggtgcgggataaaaaggaaagtggttttttgcatgactcagttctcaagcttaactttccctttggcatagtgagtctggggtccacagcttccttcttttttttctttttttcttttttttctttttttttttcttttctgtcacccaagctggagtgcagtggcttgatctcagctcactgcaaactccgactcccaggttcaagcgattctcctgcctcagcctcccgaatacctggcactacaggcgcccaccaccatgcctggctaatttttgtatttttagtagagacggggtttcaccatattggccaggctggtctcgaactcctgaccttgtgatccgcccacctcggcctcccaaagtgctgggattacaggtgtgagccatcacacctggccggcagatttcattttcctttcacaaatgcgtggtctactggacaagccctgagatgaagatggctagagaggctccacagtccctggaggggggcactggcaggcggtccacggccactcaggctgagaccctggctctagaaaagggaggaagtgcaggtaccaataaggtttaaggatggatgtatcagactgtggacaaagactaaaagaaacagggctgccagcccaatactgacaccttgcttcctcatagaatagcagatgtgttggggtggcaatgtgcccaactgctatggtctaaatgtttgggtccccccaaaattcctatgttgaaatcctaacacccaatgtgattgtattaggaggtggagcttttggaggtgatttggtgatgacggtggagccctcatgaatggaattagtgcgagatactgggatttacaagaagaaatatatatctgctcttcttgtttcctggcatgcagctcctaacacttggaatctccaaggtgatgtgtctttttgtgtgctaataagatgagtggtagtgaggggcttctggacagcctcaggatgggggctgattgccaagtgaaccaaccctgtgattagagcgttggaactttcaggcccacaatcccaccaccacccctcaccttagggaagggaagaggggccaaaggttgagttaatcacccaacaaccaatgatgtaatcaatcaagctatgcaatgatgcctccataaaaacctaaaataactggatttggagagcttccagttgctgagcacatggaggttcctggagggtggcgcccagagaaagctccacacccctttccacaaataagaggttaccctgtgcatctcctccatctggctgttcatctgtatcctttgtaatatcctttataataattgggtaaatgtaagcaagaatgtttccctgagttcttgagccatgccagccatcccactcctggagaagggagttgtgagaaccccaatttatagaccatcagtcagaggtacagatcacaacctgggatttgcaactgccatctagagtggaagcatctgagccctcaacctgtgggatctgatgcgaattccaggcagacagtgtcaggactgaactgacttagaggacacccagctgatgtctgctggagaattgcttgctgtatgggaaaacatcccacacacatctgggcgaccagagaagcattctaaattattgagagtgagggctggaaaaactgtgtttttctatatctcgaacagtgcccttataaattaagaggccgaagagagctagttcgccccttccaccaagtgaggacacagcaagaaggcatgatgcagaaggaagcaggccttcctcagacactgaatctgccagcaccttgatcttggacttctggctccagaactgtgagcaataaatgcctgttgtttttaagctaccgactctaaggcattttgttatagcaaccccacacggactaagacaccaactaacactcctttcccagaccacactggcttaggagtggccatgtgacccaattcagactaaagaggtgaggggggaagtctgctaggtggttcttggaaggtttttttttcctggaacaggttccccacgtttctgtttccaattcttgctgcctggaagacagacacgctacttggagaaatagaagccctgcagtaatcctgagacaatacgcacagagcaaagccaacatgccaaagttggccagcagaaaggaggaggagcctcggtccccagtggcaccatggggtggggagtgagatcatggctttttcttgatatacgtgtatactgtttcacctgtgcattagttttgtatggctgccacaacaaattacctcaaagtcagcagcttaaagcaacacaaatttatgatcttgcatttctgtaggttagaagtcccaaacaggtctccctgtggagactctagggctgaatccattatcctgccttttcccactcctagaggtgacccacattccttggttgtcagccaccttcctccattcctgacttccagagccaggagcatggtatctcttgagccattcttctgcagtcacacctccttctgattctcctcttctgcctccctcttccacttatgggactttctctcacccagataatccaggattacatcccttttcgaggtcaactgaccagcaatcttaattccatccacaaccttaattcccctttaccacataacctaacatgttccagggattaaggcatggacatctttgtggaggggggtcactattcagccaaccacaaattcttacagcaagcaaattccttttgttatttaaaacacaaatcaaataatttttaattaaaatattttaattgaatattaaaaattgggactgtaatccaataaatcaaaaaagaaagtccaacctttaaagcacaatgaatcaagaatgctaagatttccatggagaaaagaagtcattctgggattagatgagaacaggccccttctaccacctctgctgatcagtgggcatgcctttactcataaaaaacagagtacagggagctctgcatagcacagtcttcgccaggctgaggctgcttcccagctcctgtgtgtctgactgggctagtccttcacatcccatgcaaaaggttgaatttttttattttctttgagacagggtctcactctgttgcccaggctggagtgcagtggcacaatcgcagctcactgcagcttcaacctctgggcttaagccatcctcccacctcagcctcctgagtagctgggactacaggtgcatgccactgggactacaggtgcatgccaccagacctggctgatttttttttttttttcgtagagatgggggtctcgccatgttgcccaagctggtctcgaactcctgggcacaagtgaccttcccacctggctttgaatatttttaaatttactttaaaaaatgggcttggccgggcgtggtggctcacccctgtaatcccagcactttgggaggccaaggcaggtggattacctgaggtcaggagttcaagaccagcctggccaacatggtgaaactccgtctctgctaaaaatacaaaaaaaattagctgggcgtggtggcaagtgcctgtaatcccacctacttgggaggctaaggcaggagaatcacttgaacccgggacgtggaggctgcagtgagcgggattgagtgcactctagcactgcactctagcctgggtgatggagcgagactctctgtctcaaaaaaaaaagggcttaagcaatttccaattatttaaatttttttgaacttaataagcccaacaagatctttctcctttctaattaatgctaccaggtgagcatcttgaaaaacagtggcctataggtgggtcaccattctccgttgacacaagccctcctacaacagcacctcggggagggagcctcaatgggctccagtgcttcacctatgatgggattctgtggatttaaaacgaagacacaccactgaccttcaagaatctccctggcagatatctcccaaacattcagtcctgatacaagtatcttcataactggaattcacctacttccagaacgtcaggatgagtacccaggacagctctgactgcctgttgcttaaaaccatgcccaggtcataaagccctcactgtactgtaccctaaatgcacttaagcgactgttttctacagtgtcctagtactgaatgttgacactaacctatgaaactaagtgtcatacttactgtgaggcagagaaaccatcaactgaccacaaggtttgtttcaagaacaaatcgagacgaaccaataatgcagaggctaaatttttcaaatcaataataatacagttcacatgcaagagcttttgaaaactcttccatatgataaatatcacatcacatcggtagagatggaaattagattgctcaaccaggtgaatcaaatttaatccagctttttccatcctgttttctaaatatcttgtattattttaaattagttttgaaaaatcaatctgaaagtataaaagatacaaatgaaatctgggtcttggagcccctgggtctaggagcctgattccaagaacacatttcacctgcagctccaaccaggggtctcttcccaacccctggcctgaaggtctccagcctgggatggagcacctccttccttagaaacaaacactgttactgcatctacatgaaatggctcaaaagagttaagagagaatgttgcgatcactgaagaatggtctgaatgagaaagaaagagtagtggacatttaaagcttaattgccagactcagcttttcccttaatcagggaaactgacctaatgagaacagaggggtctctgtgaagctgccaagctcaaaggaggcaaggcagcataaagagacatctgaaggcaggtgtgacatccaaactaggagaagctcagagaaagaagcaaccagggacaggacaacctccatgaaacgatgtgtttgagctgaggtgctggccatggtgctgacaggggtcagcttggggaggcccagggaggtggaagatgaaggcttgatcactgactggatagaaagacagggacaggaagaagaaggagcttggcaggtgaagtgcaggcacaaatacctacccttctctgctttcggaatgtgatgaatgtgaatgatcaccctttatgtcctttataggacaaaaacctcagcagaataaataaccaacatgttagtcacactaaagaaccactctgaagcacagaagaataagcagagtaagatgaacaagacaaaaactttaatattaaagaagaaaatagaagtttgttacaacaaaattacaccaaacttgttaacagaacaatgtggcagcttaagactcaagactttatttttctcatcctcaaaggtccacttcatggttttaattagacaaacattttgtagagtactataattctctatcttttaaatacacattcacattatggtgaaattgggaaatcctaatatttacttgtattaagaagtgtttaagcagtccctttcctctacaaactcaccggtacctgttgttttttgactttttaatagaagccattctgactggtgtgatatggtatttcattgtgcttttgatttgcatttctctaatgataagtgatattgagcattttttcataggcttgttgactgcacgtatgtctttggaaaagtgtctgttcatgtcctttgcccactttttaatgagtttcttagttttttgcttgtacatttgtttaagttccttgtagattctgaatattggacctttgtcagatgcatagtttgcaaatattttctcccatcctgtaggctgcctgttttctctattgatagtttcttttctgtgcagaagctccttaattatgtaccatttgtcaatttttgcttttggtggtgttgtcatgaaatctttgccagtttccatgtccaaaatggtatttcctgggttatcttccagggtttttatagttttgggtttttacattttagtccttaatccatcttcagttgatttttgtatatggtgaagggaacgggcccagtttcagtcttctgcctatggttagccagctatcccggcaccatttattgaatagggagccctttccccactgcttgctttgcaggtgggggtgtaaattagttcaatcattgtggaaagcagtgtggcaattcctcaaagagctaaaaacagaattaccattcagcccagcaatcctagtactgaggataaacccaaaggaatataaatcattctatcataaagacacatgcatgcatatgctctctgcaacactattcacaatagcaaagacactgaatcaacctaaatgcccatcaatggtagactgggtaaagaaaatgtggtacatatacatcatggaatatgatgcggccattaaaaagaatgatgttcctgcaaaggaacatagatggccattatccttagcaaattaatgcaggaacagaaaaccaaatactgcatgttctcacttaaaagcgggagctaaacaatgagtacacatggacagaaagaggggaacaacagactctggggcctacttgagagaagagggtgggaggagagagagattcaggaaaaaaaaaaactgttgggtactatgcttagtactcaggtgaggaaataatctgtacaccaaacccccaagtcacgaatttacctgtataacaaacctgcactgaacctaaaataaaggttaaaaaaaaagaagtgttaacagctccaaataagtaagagtaactgtccactccctgcagttgttcccactgagcctctggtggccccaccccaatccctatggggtctagaaagagtgccccggtctccctggtccttcgctgatgatggggggtggcagctctctggccggccctcggccctcggccctcgcctctcgcctgttaggtaccctggacttctccacatccttccccaccccttctcgcctctcccacaggagtctgcaggaccaggccagcaggtggctcagctgagcatctgcagacacagcacaccgaccccacagagaaaaggcactcccagaccactgtcacagagagctcatgtcgggggcgcgaggggctgagaggggccagtcacaagtcaggcaagtccatacagggacacagagagcaggcagaggtcagggcagctgtggatgactcggggcgtgactgaaatgcatgaaaggatggttcaagaacagcccagcagctcccctctgcccaccacgggagggtcttcactatcagtgaggaattaagactgcaggcagcgaagccccctccccaccggaaccttgcagggctccctcgaggggccaccactcctatcacagccactgtcctgctcatcccagtgaccttaggggccccacccccctgcaagtcctgctcactggcaagcctagcttggaggcaacgctcggggcaaagccagagggtcctccccaggccttctgtgcagacctctgcgaagaatcctgctcagcagtagatatttattgtattttaatatcagggccaaaagctacagttcgcttttcagttaagtaaatgtgtattcactaaagggttttaaaacctttttcctgaaaaaaatgttctagaccatcaaatgcctttttatattgttaacttttactcatttaaaatgcatgttttctaagccacattttacacacttttctatatagacaactctcaattaattccctaagccaaacccagaaatgtttaacacacactttattgacactaaggcacaaatgatgagtggcctctagtgttacccacaaccatctgctttctcagcagcactggcacctggtgctgacagcccctcacccacccccatctcccattccccatcccagagcaggcaagaggggaagtggatattgggaatcctgagagagcagggatttggggcaagcagtaaccagagaagggaagccatagcccttcaccctcgtcagctcccagaagcctctgaaacaccaggaaggaggcctcatgccacatggtatggaatggggctcaactaatgtgatgtggcgaataagcagaacacgggctgcttggctgtttcatctgcttctgttttcttggtagtatctggcctatcagagacaattataccacaccacagtcacagtcctacctgcctctgagtcctaagtgcagattcttaagaagaacagacgggaatcctttagcgtcacagggtaggtgtgagtctgcgctccaggctccagagatgcttctgcaagcatgctgcccaaatccacgtcttttctgctactgggagctctctcatctttaaaatacagaatgcatttctcatatctgaaggaatatatttaactggtgtctcaacataacacttaaagcaaaacccaaaagcagagggtggggggttggggggagtaaagagcagccatatcccagtggaggggcaggaggaagagaaagaaggcctcaggagacctggtcaggccggctgagcggcaggggatgcaggacaagcaggcagaaatgagtggaaaagctgagagaggccgagaggaaattaaaccggaggaggcagagccaagtaacgagcaaacatgaaaggaaatgcctccctgcttcctgccctttctaaaatcacctcgaggcaactgaccacaaatagtcttctatcacaataaaaaaggagatcagaaatttcccggctgtttagtggcctgccaatgccacaccacagtcaccggccttcactgaacaccccggtgcagggggagagaatgtaataacttcttaagaatctgcacttaagcctcagaggccggtaggactgttactgtggtgcagtgatcacggtgctgcaaggcacggcaggacaatttcacagccctgtcctggaagtggcggaggggaggaggactgtgcctcacaagcagtgtactaacccagggatgaaaagcacacatttacttaactgaaaagtgaactgtagcttttggccctgatattaaaatacaataaatatctactgctgagcaggattcttcgcagaggtctgcacagaaggcctggggaggacctgctagctttgccccagcaaatacagagcatagacacccccaccggccagagtgccctgggctgggctgcacacttcctgttgatttcttgtccaattatctcaataatacatcctcaaggaaggaagtggagaacacacagaaaagaagaaaagaaataacgtatatcaccaccaggaaataaccactgctgctaatattttgatgtgtttccaatcagactttttttttgtacatgcacattgtacaaaattggaatcctactgtatagcaggaatcttgctgtgttcatttaaaataacatgagaccttctccaggccactgaatattctttgaaagcacggttttaatggccacagaatctgggaatgacatagtataaccaccctgctattattaagatattcaagctgcatccaattttcaactatgataagtaaagcttcagtgagtctctttacatacaaatgatactgacatctccgattttaatataaacccttagaaagaggatgattgagtcaaaggtcacaaacacttcttttccagaaggttccatcacttgacatttcctccactggagtatgagagtattcatcctccagcactcacccatactgagaataattatgagactgcaccagtttggtggacccaaaaacaaaaaagaattttttaaatttgcatttctctgattacttgtgaggtttggtacttttctatttgccttttatttttcttcagtgacttgccaactagagtccactgcagattttttccatttgatgttaatgttttcttattgatttatgactgcttttagtataatagggatggattggcaggtggacagcgtatgtcctgatttaccaattctgttgatgctgtttgacacacacaggatgctaatggatgtgtggtcaattgtatcaatctttccccttattatgacttccattgcaagtagagtgtcatggcccttcagcctgggatccagactcagctcccccactcactatctcagtgaccctctctttgcctcaatttccttgattgaacgtgcaggataatgagaatgcatttaatccatatagttagtatgtggcacacagcctcagagatggccccaatgccccccacctcctataatggcattcacatgtgatccctgcaggtccagccagcaggggccagggcctgcgaacagccacggagtgagcttggaggtagatactccccagtggtccctggagatgacgcagctccagccaacacttagtgagatcctcagccagaggcaacctgcaaagctgtgccaagattcctggcccacaaaactgggaagtaatacacattcgttgctgtaaactgctacatttaagggtgatttgctatgcagcaggagattactaatgcattatacacgtaaagcacttagaacagtggctgtggcagatcacacaaaaaaggcctaacacgttgacagtcctcccatggaaagaggaaatccgtctccacctggggtagctcagcttgactgtgtgatttgctctgaccaatggagctgtggcaaacgtgaagtcacctacacacaggagcctgcctcttacaactcctgaaactctgctgtctccatgtgaagaagcccagcctgctgggggatgagactacaaagcccatcacccctgctcaccccagtttacaggcagccatcctgacaatgcagcccatcacccctgcccgccccagcttacaggcaagccatactaaccatgtgaggccatcaatgcacgaccatgaatgagctcagcaaagagagccacccagccaagcccagcctgaatttccaacccaaatcacccactgagtaagtagttgctggtagaagccactatgttctggaatagtttgttacacagcatttgatacctaatacagctgccattattactactattattgtcttgggatcagttacatgatcatacatatttcttaacagtatatttatgcttttactttttaatccataggaaacttatttttgtgtatgatattaggtgaggacctaacaatgttttgccacacagccagttctcccttctccataaaactgcaacaccttgttttcacatattagaatccagagcaggggctcccaacccccaggccaccgaccagtatcagtccatggcctgttaggaatcaggccgcactgcaggaggtgagcagtgggcaagtgagcgaagcttcatctgtatttacagctgctccccactgcttgtgttaccacctgagctttgcctcctgtcagatcagcagcagcagcagattctcataggagcatgaaccctattgtaaactgtgcatgtaaaggatctaggttgtggctccttatgaaaagctaatgcctgatgatccgtcactatctcccatcatccccagatgaaactgtccagttgcaggaaaacaagctcagggctcccactgattctacattatggtgagttgcataattatttcattatatagtacaatgtaataataacagaaataaagtgtacaataaacgtaatgtgcttgaatcatcctgaaaccatccccaccccctccctgtccatggaaaaattgtcttccatgaaaccagtccctggtgcccaaaaggctggagactgctgatgtagagaatttggtgatatcatttccagtgatcatttctattggtatagtattaatagtaaatcttgacccaataccatacagctggtttgttttcattttgtcaggataatactgcatgttctttccactgaggcatggcaggagaaatgctcactaatctgactgcatggaagaggaggggtagtgaagttgctggggcaggtgcaggaggagagggagagcagcaacatgaatcaagagacagacacagtcacagtcaccaaagggatgggggtgacgtcaaggctattttttgtctgaaacagaaacaaaacctgccctaactttctaagtcagtcggctgccaaattccacaagctgattctgagcagggcactaggccctgtgaaggggttggcaaggtgcaaggagcatgtgggacagtgccccctcccaggtgttcacagccgcagaggggagacagtgccacctacgaaaccctggagaaaatatgtataaaccaagatgaacacaaattaatataatacaaataatatagaacggaaggagagcttagaagccccacaggtcaatcatggatggctacttggaggaaagttttcagatcctgaggagtaagatcagcaaagagtggtgtgtgcaaaggcaggaggctggaacacataattcatgtggactcatcagttacttggttagcgtaaaaagtctataaacaggtacactatgcagtgaggctgatgaaggcataggggccaatctgatggaagatcttcagtgttaggtctggtcttcaagagaaatgagcaaacaatgtgtgtttttaggtaataagagtaggaaactacaggttgtgcaccttcacagggccccgtgttcttgacacggttctgtgacatatgcagcattccccagtggctccagcagaaggaactgccttccctagaattctcaaaaaggagcacgacttcccaaaggaaaggaagcacagaagccggcatggttcccaggggaagatgcctgagaggccagccggaccccagccctctcacacatccagtcggaatgtccctgcccctgccatcacttggtgcagagcaggcatgggccagctaagaaaatgacgtctttgcttattttcaaattgtactgaataacagctttgagcctcaacgtttagaaatgaaaatacaagcatgagcaaggtcctagtctaaggatccatccacagctctcaggagagcaacatcttctgtgtcccttgcagagtcttccatggtgggaaggggctgcactgtgcaggaaggcaggccctggccctggtgcctgctggaaaggggcatcacgagagacaggtgctcggggcagaggctcagctgcagtcacagaagccctgaggcttggacagagcctgtcctgtcagcgctggcacccgctgccagggcccagttatactgcctgttcctttggctgtgttaatgagggcctaactagcagtggaggcctcacttccccatcagcatgaagctgctaagtgtcccccaaaacagtcgaaagtgtcacacgggagagacacactcgagagaaacttctgctgccccttgggttccagatttgcagtttgattttgcttgcctccatcaaggaccacacgaaccccaaattccaaataagaacactgcaggccagtgggaacctactgcctgtagcctgcaggatgaggcacggcttcctcacacccgaaccaagaggaccagctgtctcagcccacagagcccaggcctggcaaggagctggagcctgtatgagtcaggcctctccacagaaacaaaactgataggacacatatatcagaggaaattcattatgggaattggctcacacaattacagaagctgagaagtcttatgatctgctctctgcaagaggaagacccaggatagctagcatgtcggtcagtctgagtctaaaggcctgaggacagggtccaaaggcccaagaaccaggagcaccgatgtccgaaggcaggagaaaatgaatgtcccaactcaagtagagacagcaaatttgcccttcctgtgcctttttgatctatctgggccctccacagattggaggatgcatgcccaaactggcaagggcagatcttctttcctcagtctgctgattcaaatgtttatctcttcctgaaacaccctcacagacactatcaggaataatgttttaccagcacccctagcccaggcaaactgacacataaaattaaccatcgcagagccacgggcacggtagagaaggaaagcaatcctgagcccaccaagccccctacccaatccctccagctcttctcaaagcctccctgcccctcctcccaattttggagcttccgatccctgccctggacttggaggtgacccaggagtgatgcactagagataagccaaggtcatggtcacgcctcctctggatcctcagtcgacccaacttctccagcaccataatgtcaaacaatcatagctaatagtacatttttatatgaaaaaggaggattctctgctgaggataacacatgcttgaacacaaacgtttttttctggtttgtactcacgttcactttcagcagaatacgtctcctctgactcttcaggaaaccattccctttccttaatggggtagtattttttccacagactccttggtacattttctgtttgctttccctcacacaaaggagacttatccagagctaggacttgctaatggcaggcgtggattcagcaggtgtccggtgctgattcccacatgttcccaggcgcagagcaagaggaacagacccaatctccagggcaggcaaacttcaccaggccagctgccacacagggttgacaagggattgttctgcacccactgactctttctccgacccatccaatcaacaggggtcccaagaagctaagatttccattatttcctgctgcggggctcagccagcctcccgcaccactccatgcgtccccagccagactatcagtcctggtccttctgagcaacccagctgtttcttaagaatgcagtttcaaagagaccttcaaagatggggtgcaaggacagtcatctggcccatggcctgtggagaagtggcagctctatgaaatcgttggtgtgacatttcctgggagggtacatttcctgggaggagagatgagtcccatcatctgccctgaggacaggcactcttctctagggagcaatgtaagcaaggccagttccaccatcctcatagattatttctcacccttactgtaagaggtcctcaattctccagtcttcacaggtacagtagtttaatcaaactaggagttgtacatgatgttatataaagattatcgccaacagccagttattatccctaactccctcagagactaactacactgacattgagaaacgttaggtgactctgcagggttgtaagccaggagggagtgaagccaaggtttgcatagtgccttggccttctcctgtgagccccacatgcagcacaaacttggcccagaaagcccatggactcccttctcacactctatgtggggaatccaacctttgggaggtgactcttccattaacacagcttctaattcagttaattacttgacttgataggttagttccctttgttactacaaacaccactacctgcaagctatggtaatattatcatgcttcattaaaagttatcaagtgatctactttctaatagaggtataaacacctaaacacagctatttcaggccagatgaggtggcttacacctgaaatcctagcatttttggaggccaagacaggagggttgcttgagatgagaagttcaagaccagcctgggcaacacagcaagaccatgtcacaacaaaaaacattttttttttaatagctgggtgtggtggtgcacgcctgtagtcccagctactcaagatgctgaggcaagaggatcctgtgagcccaggagtttgaggctgcagtgagccacgatcgcaccactgccttccagcctgggtgacagagcaagactctatctcttaacaacaacaaagacagctatttcagactaagcctttaactttaaaaatatgaaacaatgtatgtgtcagttacgattcttaaatcattatgtctgcctgggtgcggtggctcatgcctgtaatcccgacactctggaaggccaaggtgggtggatcaccttgaggtcaggaattcgagatcagcctggccaacatagtgaaaccccatcactactaaaaatacaaaaattagcccggcacggtggcgcgtgcctgtattcccagctacttgggaggctgaggcaggagaatcacttgagcccggaggcggaggctgcagtgacccgagattgtgccactgcactccagcctgggcgacagagtgagactctgtctcaaaaaacaaaacaaaacaacaacaagaaaaaacacaattcttaaatcatcacatctaactggagtcaagtcattaacacatttgagaaatttagcaataacaaaaagattattaggattcttctaagctaacaattctaaattctaactacaaaaccaaatgttctggcttaccacaacagagaataacatccaagccactatcacgtcttttccaattagtaagccattggtggtgtgaataaaacctagaagtcaattttctacgaactctagcaggaagaaaagtgattcagctttacagttatcttctgacctgtttttagtcttcatgtaacaaaaagcttgtcaagttacaattttcttatagtgcctcactatagaacatttattctatacaaatgggattttctcaagacaataactacggcatcaacacgaggatgactgtaagacatcaatattttatctattttcatggatgttggacatgcccaacactatcccattttgtaaatgtattgccttgctctgtgtgatgtttgtgataaatgtagtgtcacagaaagcctccatgactgttatttcccttcattttataaatgccaagtttatttaaacctactgtcacatgactttgttaaccaaatacaactgttgaaactgttctaaaacaatgcttatatcagtatcaacacaccagaaaacatgagttgcttctcaaaaaaatttctgatggcccaaaatatcccaatattttgctcaagaaaggtaatttttcatttgatggtgttgatttttattatgataaaatacacagaaaataaaattttccattttcaccagttttttatttttttatcattttttgagacggagtcttgctctgtcgcccaggctagagagcagtggtgcgatcttggctcactgtaacctccgccttccaggttcaagcgattctccttactcagcctctcgagtagtacaggtgtctgccactgtgccaggctaatttttgtacttttggtagagctggggtttcactatcttggccctgctggtctggaactctcgaccttgtgatccacccgcttcggcctcccatagtgctgggattacaggcatgagccaccgtgcccggccatcattttcaccagtttttaagtgtatggttcagcagcattgagtacatttactgtgtttgcaaccatcaccaccacccatcttcagaacgtcttccaagactgaaactctgcacccactgaacaactccccattcctccctagccccgtccctggcaaccaccattctattttctgtctctgtgggtttgactactctatgtccctcatataaagtgaagtcatacagttattcgtccttttgtgactgacttatttcactcagcaccatgtcaaggttcatccatggtgcagcatgtgtcagaatctccttcctttttaaggctgagtaatgtttcatgacaggtgtaaaccacattctgtttacccattcttccatcaatggacgcttgggttgcttccatgttttagctattgtgaatcatgctgctatgaacatggctgtgcaaatatctctttgagcctctgctttccatcctttgagtatatacccagaagtgggattgctggatcacatggtaattctgttttaattttttgaggaaccactactctcctttgttcagtggctcacacctgtaatcccagcactttggaaggctgaggcgggcagatcaccttgggtcaggagtttgagaccagcctggctaacatggtgaaaccccgtttctactaaaaatacaaaaaattagccaggtgtggtgggccacacctgtaatgccagctactcgggaggctgaggcaagagaatcacttgaacccaggaggtggaggttgcagtgagccaaggtcgcaccactgcagtccagcttaggcaacaagagcgaaattcgatctcaaaactaataataataataataatacaattaaattcctcaagatgaaaagtggtggccaagtgtctggtgtactctgcaagttctgagaatcactaggagtcccatcacaaccttttcagcaaagcaatattctctctgggcatgacccctatgtccagaggacagtgtcaacccaaccaggctctgggcaggtggctgtagcttatcacagaaaaaagaaatcccaccagtgagaaccctctacaataaaatcagaaacagactcctaagatatgtagtttctactcctgttgatagtttttaaaaataatgaagggtaggaagttccagttaatagtgataactcgatcttgtgcacctacctctctcctgcctcctgaaaccttggacacactcggacaagaagatgaggaggtgcctccaggggcaggagagtccaacagccttttcaaagccttaacatggacataggaatggcgactgagatggcaggtacatggagggggagtgacgaggctcaggctgattcccctgcagaacttaggagcctgtgggttggagccactggggccccaggaggcaggctgcagagacacccaccaggctggaaaccaggggttggaaagaaggcttggcccaggcacttccacctgtctcatgaagcactgtgaccacacacctcagaggatactgaaacccagtccctggagaaagtatcaggaaaggttcagcggcccagggctgagttcagcaaccgatcttcaccaggtccaggggctgcttaggggatgggagttttctaaaactgggcatgtggctgcacaattatacaatgtattaaaaaatcattgagccgtagatttacaataggtgaataggacagtctgtaaattatacagcagcaaaactttaaaaatgcacagatgagagagagagacggaagtaaccaaaataccaaggaactatcaatgtggcaagtttttgatttttttttcctgctacccaacaaaatatgagtctgagaacaagataaggtgaattattttaaaaaataagaaatgatttccatgtgacacagcaattccacttctgggtacataccctaaataactgaaagcaggagctctaacagatatctgtgcacctatgttcacagcaggattactcacagtagctgcatggtggaaataacataagtgtccatcaatggcagaacagatatacaaaatgtggcacagacacaccatggaatattattttgctacaaaaaggagggaaatattgacacatgctccaacacggataaaccttgaggatgttacgctgagtgaaataagccagccatgaaacgacacatactgcaagatgccactcatatgagttgcccagagtcatcaaattcattgagatggaaaggagaataggggttccaggggccggggagaagggagatcatgttcaatggggacagttttagttgaggaagagggagtcttctggagatggattgcggtggtggctgcacagcaatgagaatgtacttactgccactgaaccgtactcttaaaaatggctaagacggtaaatgttatgttatagatatttcaccatgatactaaaaaaaaaagataaggaatgctatttttgcacagaaaagaataaagaaaagaaggacagctgagaaacgtggaagtgggtgtccctgcaactgggggcacctgcacagcatggggcaagaacagccactttcattaccagcttctcaacacaatttcactttgactctgttatatactagacagatttttaagcattaattttaaaacatgatggagagtggcggagatgaagagaaaatcaaatcatggaagctacacaccaataagcctgatgtcaatcacaggccagatctgagaggggactatcagagcagaaggctcgtgagtacttcaggaagcaagtgccaggccaaatgcatcttgatttctcttttaataaggttatgagattggcatattagagaaatgctgagcagatgagggcctttatttcagcaagaagttaacacagtcgctcgtggaccctatgaagaggaggcgatgtggaggggccccctgggcagggggcagcgaggccgctcatggcacaacctcggaaacagcaggagcagttggtccagccacagagctccggcccagcctggatgcaggacggggaacttgtttaaaacaggctgacaccatcgggcctgtaccctcagagacgagcctcccaatcaagatgagatcatctcaacaggctggaatgctaacttttaaagcgaacagatgaatttatcagtcttacaaatgttccgcaatttggtaccacaattcattaactgccatgagctgtaggacacagtggaaaggaaaaaagcatggggctttagaggaggagcagccccttcacctgaggcagtgacgatgcggttgggagctgcccaggccatagtggaaaccacccaatgtctgcccccgatataacccccactcagcactggtgccatgtccaaagtgacaagatgcccagaagccaccagatgaaaactgggtgaccagccttcaaatgtgcaagcagaaaaaagagctatgcagggaatggggtgcagaagtggttttctccatttgcagaacttcaatgttggaagggaagtaaggacatttcttggttctccaggaagagccaggcaaacagaatcattgtccaaaaatagatttggctctagttaaagctgcctgacaactgagccacgtgacactgcaagctccccatccccagctcagggaaacggagtgcccacacatcagaaatgccactgaaggactgtgcactctgcagaggattgacttaagtggaccataaacaccttctgataccctacagtaaaagagtaacagtgatgaaaataacaacttccatttgctaagtcctgaccgcagccaggcaatcctggatgtactctaaaggcttcctgactctgagtctttgattctcaaattgtatggtccattataaatacaatcaacaatcaaaccccaacataaagatatttaacataaatcattagttctttgggatgacagttataaataatttttataattctttaaaaggaagagtctatcaagtttataataaaaattgcctaacactaacatttaattagtcctaatacctgaccgacttcttctttcgagacatcagggtatacctaacaatgttcagatttgataaggtctcgaggaagcaggtagctcctttgtttgtggcctgagatctggcattgctgaagctagattgggccaggcctggctctgccaaatactgatgaactgccaggttcattcatttatccaacaaatatttactgagtgccagttatgtaccaggtgctgttctctgtaccggcagagagggcaaccagcccctgaagctggaagcatatggtttgaggatcaggaaaaccaagatgatggcatgatggagcgaggcatgagttcagcaggaagggccagtgagagcagctccgagcaacagtgcctcaaagggcaggttaaagaagaaaggaggggagagcaagaaagcagtgagagagactacacaagagaacaatgatgtctgctttatgtttctgtcatggtcactctggctgctgggtggagatggtcagcagagaagcaggaaagacagaaaagagaccagccagcaaggtagacactgcagcccccaggagagagcccaggagaggacgctgcagcccccaggggaggacactgctgcacccaggggagggcccaggtgaggatgctgatggccccaggggagggtccaggggaggatgctgcagccccctgggaagagccgaggagaggacgctgcacccccaagggagagcccaggggaggatgctgcagcccccaggggagagcccaggggaggatgctgcagcccccagggtagggcccaggggaggatgctgcagcccccaggggagggcccaggggaggatgctgcagcccccaggggagggcccggggaggatgctgatggccccaggggagggcccaggggtggatgctgcagcccccaggggagggcccaggagaggacgctgcagcccccaggagagggcccaggagaggacgctgcagcccccaggggagggcccaggggaggatgctgcagcccccaggggagggcccaggggaggatgctgcagcccccagggaagggcccaggggaagatgctgcagcccccagggtagggcccaggggaggatgctgcagcccccaggggagggcccaggggaggatgctgcagcccccaggggagggcccggggaggatgctgatggccccaggggagggcccaggggtggatgctgatggccccaggggagggcccaggggaggatgctgatggccccaggggagggcccaggggaggatgctgcagcccccaagtaaaactggagctcctccagaggaacagcagcaggggtggagggagggaatccagcctgggtgtgtcctgcggcaaagcgatgggcagggctaaaggaaaaggagaaatcgagatgcctctcaggctattggagtgaacaatggacaagaaaggaagccatgttttaaagatgtgcttaggtagtgttccacccaaagttcaaatccaagtcactgccaaaatgcaaaatgcaaactgccagacttgtggtctgttcatctatcagtaaacagggatgaataaaggcagaacatgcctgttcccttcagaaactaaatggctagaataaagtactgttccatttccagggtggctcagctaaaacgccaaggaaacggccacctgagtgttcgatgggaacacagtgtgagatgcaggttaagaggatgcttttgaaggctgcagtgctttgtggttgggctgtcctagttataggcccttccaaggctgtgtcaaagagattcaatgcacagagaccacccggtgaaactaccacatccccctgctttcatcacatcactccttagaggaacacacgttactctgaggaagttgaacatccgtagcccaattaagaccatctatggccaggcacagaaggcagtgtccagctctgttccccttccagactggcctttctgcagcatgacttaccagccttcaatcacactctgtttctgctcccctgtgcctaacttggggtacccacaacccactgcccttctctgttatccactggatgaaagccacccagcaatcatggctagctccagctctgcccctccctgaagcctcttctgattgttcctgcctccagatgccaaacaaaccgctgcctaaagaccttgcaccacagcacaaggctcacagctctttctcctgcaagtggatggtacgtgccggacagaagacaagctgcttgaaagcaagatcatcatgcattgtttttattcccccaaagaacctaggacagtgtttccaatactgggagcaccctccttccaacagtgatcgactgtaaagccataaatatttctaaatgtatactgaacataattaagaaattccaagacagcaaatattcattttataagctggttctgggggtgggatctaacttgcatcactagaccaccaatggtacctaaatgtgaatgattaagaaaagacaggctgggcatggtggctcatgcctgtaatcctagcactttgggaggccagggtgggcagatcacttgaggtccagagatcgagaccagcctggcgaacatagtgaaacctcgtctccactaaaaatacaaaaattaggcggggtggtggcgcatgcctgtaatcccagctacttgggaggctgaggcaggcgaatcgcttgaacccaggaggcagagattgcagtgagccgagattgccccattgtactccagcctgcgcaacgagagcaaaactccatctcaaaaaaaaaaaaaaaaagcaagacagataatccaaatgaacatttgcagggttgattaaactaattaaatctttaatagtgtctgaagttgcttttcaattattaatttggatgcatttttgttaaacttctgaatatgattttaaaatatagttctaatcattagccaacacatacatttttaacaattatatgataattaaatctgttttgaaactgttgaaaattttcttatgtaaccccagttttcagggcttcaagcaactgtggagctacaaaaaaaatatattaatatgattttttaaaaagttcttccaacgttaaggtaacacacacaaaacctgcacaaaggccaccagagcagccccatgcagccaaatgcagtggcctttcttccctagggctccggcttaggataaggctggaagagcatccgaggtggttccaccccatcccgatagcccccttccagaaatgctgacacatgcaacatccaccaatggatgaacctcgaggacatggtgctgagggaaatacgccagtcacagaggacaaatcctgcaagattctgcttcttttttgttttgttttgtttgtttgtttgtttgagacagagtttcgctctgtcgcccaggctggagtacagtggcgtgatctgggctcactgcaagctccgcctcttgggttcaagcaattctcctgcctcagcctcctgggtagctggaattacaggcgcacgccaccacgcccagctaatttttgtatttttagtagagacagggtttcaccatgttggccaggctggtctcgaactactgacctccagtgatccacctgccttggcctcccaaagtgctaggattacaggcatgagccaccactcccagccgcatgactgcacttctatgcagtacctggagtagtcagattcacagagaagtagagtggtggttgccatggcgggggaggggaaatagggagttggtgttgaatgactacagagtttcagcttgggaaggtgaaaacgttatagagatggatggtggtgatggctgagcaacagtgtgaacgcactcaatgccactgagttgtacacttcaacatggttaagaggatcagtttcacatatgtgtattttaccacaattaaacattttttaataaattaattttttttaaaaagcctcccttccagctccaaaggctacctttgagacagcctcctggaagggacccagcaggtcccccgtaagactctgattaaagttgtaaactgccacctccatatttctatctatagttgaattttctttaccactaaagaagtacttttgtctccttttccacattcagtgcccctgggtcatcaaaagtaagagctaaaagcactgattttttgacaagcaagccacagattcaatatcatgtatgttcaacacagccttgaaaaccgcagaatagatttctttaaatcactaaaaggagcctaagacaagatcaaagaatggatcccaaattaactgaaaaccttcacacacataccacagacagtcacggcgtgtgtgtgaacacgggcaggatccagcaaagccactcaagattggcagaggggctgctcggtgccccccactgccacgtttgttctatgtgtggttgagcatccggagggtcctgaggcagtgccagcccactgaggtcacaggtgaagcccacaggtcctgggccctgccaagggctacaggacactcatcaatcagcaggtgagagtacatttacctgcttcgtctcggggagcctcctgccagctcccttgcaaacttcattcacctcacgcctccctccttcctgccaagttcacctctgttgcaatccagggcaggcaaatactcgtcactcggacaaccagggcccatccttcaccgcggctgccgctactaatcaaccatatggtcttttccagggaagcccagacgcacttcgaaatccttcccagtcctacaaacgctgccggaagccacaatcaactgacaagcactggcagacaaggtgatgcgtgtgactcttccacagcatcctgacagtggccagctcggggctcatgagcctgaaggacgctctgccttcaagacgtctgacatgagacagtccctcaaagatatgctagccctgacagtgagcagttcctccttgattctcttcctagattaattttttgtttaattggtaattaatgttcattccttaataccaagtcacaattaaaaattgctcaagtcacagtcatttgacaaacgtcatgccttgtttcacattagcaaccactattacaggtgatctcactagaccaactcaaaatactggctatggctcgaagtgactctgctaagtaaacagaggtggggcattggaatcactccacattttcctgccgactcctgaattcattaagcagagctcagcccaatgcactggttttttatagtgccccacacagccccagaggatctaggggacattgatggtcctgggtggggagttgctaagtggagagggttgtaatgcctgggccccaccttcatccagatcaactccattttcacatactgagcttcctcataagatttcattggtagaaaaggctccatcactaagagtaaaaacgtttcccaactgttggctaatgcattgtgcagagagtgaatgtgcacatagaaaaagctccaagaaggacttctgaccacacagcggcccctcgagctgcaggggcagccagcatggactgggatgtgctacaaatagaaagtgagggcacaggtggctgagaataggcacaggagagaacagaaagacaagcacagaaaacagagagaccccgggaggcgccgggataacagagaggcagaacagcggctacaaagtggcaggaagggctggcagatccctaggaataaagggagtagcaaagctccaagcaaatgctcaccagagcccatatgcccatcataacccacacggcagcacgggggccaagggccacaaaaggcaatgcacgcatacaccggggtaatacgtaagccccgcacccgccagtaggacagcacacctctggtgcaaaggccctgggtgtttctttgaaaacaattagtcacactgatctacaacacattgtttctcaatcttttttctacctcatgccttcttctgaaaaagaagattctgaacaagctgcaggcagcccacatgcacacgtggagatttgggggccctgatccagcagccccgggagaatcagaacctgcagtccacatgcacaactctctgattcaagatcaatgctgacagtggtcacccaaggaggagtggccctgagggctggggtggagcagagggtggaacacagcagcacgcggtgggggcccagaagggctgggccaagcaacagggcagtgggcccccacaagctggggagaggagcaccccaaaacaatcttcccccaagaaatgcaaagcaggaatcatcatgaggcctcaatgtgctcatgttacagaacaaagctctcctgatggtgttgcctttgttaccttgtctccaactctggggacgcttaaatgctgaagccaggcctgtcatgcaattcacccagcatcagcagggacaattcaggaagaggtggcaccaggaggaaaacagctctggaagggcaggtctcgataatcaaaacccaccttaaaaatggcatcatgatgaactgttcagacaaggcagctctggcttcagtgtgttaatattaaatattttatacacacacacaacacacaacacacacacacacacacacacacacacacacacacacacacacatataaatttgagacggagtctcgctctgttgcccaggctggagtgcaatggcgcaatctcggctcactgcaacctccgcctcctgggttcaagcaattctcctgcctcagcctcccaagtagctgggattacaggctccccccaccacgcccagctaatttttgtatgtttagtagagatgaggtttcaccatgttggccaggctggtctctaactcctgacctcatgtgatccatctgccttggcctcccaaagtgctgagattacaggtgtgagccactgcacccggcctataatcaattatattataagttattttataaattagtgtaataatacatgtgatataaatacaagaatctcccttttatccattttttaaagattttaggtttaagcatacaagtacttacatttgactactagaaagagaataaaaaatagattgtaactatctgctgaaggatgacaaaacagccactggctggtcagtacactcagtcaccagagaagtcttcaaagtagtcccaagaggccagttaggaagggggaaaggaggcagggtaggttcttgagggtgggggaagcaggggaggggcagctcaccagcactcactgtacagctggtttacctgttggacaggacggtgtttttccagcaatctcacttgggaaagaaggaggagcaggtggcccagcttcaccctatgacaagtgtgactttcttgcagccacaccatacccaggctgctcccaccccctcctttcccctctctggctacagctctgactaacccgggtaacctgtccctgggcagctggaatgtgccctcttctatagctgaatgttggtgtctcttttcctggaaaaccataacacttccaacaaaataaggaggccaccgagggatggtggcagctgcagttccccccatgtagaggattccctgcggcaatccagacccagcatgcctggatcttccaattctgcaaaagaattcaaagtccattctgtactgtgaactctcccaagttttaagtgttatcaaataaacatttttaaacaccgcatgagctaaagaaaacatacctgggagcggaaggccacctgtggtcttggttttaggacctctgaacaaaaagatagacttcagtgctcagggtgaacagaaaaatatgtttttgaaagaaataataacttgtcagaaagacgtctactctatgtcacgtcaataccaggcacagcagcgagggaccattggacaccggctgtcctcagttcaagaaaccgcctgaggctgctggcaaattgacctcagggccccggccgcagccacggccccatctcccgggctgaatgctgctgctctagcactcattcatgacaacgaggacatctcaaagctaggaggcccccggaggctccagttcaacaacatacccaaggtcaccccgtgggccacggcagtccggactcccacatcaagctgggcctcctggaagacagcactgaacctagccatggattctgcagacaaccttcaaacccccatctacagccttcaatagcaaaccctgaagcacagtgcgtgctgccctaccctatgacctagttacagacgggcttgcgacggttactaggagtgagagcagaggccctcattgtataaagaccagtgcccatcctgctacctcactgaaatggagggagaaagcctaaatcaccaagtttagagttggtgggcgagaagagaggctacctacggttcagggaaaccagcaaagataagccatccaggctggggcgggggccatccccaccctaccccaagtctcagaaaggctgcgcccggcgtcagggcacccctcctgggtaggggccctgagatgacagttcacacagatcagcccttcagaaaacactgtcatgcttctcaaacacattaaaacacaaatgactacggttcaggttcatggtcaagtccagtccttccatctctccctgacaatctatatgtcctggtcactgcgtggggacttaggtacctccttggccacacagttcaaggtcatttctgttgttgtttttttttcctttggagacagggtctcactccgtcacccaggctggagtgcagtggtacaatcttggctcatggcaacctccgcctcccgggttcaagtgattctcgtgcctcagcctcccaagtagctgggattatagacatgtaccaccactcccagctaatttttgtatcgttagaacagacagggtttcaccatgttggccaggctggtctcgaactcctgacctcaagtgatttactcgcgcctcagcctcccgaagtgctgggattacaggcgtgagccaccgcacccggccaaggtcatttcttcgggggatcttttgtgtagatgtcgtatcttgctcattacatattgatttttcctagttttattcatagaaagaaaccccattttcccaatgtggaagcacctccttatataaggcaaatgtatgaacatttttatcctgcagaaacctgtgtgccctacattgtatgatccagaatagattctggccctccaccataaaaagcacatgttcacaccaaagcaagcaaagacatgcggcactgagcgagagtgtgtgggagggggtgacaagaatggtctgtgggaccccggacagcctttctgggcccccagtcctcactgcacagatgccaataatcactgctgcttccaaggggtgagctggagacagaacgctgagagagtacaggctcacagcaggctgcatctgcgcacgctcttggtgtcatcactactgctggcctgagcaggaaggcccaccctgccacagcggtccctgcacagggctgagtcctgtgaccacagccccattaaaaaatgctctgtgctccatccggctcccttagcaacctcacagggtcccaacctcagagcaggatctggaaggaccgttcactcaccgcaccttggaatgcattcaacttggcggtggcccgaagctgactcccaccagggcagaggaaaaaacacaacccagtgggcaagaggggctgagggaggaggagtagggggcgagggggcagtgctgggcaaaaggaaggggacaccaagggcagacacatccctggatgtccaaatggaaagaaatgaggaggaggaggaagggtcccttgaagggccgtaccatcccgcagaggggacatgaggctgtcccagagaggggtatgggtcctgagaagctagttagcacctctgatgccagccctaatgtccactctccctggtccatggcacaccctctccaggcaggccttcccgagaggagagacctccagagaagcaggatctacggaagggcgagctgacccatggtgacaggtctcctacttccctgcccaagtggttggcatctgtatcttgttcatagtaagatctgctcatgagacaagagccactaagaaatattcacagacaagatgattgcatttggggaaaatgtgacagacctgaagtgaaaacaaaggccaacttacaaaatgtcaagagtccaacaacctgaaatgcaaagcaataatacacacatatacattttagacagcaaattatactcttcaaaaggaaactttagctctaaatttttataactaaaatctgcaattcttttctatccccccaaataacaatgttttaacaggaaactggctatttacataacgtgttcaatagcgtggaaaagcattttgtgtattttattatatgtttattgtttcagaagccaccataaagttgaccacctgccactgccaccccataaaagggaaaacgtctatgtgtagttctattggactcactgggaagccattagctgacccttcattatttttaggcttctgagctaaagtgggaggagaaaatgacgttagaatgcccgttcaccaaacagctactcagtggctgctgctgcagacaccaaggaggtcagcatggggcccacaaagagaaaggacacatccctcttcgtggtccagccaccaaggttttaccaccaccaggcagggccagacctggacatgcgtccccaataccccacctctgcccctgaccacccttgtccttcctggacacttctggacctgaggacagacatttccctcgactgcaaagatgaggcagaaatgacacctggaagcaggggacgagtgagtctctcacacttccctagagtagaagccacagaggtaccaaagtgagggcggagaaacaccaagtgccagcaaggagcggccaaacctctcacatgctgctggcgggagcagacagcgatgccaccaccctggaaaaccgattgccagccacgacaacagttgaacacaggcacactccgtgccccagcaattccactctcctaggcatacacccatccaaacaggcgcgtatgctcaccaaggccacgtacgagaatgtgtcggcagcactgactctaagacccgaaactggaaactaccctagtgccatcaacagcacactggtaggtaagtgcactcatacaagagagcactctacagcaataaacatgaatgaaccactcaacaatacagatggctcttcacaaacacactgttgaaagtgtaagagatcagacactaaataatacatgttgtatgaatccatttatataaagttcaaaagcaagaaaaattaatacaggatgctaaaaatcagaagaaaggttcacctttgggggcagtaagtagaagggagcacaagggggaccttgaggtgcaactgatgttctgcctttgggtgccggctacacagagacattcagtttgtaaaaaacatactgagctatacactcaactgtttgtgcagttctctgcatgtatgttagacttcaacaaaaagtgcaaaaaaaaataagggctgaggagagaaactgttgctaggagacaaagaaatgaagattctggctttggttattagcccttagagcttggagaactgtggatacacgctgaaagcccattaaatttttcaaggaatcttaggaccagagaaacaccaaacctggccatcagtggtctctggtactctgctaccaatctccagacctgtgcctgcaagacatggctgagaaaaagctgcaggcctggagaggggaccctgtccatctcagacatggccggggaaaatggtccagggagatctctatacagaccatgcccaccccatacacaggggagactcaaggctgtacccacttggggagggggtgggtgtacttcacgtgggcatgagcgttcccgaggtgcacgtgggtaagaatggactggatggccctcactggtcaatcactgtcctgcaaatcacgttctgcttccctctgtgaatcactgtccagcagaagcacaacacaagccttgggtgtactttacaatttcctcatagccacattaaaaagaatagaaagaaattaaatttaactatatatatatatatatatatatatatttttttttttttttttttttctgagacggagtcttgctctgtcacccaggctggagtgcagtggcgtgatctcagctcactgcaagctccgcctcccgggttcacgccattctcctgcctcagcctcccgagtagctgggactacaggcgcccgtcaccacgcccggctaatttttattgtattttttagtagaaacagagtttcaccatgttagccagaatggtctcgatctcctgacctcgtgatccgcctgccttggcctcccaaagtgctgggattataggtgtgagccaccgcgtccagcctaacaatatattttcttcaacccaatacattaaaaatattatcctttcaatgtgtaaacaacataaaaaatattcagatgttgtacattctttcatgcacctcaagtctttaaagtgcgtgtgtgatgtagtttggatatttgtccccgcccagatttcatgttgagatataatccctgatgctggaggtggggcctggtgggaggagtttggatcatgggggcagatccctcatggcttgatgccgtctttgtcatattgagttcttgcacgatctggtcatttaaaagtgtatggggcaggtgcagtggctcacacctgtaatcccagcactttgggaggccgaggcaggaggatcacttgaggtcaggagttcaagaccagcctggcaaacatggcaaaaccctgtctctactaaaaatacaaaaattagctgggcgtggtggtgggcgcctataatcccagctactcaggaggctgaggcaggagaatctcttgaaccggggaggcggaggttgcagtgagctgagatcttttgagactctgtctcaaaaaaaattgaaaataataataaaagtgtgtggcaggccaggcgtggtggctcacacctgtaatcccagcactttgggaggccgaggcaggtggatcacgaggtcaggagatcgagaccatcctggctaacatggtgaaaccccgtctctactaaaaaatacaaaaaaaaaaaaaaaaaattagccgggcgtggtggcgggcgcctgtagtcccagctacttgggaggctgaggcaggagaatggcgtgaacccgggaggtggagcttgcagtgagccaagatcacaccactgcactccagcctgggtgacagagcgaggctctgtctcaaaaaaaaaaaaaaaaaaaaagtgtgtggcacctctccgacccccgctcctgctctccccatggtatgcggttgctcctgctttgccttcctctgtgaataaaactccctgaggcctccccagaagcagatgccgctatgcttcctgcacagcctgcagaaccaagagtgaattaaacttcttttcttataaattacccagggtcaggtatttctttatagcgacacaagaagggcctaatacagtgggtgttttccacatacagcagcacatcgcaatcagcaccagccacacatcagtgctccggaaccagctggacagcacaactatgggaaggagtacctgctccccactactccacccctaagggctactgtgaatagctttggctgcaattctctctctccctccctctctttctctctccctccctctctctctgtctgtctcacacacacatacacacacacacatacatacacacacacacacacacacacacatgctgggacctagaataagctgttctatccctctagccacagaggtcaagtcaatgagagatctgccaggaatcttgcagaagaaacagacacttttcccattgggctgaaggtgagagaaaggatgtgaggtctggaattgtagcagctgcttgaggccatgaggtagaggctgtctaggaatggagccacagagagaggagaacagagcccaggaagaaaggaaaagcaatgtggttctgtggacatggctggaacctctgcatcaacagatatatcccctactcttggatttttcagtctcatgtgctaaaaaatttgcttgttcactacgcaaatttgggctgcactgatgtgatctgttattaaaatagtcccagataatacacctcattattctaattatctctgctttttttcccttctagcaactttaaagtttcatattgttgttgaattcttcttactgattcaagttactagtatgcttttaataacatgtctgaatatatctaagcctcaaaacactgcatttcttttgaagctacaatttcagttttaagggctcatcctacgaaaataaccagacaagtgtccaaaaatgtgtacacaagaccattcactatagcaaaaaaaaaaaaaaaaaaaaaaaaaaaacccacaaatgcacactgagaaataagtgggtgtccagtcctaaggagatagcttccctctggcacagagggccccccagtgggcagcgttctttgttccctgcgtggacagcaccctggtagggcagggaggccacaggctcactggagcacggtcacagaaggacgtgatgcaaagaaaaagagccggatgtggtggaaggaagggaacatgcagagagttaggcagggcatggggaggcagcatggggcccactctcccatgtcccagcagagaggaggaacgtctaggagggggagcgggggcagagcctgccaacctggactgctgtcagagcaaacctgtgccagagcaaacctggtggacactggtttagaggcattgaacatcccatttcccgggcaactctgactttccgaaggtgtgagtgggacccagaaaacctcacggctgcagttggggggtgagagtctgggaggtaacagctgggcaatgtggaggcgagacaaggggaccaccatgggaaggaggtgaggtggcccccaagggccagatgggggaatgtgtcaaacactcagaaatcctgcagaggaacccaggggaactgagtcagcgagggaaagtccctagaccataccccagcatgggagaacagatgacagcagtaagcaggtggagaaggagtgctgccttgggggtccatggcaccaaaggatgctgtgcccagagtctctgctcctcacccccagtgacatcagacagctacaccatccctgcttccagatgccattctgaagacgagcctgcagggcaggcagaggctgagaaatctgagaggctcagcactacctatacgggcacttctcaattagaagtgtgcataggaatcccatgggaatgccgttaaaatgcagatcctgctacaaaatatctgggggtggggcctgagaccctgcatttctaacagactcccaggagatgcagagactcctaatggatgggccacactcagagtagtaaggccctcagggacctctgtgaatgaaacagaattaaaacaaccctcccgctctcaagtagatgtaagattcatgcagaagacagactgattatacaaaaaaatagtattaataaggaagacagacgtaccctccacatctgagattagtgtgaatactgtactctgcaactccactacacctacttataatctaataaaaattctgaaggaaacatttataaggcataaagattaaaaatattaaattatatgcttaacatagcctggctaagtgcactctgggggttgaaggcaaggataaggccataaggaaaagagcagtgccttgatcttcctctataaatcaagtcacttagtcctagacaccatttgccttgttaggactgcaatggttctctgacttcacgaataagcggatcctgccttctacccccacatactgccaaacatgacgtttttaaggtttatttaattcatacatgttattatttagggcagattttggttcacagcaaaatggagcaaaaaagggcagaaagttgccatatactccccctctccccagaagcacagctttccccatcagagtggtgtatttctttttcttttctttctttctttttttctgagatggagttttgctcttgttgcccaggctggagtacagtggaacagtctcagctcactgcaatctacacattccaggttcaagcaattctcctgcctcagcctcccaagtagctgggattacaggtgcctgcaaccacaggcagctaatttttttttttttttttgtatttttagtagagatgggatttcaccatgttggccaggctggtctcgaactcctgacctcaggtgatctgcctgcttcagcctcccaaagtgctgagattacaggcgtgagccaccatacctggccagtacatttcttacaatcaatgaacctacacactgacacatcattatcacccaagtccatggtatacattagggttcactcttggtgttgtacattctgtgggtttggacaaatgtataacaacgtgtatccaccattgtagtatcttaagagacagtttcactgctctctgtgccccacctattcatctctccctcccccaaacctctggcaaccactgttctttttactgtctccacagtcttgctttatctggaatgtcatatcttgggaatcacagcagtgtgtagcctcttcagactggcttctttcccttagtaatattaatttaaagttccagatcttttcatagcttgatagctcatttctttttagtgcttagaagtattccactgtttggatatctcacagtttatttatcaatttacctacagaaggacatttccactgcttccaagttttggcaattatgaataatgatgctataaatatccaagtgcaggcttttgtagggccataagtttttaattcatttaggtaaataccaaggagtatgactgtaggctcatagggtaagagtatgtttcattttgtaagaagctgctcaactgccttccaaagtggctgtagtgtttagtgttcccaccaacaatgaatgagactccctgttgctccacctccacatcagcatttgatgctatcagtgttttggcttttagccattctaacaggtgtgcagtggtatctcactgttgttttaatttgcattttcctaatgatatatgatgttgaacatcttcatatgcttatttgacaactgtatatcttcagtgagatgtctgttcaggttgtttgcccattttttaatcaggttatttgttttcttattatcaaggtttaagagttatttgtatattttgaataaaagtccttgatcacatataacttctgcaaatattttctcctaggtttgtcttttcattctcttgacactgtctttagcaagacagaagtttctaattttaaggaagtccagcttaccaattttttctttcatgtattgtccctctggtgttgtatctaaaaaatccatcaccaaacctagggtcattaagatttccttctgtgtaatttatgaagagctgtataattttatgttttacacttaggtctatgatctattttaaagtgcatttttgggaagagtttgcgtgttggcctctagctgttccagccccatctgttgaacacactatccttttgcccttgaattgtttttgttccatgtttcagatattagctaactatattgtgtggtctaactagttagaaataaattgtctattatttaatcaagactacactatcctgattaagtaagtgttgaagtcgagtattgttagtcctctaatttggttgatctccttcgctattgtgtcaactattctgaatcttttgcttttccacataaatttcagaatcagtttattcaaatcctcaaaatcacttgctgagatttctgattattacattttttaaataactacaaaatgattgattttattagtttgttggaaactgcctatctggctatagtctacgtttcagctgttataaaatctgcaagtcctcatacaaaaactttcacactatgatgacacctcactgctgacagcctcctctgcagtcctggagctcctgcaggatacacgctgcatgcacaggtagacatgtgcaacccaggagggcagccagggttttcccaggatgtcaaagctcagaaggaaccaaaaattttaaagatttttaaaaatattttaattttttacaatataggttgaaagcaaatagctccttcaagagctagaacaactgaacttcacatctaataacaagaatgttcaattaaaacagaaagctaccctatggcccttccattcataatgcccatccatgagcctcagcatggactacaagtggatttaggggtccctttcaagatcttcaattgttcagagggcactccactgccctagcggaaggaataaatctgtcacaccacccacaacacagctagttctggagggccaggaccatggcccagaagcagtactgcatgaagattaaacttctcttccttttaagtgtcagatcccaaactgtcaacagtgtatacatgcattgtaacaaacacaaacactaccaacagaaaataatcattcacatgccataggtacatgcatgtgtacacacacacacgcacagactctcacacacatacttcatatttgcttgtcttttactgagaaaaaagggattataatatgcaaaaaacagattttttaaagtaatcatgataacagaaacactcagctaagatgctattctattcatttataaacaccttgcttcctaagggcctgccacaccttaacccatagaactcacttgtggaataaattctttactgaatgaaataagaacttaagtcacaaagtatctattgactatgatatggaaaaaagccttttaaaagcacgtattatcatatataaatacagaatatgaactaagggctacagcaggaaaacgttaactggttatgaattagaatttttatttgtctattgcttgcagggttttattgggcacctagcctgtttgaagcatgaaagctttaaccccaagactcaccctgcaagccaaaagcatactttgttggcaacattaaagcatttctggcttctggcctgggacatcagcaaaaaggcagagtaggcagctccaagggtccatcctccacaaaaccattgaaaattcaagcaaaaactgtcagaatcaactttgtcagaataatggaaacagtaaatggttcgcagcaaccaagcaaaaatggaatggagagaaaggtaaaataaaagcaggaggaaggccctgtggtgttttcatctacccaaatccaccctcctctccagctccacagtgcaggacctggcccctgtcttgaagacagcagcagcattcccagtgcaggacctggcccctggttcccgagggtgcagagcagacttgattcacaaagaattgtgtttgctctaacctgtctggaggctgctgaaggactgattcaaggggctcctctctgttctgtgtaactcagaatgcactcagggcagaaaagtggcaggcactcctggaaaacactagaaggcaaatgagcaacctgcagtccctgggacagaagattaccattgaggcacacggtagagtgccaaaaccatgaaaggaaaggctggggacagggtttaagaaattcaggcattcaacacaaggaactcaaacatctcaacagcaaagaacaaataatcccattaaaaagtgggcaaaggatctgaatagacatttttcaaaagaagacatacaaatggccaggagatatatgaaagaatgctcgacatccatcaccaatcatcagggaaatgcaaatcaaaaccacaatgatatataccatcccaacccagttgcaatggctattatcaaaaagacagaacgtaataaatgctggtgaggatggaaagggaactcttatacactgttggtgagaatgtaaattagtatagctgctaaggaaaatcgtatggagatttctcaaaaaagtaaaaacagaactaccatatgatccagcaatcccactgctggctgtttatccaaaggaaaggaaatcagtatgttgaagagatatccatactcccatgttcattacagcactattcacaatatctaagataggaaatcaacctcagtgtccatcaatggataaagaaattgataaaatgataaattgatacattgttaaagaaaatgggagacacacacacacaaacacacaatagagtactattcacactttaaaaagaaggaaatcctgccttttttaataacatggataagcctgaaagacatcacaccaagtgaaataagcaagccagagaatgataaataccatgcggtgtacgtatgatatactatttggccataagatagaatgaaaatggaatactatctggccataaaaaaagaaaaaaaagaatgaaatcctgtccgggcacagtggcgcacgcctgtaatcccagcactttgggaggccgaggtgggcagatcacttgaggtcaggagttgaagaccagcctggccaacatggtgaaaccccatctccactaaagacataaaaattagcctggcgtggtggcgtgcgcctgtaatccagctactcaggaggcagaggcaagagaatcgcttggacctgggaggcagaggttgcagtgagccaagattgtacatctgcgctccagcctgggcggcagagcgagactctgcctcaaaacaaacaaacaaacaaaaagaatgaaatcctgtcatttacggcaacacagatcagcctgaaggatattatgttaagcaaagtaagtcaggcactggaagacaaataccacatgatctcaaccatatgtgatggctgaaaaaaaatgagctcatggatatagaaaattagaattgtgggtgcagagtctgggaagggtaccagtgaggggaggatgatgagaggttggttaatggatacaaagttgcagctagataggaagcatgaattctggtgttctatagcactatagggtgaatatggttaactacaatttattatatattctcaaaaagctagaatagaggattttcaatgttcacaacacaaagaaatgaggtgatggatatgctaattatcctgattcgatcattacacattgtatacacatattgaaatatcactctgtatcccataaatatgtacagttattatttgacaactaaaaataaaagggaaaaagaaattcaagcattccaaagcacctatgcatatgggtgggaatgtagacagccatgtgaatgcccagagcagaacgcatgctcagaagaagcctgagaagaccccagtctttcacctctggatgagctccaggttcagtataaacaagaaatgaaggtcaaggcatagctgtaaaaagccaggctaagtgttaaaggaggactccaccacagagccactccatacagataagcggtcagtctcttctctctctgtttttctctgcctctctctccaaccccctcgctctctctatcatgttttggcatctggtgctcaaggaaatctctttgacagcactagctgaacaaacaactaaacagagacttcagagaccacacacggtaaggaattacagatcttgcaaaactctacagtctatagcaagcaacaacaaaccctgaggtgggggaagaatctgatctccagagttacctctgtttaatatgcaaaatgtccaggcgtttgttcgtttgttttgagacagggtctcactctgtcacccagggtggagtgcagtggctcgatctcagctcactgcaacctccacctcctggattcaactaattatcctgcctcagcctccagagcagctgggattacaggcatgcaccaccacacctggctaatttttctatttttagtagagacgggattttgccatgttggccaggctggtctcaaactcctgacctcaagtgatctgcccaccttaacctcctaaactgctacaattacaagtgtgagccaccatgcctggcatgttcagttttcaacaataacttatgaaccatgtaaagaaacaagaaaatatggctcattcacataagaaattaacaaacattgtccctgaagaaacacacacactggacttactaaagactttaaatcaactgccctaaatatgctaaatgacttaaaggaaagaaaggaaaaggagctaaaggaaatcaggataagaatgtatgaacaaataagtgaattgaaataaagatatagaaattataaaagggagtcaaattctaaggtcaaaaagtacaccaactgaatttttttaaaaatcactagagcatctcagtaacagacttgactaggcagaagaaagaacccgcgaacataaagacagggcaatgaaaattatccagtctgagaggaagaacaaaaatgataaaagattaacaggtatgaaatgccatcaagcataccaataccaagtacataacaggaatcccagaaggagaggtgcgagtgaaaggaacacaaagaatatttggagaaataattgccaaaacttaccatacctgataaaagatacaaatctacacacacaagaagttcagtgagtttcaagtgagatgaatacaaagaaatccacactgagacacattataatcaaacagtcaaaaagccaagggcaaagagaaaaatcttgaaatcagcgagagaggagccactgattcacatacaagggatcctcaatcagattaacagctgacttctcatcagagaccaggggaccagaaggcaatgaaatgacattttaaagtgatgggcaggatgggggtgatgcttccaaccaagcattgtatgatacatcctacaaaaatacccttgaaaaatgaaggagaaatttacacccacatattgaatggctccaattgtataaaatatcagaaacaggtaacaatccacagggacataattcagactgatggcttccaggggctaggagaggggaaatagggagaaacaatttaatgagtatgggatttcctctggagacaatgaaaataattttggacttttatagagggagtggttacacaacggtgtgaatgtactaaacgtcaaagaattattcacacaaaaattattactgttaagttaatttcacctcagtaaagaaaaataaaacatgggaaaaactggcttctgacaaactgatcaaagttctgaatcacaggcagtagcagaagcagcatggattaccctgagatctcttccttccttccttacctgcctggccgagagaaatatggagcgagggtactgatttaagataatatgctaactgggtgcttgtagcaatatcaaaaggtaatgtaatatagactaaaccatatggaaccatgaactgccaaggacatgagttacctgccaaagtaagacgttgcccttgggtgcagacagaaaacatggtggggtgatctttatcaacagtcagcaacaggataaaattccatgtgtaaaggccacctgaactttgattctgtatgtgcgtattttacaagaatgtaagagcagtccaaaaactattttaattgaattcattctatacataggtgcatcccaatgccaattactggcatcaattctaaaccaataaataagaacatatgtattttacgcacaaaatgtcatgtctctctggatatcccatgcacaaccccaacagtacccgtccatcagagcctgcagctctatgaaggagaacttaacagcactctaggtgaacacgcccctgcctgatgccgtccacaaagctaggcacatttgcacgtctgggtaccatcgctcagctacacaaccacaggccatgacggcgcagttcttccaactaggctgtgctgacacaggtctcgagatggctgatgcttttgatgcatcctgaagttttgctacaaagatcaccacaaaaatgttcaagcatcaaaatgttttaattcttctgaaatgaaactgtctctaaatagctcagcaataaaattcaataattctattgggttcaaagcagtttaacaatggaaaatgaattatatagtcaaaggtggtccattctcgctctccagtaaacatttctgtatgtgcggaattggtgggttctcggtctcactgacttcaagaatgaagccgtggacccccggtgaattttacacttcttaaaggccggtgcatctggagtcgttagttccttgtggtgttcggacatgttgggagtttcttccttctctcccaatgggtttatggtctctctggcctcagaagcaaagctgcagaacttcgctgtgagtattacagctcttgaaggtaatacagagcctaagagtgagcagtggcaagatttaccgcaaagagcgaaagaacaaaacctccacaacatggaagagaacccaaacagtttgcggctgctggctccggcagcctgcttttattcccttgtctgaccccacccacattctgctgattggcccattttacagagagctgactggtccattttacagagagctgattggtccgttttacagagagctaattggtctgttttgacagggtgctgattggtgcgtttacaatcgctgacctagacacagagtgctgattggtgtatttacaatcctctagctaggtgtaaaagttctccaagtccccactagattagctagacacagagcactgattggtgcatttacaaaccttgagctagacacagagtgctgactggtgcatatacaatcctccagctagacataaaagttctccaagtccccacctgactcaggagcccagctggcttccgctagtggatcccgtgccagggccgaaggggagctgcctgccagtcccactccaggcgcctgctctcctcagcccttgggggtctatgggactggacgcctatggagcagggggtgatgcccctctgggaggctcaggcaggaggctcgggcagcacgggagcccactgcagggggcagcatggcgggctgcagatccccagccctgacccgtggggaggcggctgaggccccgcgagaattcgagtgtggcacaggcgggccagcagtgctaggagacccagcgccccctccacagctggtggcccaggtactaagcccctcactgcccagggccagtggcaccagttggccactccgagtgtggggccgctgcctgcacccacccagatcttgggctagcccacgagccctgtgcacagccctggttcctgcccgcacccctccctccacacctccccgtaagcagagggagctggctcctgcctcggccagcccagagtggggctcctacagtgcagcagggggctgaagggctcctcaagcgtggccaaagcagacatcgaggcccaggaggtgcagagagtgagcgagcgagcactgctagcacattgtcacctctcatctagacttgttgagtgtgagtacctgccctttctggaacaaaccatcaattcttttgctccctacaattttaagttccaatctggtgagccctagggtccctaggtttcatattgtagaaggctttaaatctaaagagtccttggataaatggaagggcaaagtaaatctcaggaagtttcacacagtagctatctgactgcattcaagaaagaaatctctgtattttccttcaacttctctcacacagcccaaagttgttgggagaaggtaaaggaaaaaacatgaagatttatttcatggagatagccagcataggggaaattatttaccttttcgacttagaacaactagaaaacaagtttccaatcatggtcatctcctgcctcacagtagacattaaagttaagttagagaattcacaaccacacccttctgattgacactatacatatcaatctcgttactcaactgaggggaaaaaactatttccatcagctagaccttttcctgcactccatgaaaagctcaaacactcaggatgtcaaacttaacttttttgcaatcacacagcaaggcccaatctgtcaaagccatacgattcactgcctttatttctactgttggtttgatttttttttttttctagcttgtgggtttcagggcagacaaaggcagctaaaagtctcagggagaaaaagaatctccagtaggctgtaccatagacatccccatttattgcatgtaacttacttcacttctcaaccccacagtttaatcacctgtataaaactggcgcagtaatactcagactgcaaagtcattgtaagaattagcagtagcatgaggaaaacatcagctcatgttaggaatgcactgattattacctggcattatttagattgattaataagttcatatatgcatagtgggaaacaccttggtctaacattctttggttctaattatgattacgatatcatgtgatttccatgtgttagagagcaagtcataattatcaccattgtaaaaggagaagtacattctacatcagattgacaaattgtgttctataaaactctaagaagccaggcagatacctcaagagccatgaggactcaataggaaggttgctaaattctatgagctatcggttatgaccttcaagtgttaaacatattaatatagaggtataacttttcccgataggaaataaaaggcaattactattttaacatgctgccaaacacactgcctattgttaaaataattgttaaaatttttattgaggctgggcacggtggctcatgcctgtaatcccagcactttgggaggccaaagcaggtagatcacctgaggtcaggagttcgagaccagcctggccaacatggtgaaaccccgtctctactaaaaatacaaaaattagccaggcgtggtggcgggcacctgtaatcccagctattcaggaggttgaggcaggagaatcgcttgaaccctggaagcggaggttgcagtgagctgagatcacgccactgcactccagctggggcgacagagtgagactccgtctccaaaaaaaaaaagtttttgttgaaataaattattttaaataacagtgacttcagttaaaatcctaattagtgaacttattagtaattcaataatagtatttccaatgcttccctgacaacccttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacaactctttttacctcataaagagaagctatgtaaatcctgaggcaaacagcacgcttaatgctgagcatttaaaagcattctcaggcagaaggatcacttgagcccagtaattcaaggctgcagtgagctatgataacaccactgcactccagccagtgtgcagagtaagatcctgtctctaaaaataaataaatagttcagatagaaataaacagaatatagatagatagacagatagagataataaaagcattcctggctaggcatggtggctcaggcctgtaatcccagcactttcggaggctgaggtgggcgaatcacctgaggtcaggagttccaagaccagcctggccaatatggtgaaacctcatctctactaaaaatacaaaaaattagccagggtggtggctcacacccgtaatcccaggtactcgggaggctgaggcaggagagttgcttgaacccaggaggcagaggttgcagagagccaagatcacaccactgtactccagcctggccaatagagtgagactccatctcaaaaaatttaaagaaagcattcccaatgaagacacagcaaaaatgctctccttcactattactattcaatatttaatgggaattcccagccagcacaattaagaaaataagtaacaaggatcgaaaagagacaatattatcattctttactgacagaatgattacatataaaattcaaaaacatatacaaagtatcagacctaatacgagtttggaaagactataggaaaaaaaaaaactttaaaaacgctttccaatatttcaataacaatcaattaaaaaccatttttagaattagcaataaactccaccaggtacctagaaaaaaactaagacacaagaactttatacacataaaattgtgccaaaatacgttaaaatgtattcaactcttccagctttattgtggtataagtgacaaataaaaattgtatatattttaggtgaacaacataagttgatacacatattcactgtaaaatgattaccacaatcaggccaattaacatatccatcacctcacatagttaccatttttatccttgtggtaagaatatttaaaatctactctcttagcaaatttcaagtatacaaaacattattattttagttatagccacattaggtctccaaaactaactcatcgtgtaactgaaagtttgttcgctttgaccaacacctacccatttcccacaggcccagcccctgcaaccatcattctcctctctgtttctatgagccacgtttttagattccacatataagtgagaccatgtggtatttatcattccctggcttgcttatttcacttagtgtaatgtcctccaggcttatccatgttgttcaaaaaggcaggatttcctttctttgaaggctggctaatactcctctgcctgtgtgtttgtgtgcatgtgtgtgtgtgtctggatgtgtgtttgtatgtgtgtcacattttatcagtttatccactgatggacattaggttgttcccattatcttggctattgtgactaatgctgcagtgtacatgggggtgtagatttatctttaaaacactgatttcaattactttggatatatacccagaagtagaattgttggatcatatggttgttctataattttttgaggaacctctatactgtttaccacaatggcagtaccaatttacattcccagcatcaatatataagggttcccttttctccacaacctcaccaactcttgttatctgttggtactttgagaatagccattctaacaggtgggagatcacatctcattgtagttttgatttgtatttccctgatgattgatgatgttgagcactttttcacatacttgttgccatttgtatgtcttctgtgagttgcctttacatttcattgtttcctttgctctaaagaaatattttagtatggtgtagtccaattatttgtttttacttttgttgcttctgtttttggtgtaatattcaaaacatcactgctaagatccatcttattgagctttctatgttttcttctaggagttttgtggcttcaggcctttcctttaaatctttaaacaattttaacttgatttttgtgtacagtgtcagataactctccaattttgtttcctttcatattttttctttttttgcatgaggatatccagttttcctaacaccattaattgaaaacaatgatccttttcccattgtgtattcatggcacctttgtcaaagattagttgaccatatatgcatgggtttatttatgggctttctattctgttccattggtctatgtgtctgtttttatgccagtagcatgtttttttggctactatagctttgtaatataatttaaaatcaggagatgtgatgacttcagttttgttcttcctgttaaaaattgcttgggctattcggggtcttttgtggttccctatgaattttaggattgttttttctatttctgtgaaaaatgccaatgaaattttgatagactgcattgaatctgtagatcactttgggtattatgaatatttttataatattgattattctgatccatgaacatgggatatcttcccatttgtgtatcattccatttcttttatcaatgtttcatagtttttggtgtatagatcttgcatctccttatttaagcttatttatgttattatttttgatgctattgtaaatcagactgatttcttaatttctttttctaatactgtacactaatgtgttattagtgtacagaaacacaactgctttttatatcctgcaactttactaaattcatttatagttctaattagttttggggtggtgtctttaggaatttctattacaagatcacatctcctgcaatcagaaacaatttcctccttcccaatttggatgactaataaaataaataaataaaataaaataaaataataaaattatttttactgcctaattgctttgactaggatttccactactactttaaataaaagtggtgagagtgggcatccttgtcttcttcctgattttagagaaaaagctctcaaccatttatggttgactatgatggtagcttgtgaaatatgacctttattgtgttgaggcatattatttctatacctaaatttgtttagagtttttgtcataaaagattgttgaattttgtcaaatgttggtttaaatatttgagataatcatataatttttgtccttcattctttctgttaatgtgttgtaccacacttattgattatattgaactatctttgtatcccagggataaatcccacttatttgtttaatatgctattgaattcagttttctagtattgtgctaaagatttctacacatatattcatcagggatattggcttgtaattttctttccttgtagaatttttgcctggctttgctatcagggtaatgctagcctcataaaacaagttggaagatgttccttcttgctatggtttgaatatgccctccaaagttaatgtgttagaaacttaatccccaatgcaacagtattaggaagtagggcctaatgggaggtgcttaggtcatgagggttccatccttatcaatgcattaatgctgattataaaagggcttgaagctgtgagttccatctcttgctctctcgcactctttttctcttctgccttctgctatgcaatgacatagcaagaggatcctcaccagatgtgggccctagatcttggacttccccgtctccaaaactgtaagaaattaatttattttctatgtaagttaccaagtctgtggtattttgttacagcaacacaaaatagactaagacattttctcttcaattttttttggaagcgtttgagaagcactggtattaattcttctttaaatgcttggtagaattcatcagtgaagccatcggatcctggacttttctttgatagaaagatttttgttactgattcaaacttcttactcattattagcctgttaagacttctttttcttcacgattaaatccaagacttctttttcttcatgattaagtctttgtaggttgtgtgtttctaggaatttatccattacttctgggctaatttattggcatataagtgtttgtagtactctcttaggatcctttgtaatcctgtggtatcaattgtaatgtcttccctttcatttctgattttattttagtcttcttttttcttaatctaattaacagtatgtcaatttcatttatcttttcaaaaaaccaactcttagttttgctgatcttttctattatttttctaagttctatttcatgtatttgttctctgatctttactatatccttccttctgctaactttagtttgttcttctttttctagtttctcaatatgtaatgataggttgtttatttgagatctttcatttttcttcatgtaggcatttttcactataaactttcctcttaaaactacttttgctgcatcacctatgataagatttggctctgtgtccccatgcaaatcttatctcaaattgtaatccccatgtgttgagggagggaactggtgggaagtgactggatcacagaggtggtttgccccatgcttttctcgtgttagtgactgagttctcatgacagctgatggcttttaagtgtggcacttcctcactctctcctgctgccttatgaagatgtgccttgtttccccttcaccttctgctatgatcgttaagtttcttgaggcctccccagccatgtggaactgtgagtcaattaaacctcttttctttataaattatccagtctcagtatctttataacagtgtgagaatggactgatatacccaaagttttggtacactgtgttttcattttcatttgtctcaagatattttttaattttcctactgatttcttctgctccattggttgggagtatgttgtttgatttccacatatttgtaattttcccaattcccttccattagttatttctagtttcatgatactatgatcagaaagaaatattacataatttgatatataattaaaatataatttcaatctgcttaaatacattaagacttgttttgtggcccaacgtataacctatcctgaagaatgttccatgtatactttagaagaatctgtactctgctgctgttgaatagaatgttctgtatttctgtatatatctgttaggtctacttggtataaagtgtaaaatctaatgtttccttactgattttctctctggatatcctgtctgtagttgaaagttaggtaatgaggtccctcattattactgtattgctgtctatttctcctttcagatctattaatatttgctgtatattatttacgtggtctgatgttgggtacatatatgattattgtgtcctcttaatgaattgatccctttttcattacataatgacctttttgatctcttttaaagttttgtagtcaaactatattttgtctgatataaatatagctacccctgctctcttttggtttccatttgcaagaagtatcttaattccttcacattcggtttatgtatgtctttaaagttgaagtgattttcttacggcagcatatagttgagtcttgtttttaaatctattcagccaatctgtcttttgactggataatttaatgcatttacattcaaggtaattattgataagaactttcaattgtcattttgttaatttgtttctgggtgttttgaggatgccttgatcctttcttcctctcttgctgtcttcctttgtgacttgacaattttctgtagcagtatgctttgattcctttctcttcatcttttctgtatctactatatgtttttgctttgccattaccatgaggcttacataaagcatattatagttataacagtttaagctgataaaaacttgtttgtttgttttgagacagaggcttgctctgttgcccaggctggagtgcagtggcgtgatcataactcactgcagcttctaactccttgagagatgatcctctcacccaagcctcctgggtacctaggactacaggtgcacacactaggctaattttttttttttttttagaaatgaggtctcactatgttgcccaggctgatgtcaaacacctaggctcaagcaatcctcttgctttgtcctctcaaagtgctgagattacaagtgtgagccaccatgcccagtcaaaaacttaactttgataacatacaaaaactctacactactttctgatagtgaagtgtaagtaaattcttcctaattggtaattacatattgtgtaaatgaactaaactctctaagagaaaggcagagattggcagaataaattagaaacttgtggaactgtatgctgtctacaagagactcactttagattaaaagacaaaaacaggttgaaagtaaaaggaaagaaaaggatatttcatgtgaacagaaaccaaaatagagctggagtgtatacactaatatcagatgaaatacactttaagataaaaattgctactaaaaacaaagcagcacaatatacactaataaaaaggtcaagtcattaagaaaatactgcaattataaatataccacacctaccaacagagtcctaaaaatacctgaagcaaaaaattgacagaattgaaatacaaaatagggaattcaacaataatagttggagaattaaatacctcaatttcaataatgaatagaacaaatagaataacagcaaggaaacagaagacttgaacaacactataaaccaatcaacttgacatctatagaacactcaacccaacagcagcagaatacacattcttctcaagcatacatggaacattttcctgatgaaacatatattgggccaaaaaacaagtctctgtaaatctttaaagattcaaataatgcaaaacatgttctctgatcacaaaagaataaattaagaaatcaatcacaaaaggaaaactggaaattcacaaatacatgcaaattaacaacacattccattggccaatgggtcaaagaagaatttacaagagaacttagaaaatactttgagataaaataaaaataaaatacaatatactaaagcttaatctttcatatcagagtttaatccatttgaataaaagcagtgctcagagggaaatttatatctgtaaatgccttcactaataaaataaaaaactctcaaatcaataatctaaccttccaccataagaaacttaaaaaagagcaaattaaatctaaatcaaacacatacaaaaaagagattggagccaaacagagaacagaaaaacaacatagaaaatcaacaaaaccaaagttggttctttgaaaagatcaacaatattgacaaactttagctaggctgagcaaagaaaaaatagaagactccaattactaaaatcaggaatgaaagagagaatatcataattctaagaaaattctatgaaagctggataccatcaaattagataccctagatgaaatggacaaattcttagaaacacacgatctaccaaaattgactcaagaagaaacagacctgtagctaataaagaaatgagtcaacttttctaaaaaaaaatctttcaatgaggaaagcctcgaccagatggtttcattggggtattctacaaaatgtttaaagaaaaattaacaacattatttctcaaactcttacaaagagtagaagagaagggaatacttcgtaattcattctgtggaagtgaaacacatcaaaagtaaaaactacagatcaataaccgttgtgactacagatgcaaacattctcaacaaaacattagcaaatggaatctaacagcatatgaaaggggttattcaccatgaccaagtagagtttatcccagaaatgtgaggttggtccaacatataaaaatttatcaacataataaagcatattagcataaacccacatgatcatctcaatagatgcagaaaaagtatttgacaaattccaacatcttttcatgataaaaattctcaacaaattagaaacagaaaagaaaatttcttaacctgataaagggcatccatgaaaaaccaatagctaacatcatacttaacagggaaagactgaaagctttgctcctaagatcaggaagaagacaaggatgtctacctctcaccacttctattcaacattttactggaggttatagccagggcaaaaaagaatgctgtaggcaagaagatgaaataaaatgcatccatactgaaaaggaagaagtaaaagtatctctgttcacagatgacctaattttatatagagaaaaccctaaataataaacacacatacatattaaagctaataaatttggcaaggtgacacgatataagttcaatgtataaaaatcagttgtatttgtatacacacaatgaaaaattttaaaatgaaatgaaaaagacaattccatcaacaataccagtaaaaagaataaaatattcagaaaaaatctaactaaagaagtgcaagacatatacactgaaaaccataaaacattgctgaagtaaattaaagactgaaataaatgaaaatatatctaatgttaatggacagatcaaagcaattcctatcaaaaatctcatcgagaatttttttttgcaaggatcaacaaactaatcctacaattcatatggaaattcctgaaacccagacaagtcaaaacaatcttgaaaaagaacaaagtgagaggaatcacactttctgatttccaaatttactacaatgctacagtaatcaagacagtgtgatactggtataagacagtcaaatagatcagtgaaacagatctatggccaagtaactttcaacaagagtgccaagaccattcaataaggaaagaataattttctcaagaaatggttctaaaactagatatccacatacaaaggaatgaagttggaccccaccttataccatatacaaaaattaatgcaaaatgaatcaaaggcctaaatgtaagggctataactaaaaatcctagaaaaaaaaagcatagatataaatctgtgcaactttgagttaaggaaaagttttttggaaaggacactgaaagcatgtgtgaccaaagaaaaaatagatgaattgaacctcatcgatatttaaaacttttatgtttcaatcagccctatccacaaaatgaaaagacaacccatagaatgagggaagacatttacaaatcatatgtctgataaaggtctagtaaccagcatatataaaggactcctagcattcaacgacaagaagtcaaataactcaactaggaaaagggctaaggatttgaacaaaaatttctcgtaagaagatatacaaatggccaataaatgcatgaaaagatctttagggaagttcaatatcattggccattagaaaaatacagatcaaaaccacaatgacataccaatttcatacccactaggatggctagaataaagggggaaaaaaaaaccagaaaataagtgttggcaagaatatgaagaaactggaactcatacgttgctgataggaatgtaaaatgttgcagctgctttggaaaacagtctggtagttaaacactgaattaccgtgtgactctgtaattctacccttacatatatacctaacagtattgaaaagatatgttcacacaaaatccagtacactaaatgttcacagcggcaatcataatagtctaaaagtggaaagaaaccaaatgttcatcaattgataaatggttaaacaaaatgtggtatatacatatggaatgtcattttccacaaaaaggaagtgctattgcatgctataacatggatgaaccttgtaaacattatgctaagtaaaagaagccaaatacaaaaggccacatattgtatgattccagttatgtgaaatgtccagaagaggcaaaatcatagaaacagatagtagatttgaggtgccaagggttagaggattggggaattggaggtgactgctaacagttatgagatttctttttggggtgatggaaatgttccggaattacgtcatgatgatttaacataacactgtgactatactaaaaaaacactaacctgtacacttcaaaatggtgacttgcatgttatgtgaataatacctcaataattaaaagaagtaaggataataaaatcatcttaatcagccagctatgctagagcaagtaaagctaaatatctttttaggatctagagaaaataaaattataaaattatcatactaatagacaattaatgaatatgcagcaaaaaactattacaaagatgggtcatgcaattctttaacttgtaaatgttatttttctcaactgtgtggtatatttcatgcatttaaagcatttttaagtttataattcattgtgatttgttttttcattccaaataaatatccactgtcatgactaaatttgtatttacaattttgtattctttctgttaaaagaactgagatgggccctacaaaacttgaatcctccactggagataccttttcacaaccatcacagtagctaaaattaaaaagtctaataatacttggtattggagagaaagtagacgaatgttaactctccttggccctactaggagtacagattgatttaaacaatttgaagagcagtttgacgattatagtgacattaaggtgccccaggaattctacttctagagacaggctctaccaacatgtttctacctatgcacccctgcagcatgttgtaaaggcagaacaccagaaacaggctaaacggtcagcaacaacacaacacagaagattgggatatgttctcagaagggcactctatagaggagttaaatgactttatgcagatcaacccacatggaagtggaaaacaataccaactgtgaaaagcaagtttcagaatgacatcacagttaaaaccatttgtgtgatgttttgaaacatgcacacaagtactacatattgattccagaaacaaagaaatgaagtaaaagagaaattcctctttgtttacagaggaaatagacaggttggaaaaggacacgagagactgtaacttgatctgtgatattttgagacaccatgaagaagaactgaagcgtgtgtttccaagtttaggcatccatgaattctgcctcgtgcttttatacttaggattcttaggctcactctctgaccttttctatttgaagctggattcagactatttacctgagtggaggaaatacttgaatcttaaagatcaaactcaccaacaaagaagtggggaaagcagtcatgagtaattcatgaaatgctaagtaaaataataatgcattcataacatttttcatctatcaaactagaagctctggtgtcttccatgatgatacccagggctggcactgtcatgttaggtcattagaaagccttgaaaacatatttatccctttgcagaagcaggtctgttctcataaggagattcttctgaagttgtgcaaagattttgatacaaggatgtacaatgccaagtcaccttgtagatgacaagagaaaaaggagaaaaaatgtccaacaactgtttgttaaattggaatatcttatacaaaccataaacatagagtggatacttataaagacaataaaaaaggcatggagaatgtttaagtgtttagaaaacatgctccccctgggcagagcccaccccagtgccacaaagccactgtagccagactgcctctctaggttcctcgtctgtgggcaaggcatctcggaaagaaaaacagcagcacccgtcaggggcttatggataaaactcccatctcccttggacagagcacctgggggatgggacagctatgggcgcagcttcagcagacttaaatattcctgcctgctggctctgaagacagcagtggatctctcagcacagtgctcgagctctgctaagggacagattgcctcctctagtgggtccctgaccccagtgcctcctgatggggagacacctcccagcaggggttgacagacacctcacacaggagagctctggctggcatctggcaggtgcccctctgagatgaagcttccagaggaaggagcaggcagcaatctttgctgttcagcagcctccgctggtgatacccaggcaaacagggtctggagtggacctccagcaaactccagaagacctgaagatgaggggcctgatgaccgttagaaggaaaactaacaaacagaaagcaatagcatcgacatcaacaaaaaggatgaccaagcaaaaacaccatccgagggtcaccaacagcaaagaccaaaggtagataaatccatgaagatgcagaaaaaccagagaaaaaaggctgaaaattccaaaaaccagaatgccccttctcctccaaaggatcacaactccttgccaacaagaaaacaaaactggacagagaatgagtttgatgaactgacggaagtaggcttcagaaaatgggtaataacaaactcctcctagctaaggaagcatgttctcatccaatgcaaggacgctaagagccttgaaaaaggttagaggaattgctaaccagaatagccagcttagagaagaacataaatgacctgatggagctgaaaaacacaacacgagaacttcgtgaagcatacacaagtatcagtagcccaatctatcaagcaaaagaaaggataccagagattgaagattaacttaatgaaataaagtgtgaagacaagattagagaaaaaagaatgaaaaggagcaaagcctccaagaaatatgggactatgtgaaaagaccaaacctacgattgattggtgtacctaaaagtgatggggagaatggaaccaagttggaaaacacacttcaggatatcatccaggagaatttcaccaacctagcaagacaagccaacattcaaattcaggaactagagagaacatcacaaagatactcctcgagaagagcaaccccaagacacataatcatcagattcaccaagattgaaatgaaggaaaaaatgttaagggcagccagagagaaaggtcgagttacccacaaagggaagcccatcagactaacagcagatctctctgcagaaaccctacaagccagaagagagtaggggccaatattcaatgttcttaaagaacagaattttcaacccagaatttcatatccagccaaactaagcttcataagtgaagttcaatagaatcctttacagacaagcaaatgctgagggattttgtcaccaccaggcctgccttacaagacctcctgaaggaagcactaaatatggaaaggaaaaaccagtacagccactgcaaaaacaaaccaaaatgtaaagactatcaacactatgaagaaactgcatcaacaatgggcaaaataaccagctaggatcttaatgacaggatcaaattcccacataataatattaaccttaaatgtaaatgggctgaatgcccccaattaaaaggcaaacactggcaaactggataaagagtcaagacccatccatgtgctgtatttaggagacccatctcacatgcaaagacacactaggctcaaaataaagggacggaggaagatttaccaagcaaatggaaagcaaaaaaaaagcaggggttgcaatcctagtctctgataaaacagactttaaaccaacaaaaatcaaaaaagacaaacaagaggattacataatggtaaaagaatcaatgcaacaagaagagctaactatcctaaatatagatgcacacaatacaggagcacccagattcataaagcaagttcttagagacctagaaagaggcttagattcccatgcagtaatagtgggagaatttaacaccccactgttgatattagacagatcaatgagacagaaaattaacaaggatattcaggacttgaactcagctctgcaccaagcagacctaatagacatctacagaactctccaccccaaatcaacagagtatacattcttcccaggactacatagcacttattctaaaattgaccacataattggaagtaaaacactcctcagcaaatgccaaagaacagaaatcataacggtcactcagaccacagtgcaatccaattagaacttaggattaagaaactcactcaaaactgcacaactacatggaaactgaacaacctgctactgaatgaccactgggtaaataacgaaattaaggcagaaataaataaattatttgaaaccaatgagaacaaagacacaacgtaccagaatctctgggacagctaaagtagtgtttagagggaaatttatagcactaaaatgcccacaggagaaagtgggaaagatctaaaatcaacaccctaacatcacaatgaaaagaactagagaagcaagagcaaataaattcaaaagctagcagaagacaagaaataactaagaccaaagcagaactgaaggagatagagacatgaaaaacccttcaaaaaatcagtgaatccaggagcagattttttgaaaagattaataaaataggccgctagccagactaataaagaggaaaagagagaaaactcaaatagacacaataaaaaatgataaaggggagattaccactgaccccacagaaacaaaaactacaatcacagaatactataaacacctctatgcgaataagctagaaaatctagaggaaatggataaattcctggacacatacaccctcccaagactaaaccaggaagaagtcaaatccctgaatagaccaataacaagttctgaaattgaagcagtaattaatagcctaccaaccaaaaaaagcccaggaccagatggatttacagccgaattctaccagaggcacaaagaggagctggtactgttccttctgaaactattccaaacaacagaaaaagagggactcctccctaactcattttatgaggccagcatcatcctgataccaaaacctggcagagacacaacaagaaaagaaaatttcaggccaacatccctgatgaacaccaatgcgaaaatcctcagtaaaatactggcaaaccaaaccagcagcacattaaaaagcttatccaccacaatcaagtcggcttcatccctgggatgcaaggctggttcaatatacacaaatcaataaatgtaatgtatcacaaataaacagaagcaatgacaaaaacgacatgattatctcaatagatgcagaaaaaggtcttcgataaaattcaacaccccttcatgctaaaaactgtcaataaactaggtattgatggaacatatctcaagataataagagctatttatgacaaacccacagccaatatcatactgactgggcaaaagccggaagcattccctttgaaaccagcacaagataaggatgccctctctcaccactcctattcaacagagtactggaagtcctggccagggcaatgaggcaagagaaagaaataaagggtattcaagtaggaaaagaggaagtcaaattatctctctttgcaggtgacatgattgtatatttagaaaacctcatcatctcagcccaaaaactccttaagctgataagtaacttcagcaaagtctcaggatacaaaatcaatatgcaaaaattacatgcattcctatacaccaataatagacaaacagagagccaaatcatgagcaaactcccattcacaattgctacaaagagaataaaatacctaggaatacaacttacaagggatgtgaaggacctcttcaaggagaactacaaaccactgctcaaggaaataagagaggacacaaacaaatagaaaaacattccacattcatggacagggagaatcaatatcatgaaaatggccattttgcccaaagtaatttatagattcaatgctattcccatcaagctaccattgactttcttcacaaaattagaaaaaaattactttaaatttcatatggaaccaaaaaagagcctgtatagccaagactatcccaggcaaaaagaacaaagctggagggcatcacgctacctgacttcaaactatactacaagactacagtaaccaaaacagcatggtactggtaccaaaacagacatacaggccaatggaacagaacagaggcctcagaaatgacaccacacaactacaaccaaatgatctttgacaaacctgacaaaaataagcaatggggaaaggattccatatttagtaaatggtgttgggaaaactggctagcatatgcagaaaactgaaactggaccccttccttacatcttatacaaaaatcaactcaagacggattaaagattttaacgtaagacctaaaaccataaaaaccctagaataaaacctaggcaataccattcagaacacaggcatgagcaaagacttcatgactaaaacaccaaaagcaatggcaacaaaagccaaaattgacaaatggaatctaattaaactaaagagcttctgcacagcaaaagaaactatgatcagagtgaacaggcaacctacaaaatggaggaaaatttttgcaatctattcatctgacaaaggggtaatatccagaatctacaaggaacttaaatttacaacaaaaaacaaacaactccatcaaaaagtgggtgaaggatatgaacagatacttttcaaaagaagacatttatgtagccagcaaacacatgaaaacaaactcattatcactggtcattagagaaatgcaaataagaaccacgatgagatgccatctcatgccagttagaatggcgatcattaaaaagtcaggaaacaaaagatgctggagaggatgtggagcaacaggaacgcttttacaccattggtgggagtataaattagttcctccattgtggaagacagtgtggcgactgctcaaggatctagaactagaaatactatttgaactagcaatcccattactgggtatatacccaaaggattataaatcattctactataaagacacatgcacatgtatgtttattgcagcactattcacaatagcaaagacttggaaccaacccaaatgcccatcaatgttagactggataaaaatgtggcacatatacacctgtaatccagtactttgggaggccgaggcgggcggatcacgaggtcaggagatcgagaccatcctggctaacacgatgaaaccccatctctactaaagataccaaaaaaattagccgggcatggtggctggcacctgtagtcccagctactcaggaggctgaggcaggagaatggcgtgaacccgggaagtggagcttgcagtgagctgagatcatgccgccactacactccagcctcggcgacagagtgagactccatctcaaaaaaaaaaaaaaatgtggcacatatacaccatggaatactatgcagccataaaaaagaatgagttcatgtcctttgcagggacatggatgaagctggaaaccatcgttatcaacaaactaacatgggaagagaaaaccaaacaccacatattctcactcataagtgggaggtgaacaatgagaacatatgggcacagggaggggaatatcacacactggggcctgtcggtgcggtggggggcaaggggagggatagcattaggagaaacaactaatgtagatgacgggttgatgggtgcagcaaaccaccatggcacatatatacctatgtaacaaacctgcaggtctgcacatgtatcccagaacttagagtataattttaaaataaaagaaagaaagaaaaagaagacatgctcccatgtgttaagcgggtttcctgcagaggagggctcatttttacataagattcccaaagcagcctccttatatccagagtgtcagagattttacttttcttcttcttttttcttttcttttttttttttttgagatagagtcttgctctgttgcccagtggcgtgatcttagctcactgcaacctccacctcctgagttcaagtgattcttcctcctcagcctcccaagtaactgggattacaggcgtgtgccaccatgtccagctgatttttttttttattttttgtagttttagtagagttggagaggctggtctcccaactcctggcctcaagtgatctgcctgccttggcctcccaaagtgctgggattacaggcgtgagccaccacacccgactgagagtgtcagagatttgtcaaagggcctgcaagtatcctggcctgaaacctcacaggctgcttctgaatgataaaaactgacctgtcacttctgcaccattggtttctggtcttccatcacttccagcctcgaagggtgctcccacagcttagtacctgcataacaaaccccttaccccagcatatctaggatgccaacaactgtaaggcacaccacaagagaaaatgtatgctgccaataaatgctgacgtgttatctattgtaaagaagcatgcaggccctggcagtgttgaaatgtgaaaatatgcacatccagcaatcaaaacacctcatgcatactacaatattaacagagattgttttagaattatgaaatcagggccggtgctttggctcatctgtattttctaaactttctatggtgaacgatattactgccaatatttgaaaaatggtaaataaacattattttaaacaaaaaaaatgaaatgagccaaccagaactaccatgaacctaatgaaactaaagctttgtggccttccaaaggcccctggaagaagccctagtttgtttatatttgtattttttgttatttgtcataaaacaacccctcaaactacacatgcttcaggccccataaagctatgagctgtcttggattcaacaaatatggagtacctaacaagtccacgtggactgctttaaaagacagacagaaatagaaacatttcagcttaagtgaggatacaagcaagcccagataaccacaccaaggcaacaagaccaataatccctctccctttcctaattatcactcctgctgctatggactgaactgcgtcctcccaaaattcgtatgttgaggcactaaccccaatgggatggtattaggagatggggaggtgatcagggatagatgaaaccatgagtgtggaggccccatgttgggattagtgaccttataagaacaggaagaaacaccagagctttctgtctccaccatgcaaggacacagcaagaaggtggccatctgcaaaccaggatatgagccctcaccaggaactgaatctgcaagcactttgacctgggacttctcagcctccagaactgtgagaaataaatgtctactgtttaagccacccagtttatggtatcccattagagagcagcccgagctgactaaaacacctccatactccatctctagtgattataactggtgatgcacaaatccactggtaaactgtcagatattgaagccaccaccacgctctatagtttggttctgttgaagttttataagtaaataatgaactgccaatgttgtataaatgctatggggaatattcacccaaggattctttcttttctctgaaatctctcatattctttaaaaagtcagcctcttttcatctgcagtgagattttctctctaaatccttctttaaacactctttttgtgtgacgtcttagccttaagtactgagccttaaagaaaagctgttttccactcactgccttgttttacatatgctctccctgagctttcaaaatggcaaaataaagcatcttagggaccacaagggccgcctgctttgaactacccagcagtaaaggggccaagtgacaaagctagtcggtacacccggcccaaagcaccctaaagccaaacacaacacaacactttgtcaaattaattattaggctgcatcaaaatatgaagccactaaaagtggatgtactctatttgaaaaggaattttaaaaccctaaggttccacggaacctagtttgaaaaccattggtcaacattagcaagaagcaaacaaaatgaggaatttttccctctgcaaaaccatgtcccctccaccttctccgtggagggaagacacagtgttgatacacatacctgccatgatacaggggagagtgcatgacacacatttaaaaaggcgtggggtgaacaggcaattctcattttagcaagactgttagaacttcattcagccaatgatgaacatgtgctccactttgaaaacaaaaggcagccttgtctcacccatgactctctgtccctattccacaaggagcattcccacccaaatgcaagctctcagcttcatggacacgctaaggaggctctcaccaggagcacctccgagtccatgtccacatctctgcagtatggccccagccagatctggagcacattcttgtattcaacacatttataaagtgcctcatcaatacctggcgctgttcttgaccatccgtgaacaaaagaaacaacaatctcacccttgcagtgtctacattctagaggggagagacctcctaagtaattaaattgggcacaaaagaatgatgagtgctccgggggaaaaacagagcccagatagggggagcagggagtgctggggcaagtgttttgcttctgtttcggtttttatgtggtaaaaaacatgtaagatttaccatcttagccatttttaagtgtacagtactatagtgttaactacatgtaccctgtttgacaacagatctctagaacttcttcaccttgcaaaactgaaactctatatccaatgaacaactctcctttccccctccctccagcccccggcaaccaccattctgctttctgtctctaggtgcctcgtatgagtggaatcattcagcatttgtctttctgtggctggcttatttcacttagcataatgtcctcaaagttcatccatgttgtagcctgtgtcagaatttccttccttttgaagactgagcaatcttccactgtgtatacagaccacattttatgtatccactcatctactgatggacacttgggtagctcccaccttttggctattgtaaacaaggcttccatgaacataggtgtgcaaacatctgttcgattccctgctttcagtgaagacctagttttaaacagagctgtcagtgtggttccatgcctttcctttcctctgcagccctctgtccaccttctctgtaggggggaaattcccactttagtctatttcctggcactatttcatcagtagctatgcaacccacacctgcattttcagaacaactcccacaaactgcagaggactcaatatcacctattttctaaagatggatttcttcaaagcacagggctgttgggaccagagtgcaataaaagagtgaggaatggagaatgaaaacatgaatcatgaacgtgagcagctggctctgttttcagaggcacttgtcagttcccccaaaagacagcccctcatcatgtccttcaacacggcaggatagacaggacaatgtcacccatgctcccaagggcccccctgtccttactgcctaggaaagaacggccccttgatggaatctctgtctgcatgaaaacctaccacgaacactttcttcaaagttctggaaagaaaagttttgacacctgttaaaggaatttcaagaattcaaaattaagtggggacttcccaaagtctcaaataatcatgacacaacctactcaaccatggaacaaatcctgactgcggagcaggacccccagctagacagtgcagagcagccagagtgggtcagacctgagtcctgacccgaggactgctttctggaggtagatatgagaccccaaatatgaacaagatgcactagggacccaggaaccaggagtgctgatatccaaaggtcggggggatgatggatgtcccaattcgagaagagagacagaacgcacccttcctctgactctctgttaagactggcaacaaatcggatgatgaccacctgcattggtgaggatgatcttctctactccgtctactgattcaaatgctcatctcttccagaaacaccagctatctgggcatctgttagcccagtcacataaagttaccatcacaaaccacaaggaatgaattctgctggcacctgaatgagcaaggaaatggattctccccaagagcctgcagaaaggaacaagaccttgactgtaatccagcgagtcctgtgttggagttctaatctactgaactaaaagaaaataaatgtgttttgctttaagctgttaaatgtgtggtcatttgtaacagcagcagcaggaactaatacagccactttaatgagcagcccaggtggctagtacaactgatggggaatgtatcccctggccatatccccaggtgtgtgcccgagagtatcactgtccaaccaaactctctgcagtggtagaaatgttctatacctatgccgtcaaatatggtagccacttgtgaccattaagcccttgaaatatggctagtgcaactaaggaaatgaatttataatacaggtcatcttaattaccttaaacttgaatagccatgggtgatcagtggctcctacaatgaacagcagagcctcaagcagaggttcttaaatgttgctgcatattaggatttcctggagagatttttttttaatgctgatgcccaagctgcctcccagatcaattaaatcagattgcacttaggggatgggacccaggcattggtatttttaaaagtctccaggggttctaacatgcagccaagtttgagattcagtgacccagggaaacggtcacacagggtacacacagtcagatacatggatggtaactgaacccctgccttggaatgtcaacaaatggcaaacgctaaggtttccattcatgcaatggaatagaatgtccacagcaattaaaataaatgcatggatctatacataccaacaatggtaaatacagaaaacacaaagttgacttaaggagcagaaacactagtaacaatacaatatcatgtctatgaactttgaagtgtacacaacaatactacctgttgactataaacacatatagtaaaaagcataaaaacttggacaagaagaacacacaccaactgcaggctgggggaaacctgctgggaaatgagagcaaaggaggggatgggggggtgcaggtacaaagagcttcacttccatgcagcaatttatttcactttagaagatgtgaagcaattatggtaaagtggtattatttgctgtagctccatgttatgaacacaagtgtgttgtcatattttctctattcttttctgggcgtataacatttttcataataacaaaagagaccaacatatggatctccaggcaggaagagtttatccctgggcgggcagcacagaggagggtggttctctggggtgagttaggctatgtcatattgaggaatttattcctagtaggttttccttcaaatggaaagccaattgtcttccagaatttaaggaaataaaacaattatgagccaaaaaaaaaaaaaaaaaaactactggacaacaaaatctggccaaaggtgagtcaggcaaaataaagaagttagaaatggccttagtaaaggcagcatggcagcagctcaggaggaggagaggcaggttggcagggttctctgagcacttaaacataagactatgaggaaataccacaggaagcgggggagcagcggagagcaaatgctatcaacctcatcccacacatgcaacaatttgcaacaatctagccacgggagggaaatgataatattagtgtgccagacactgccctaagtgctttacattataaattataataactcaactgttagaataattctacaagatactgctattacttctatcttagacgtaacagagggaaactgagtcacagcaagtttggtgattagcctgaggtcaagtggccaagatgggatttgaacccagctgtctgggtcccaaatgttaacccctacattataccgttctttgaaattaggtatgcctgcactaatgtcctctgcgcttctacacttgaacttcccgttgtaaaaaaaaggactctaaccacttaaaaaattctatagccttttctacttgactgtgaagcatattcatattctttttcttgttaaagtaaatttcaaacttaccatttatcctgaaagtaaaatgtataatatataactctttggacacacatcctccctttacatccatgaacagcgtgatgtcgaagtcccgctcaccaatgtctatgaggggttatttgtgaaaggtgacattttatgtcatttttcttcttctgtttttccctggctttactgaggtacacttgacaaataaaaattccatgtatttaaggtctacaaggtgatgtttttgtattcaccttgcaaaataattaccataatcaagctaattaacatgtccattacctcacatagctctgatgttttgtacatggggcgagaaccgcactgctgggtgcggtggttcatgtttgtaattctaacattttgggaggctgaggcaggaggatgggttgaagccaggagtttaagaccagcctgggcaacacagcaagaccctatctaattaggcatagtggcacatgcctgtagcagggagacagaggaaatgggtaacttgagcccaggagttggaggctacagcgagctatgattgctacactccagcctgggtgaaagagtgagacctagtctcaaaacaaaacaaaacaaaacaaaacaaaaaaactactctcttagcatatttcaagtccacaacacagcattctcaactatagtaaccatgccgtacgttagatcttcagaactcattcctcctgcataactgatacttagtatttttattctttctacttttctgtattgctggaatgttttatagcaggtattcataaattttcacaacaaatgttcagttaatgacatttctaaaaaaacaaataaaaaagaaaataccaataaatgcacctcctatagaaacacaaggaaaaggaggcgtgccatggacatgaggagggagaacacacctctacatctgtaggacccaggacagtccttctggacccgcaacccagaggactgcaggcaggcagcacctccctgaatccagggtagacagccgggaagggcaggaggaaggccacaggcatggagccagatgaggtcaacaggaatgccatggagacaacagctataaccacagggggaaacccacgctgaaggaagtaaaaatcagaacctacaccctggaaaaccaaactagtgacacaggggaaagcttcagaaattctcccagaatgtcaaaatgaaaaagaccaccacctgacaaagcctcttatggcaagaacagagaggaaggtcacagatgacaaggacaacagagatcaagggcgtttcaagaggaactgctaactcttttccaaagaaaggtgtgcactactgcgacacaaaagcagacccttgctctatggaagaaaatccctctccaccagtgagtacttcagagactgcctgaaatgctccccaagctgttctcagtaaaagcaccaagtcctcttaccaagtcaggaaaacaagcctgcatatttatttggagcactacatttcttggtattctaaaataatatacacctctttctctctctctctctctctcacacacacacacacacatacacacacagagtagataaaaagtcccctttaagctaaagttgggagctcaagtacaacttcaggattatcaataaatatacagctgaccttggaacagcacaggtttgaactgggcgagtccacttatatgtggatttttttccatcaaagttacactgagtgtgcctgcctctcctgctgcccctcctacttcctctgcctcttcctcctctgccaccccgagatagcaagaccaagccctcctcttccttttctactcagcccactcaatatgaagactacaacaaagatgaagacctttatgatgacccacctccacttataaatagtaaatatattttctcttccttatgattttcctattaacatttcttttctctggcttactttattgcaaaaatacagtatataatgcatgtaacctacataatgtgttaattgaccgtgtttattagtaaggcttccagtcaacagtaggctattagtagttaagtttgggggaagtcaaaagttatacatggatttctgactgtgagggaggttgggtcccatcagggctctgagcccaggctaagccatcatatgccctgtgacctgcagtatacatccagatggcctgaagcaactgaagaaccaccaaagaagtgaaaataggcagttcctgccttaattgatgacattccaccattgtgatttgttcctgccccaccccaactaatcaatcgacctagtgacattcctcccctggacaatgagtctcaaaatctacccaccctgcaccttgtgacccccgcccctgcctgtaagagataaccacctttaactgtaattttccactacctacccaaatcctgtaaaactgccccactcagcccacttgcattcaagtaaaataaacagccttgttgctcacacaaagcctgttggtggactctcttcacatggatgcgcatgacgggtcccctaacccctgcactctttgaagggccaaatgtgcattatgtgacatggataaaaattaatgtttttctaaatggcaaagtctacaacctacaaattgaagaatagttctagcttcatctgaagtgttattgaagaacaaaaataatattctccataaatatagcaggcagatatacatttttaaaagtctcaactaaagctgaccaatgcaaacaattatttatttaggtgatcaaatagcaaactgactgtcagagacccattcaacctgtgatatgtgacctatgaattcactttctaccttcatgcttccaaaattatctagattactcactatcaatatttttcaccaagaaacaatggaatcctgagtctggtcacctgaccctatattaaattgtacccatcaattctacaaaacactgcccatgtttcctataaaaaaaaaaaattagaagaataaaagagtaatccacatacaatgtaaagctaaaaaactgcattggaataaaaaacaaaattgaagtattttatgaaaacctacaagaactaataagtgagtttaggttagcagggctgcagaatacaagagcaatatacaagatgcaactgtatttctatacactagtagtaagtaatcagaaagttaaatttaaaaacaataccatttacaatagcatcaaagtctgtaaaataaataggaagaaatctgacaaaagataagtaactcctgtacactgtaaactacaaactactgtagagaaagattaaagaccaaataattgggaagatataatgtattcatagggcagaggactcaatattattatgacatcaactctccccaagttgatctgtagaagtgcttttcaaccacgggtgattttgtcactccgggagatatttggtaatgtctggaggcactgttggttgtccctacttggtggcagaaggtactgttgccatctaatgagtaaaggatgggatgctgctacccaccccacaatgcagaagacagccccacaacaaagaattatccagcccaaaatgtcaacactcccagtgccgaggtggaaaaatcctgatgtacagagttagtgtaattccaatcaacatcccagcaggctttgttctaaaactgacaaactaattctaaaattcgcacagaaattcaaaggatatagcatagccgcaacaactttgaagaagaggaacaaagagaattaacataacctttcaagaggtttcaagaattaagtcaaagtatgttaacagacaattctccatgaacttctgcatatgtggtttttctaaacaagcagcactgtaaaaataaggatagaggatttgaatgccttgaaagctagaagtagtataacgcccaggagagatttagagacatatctgtcttgcaaccatttgctacctttcagtaaaataaaactagggaactttcctcctctccccagagaggatttgtttagattgcagagtaagagtctctccctctttgtctctggggcagaaaaagggcaaagttattagacaccctatagcaattcaggggcctctcctgaacagcactgcacgcacaggggagtaagtggcactgaccacactgtcccttggggaattgacactagttggcactgtgaatataaaatatttcctctgatccagagacattgttcctcatcagaatatatacatacacttaaacacacacacacacacatttttaaaacacattaattaagacagtgtggtgttggcatcaagacagacaagtagaccaatacagtataatctctactgcagaaatagatccacacatatacagaaaaaaatctttgatagaggtgcaaaagcaattctgcgaggaaaggatagtcttttcaacaaatggtgctggaaaaactggatatccatctggggaaaagatgaaataaacctcaatccatatctcataccacataaaggagttagtttcaaatgaatcacagacataaatgtaaaacatgaaactataaaatctgtaaaggaaagaatggaaacaaatctttataactctggattaggcaaagatttattacatatgacaacaaaattttaaatgtggcatcttcaaaacacactgtaaagggaatgaaaatacaagacacattccaggagaagatatttacaaagcatatagctgatacaggtcttgtacctagaacataaaaagaatcctcaaactttaataaaaatgatgtcaacaaaaatgccagagttgaagaccaatgaaaattctctcttccataaaatcaatgagaaaactggcagaaagtgtcagaatcaactttttcagaaccctaaaaattaaaaacagattgcagcaatctgatgagtgcttcctcaagaaaaatgtctgaatctcggtaagaacaggtgagctttgtggcacattagcttggtgctattcccttcccacctacccgtctcggcaggagccttgcaaaccaatagcccacaatcacagtgcatgtgagaaccctggcaaaacatggctggagctccttcaaattctcattcccagagaactgacatgaaatgacctgtctgatgtttctctagaagaaaccacctagaaggctgtttttatttgacctgactcagaccttgctcagtgtgacatgtctttagcctcggggcatttgctgaaaacagttgaaggtgatcattaaccacaacagctgctagaggtggtggttaacaaaaaggcaaaaagaggctaaccaaaaagcttaaaggaaaaagccatggaatgaaacgtctgtaggtcctttgaaaaactccaataaagtgctgaaaattaaaaggccacatgcacacaggctgtgtacatgccaagcactgtgttcatgctcaggaaaggcctgggaaggccctaagctctcatctccgactgaccttgaggctttgcacaagcaggaagggaagacgaaggtagggctgtcaactgcctgcctggctgagtagtaaagtaacatttgcagatgacttccttagaaaatcttaaggaatccacaaaaatactgttagaggtaataaatgagttcagcaaggtttcagggtacaaaaatcaatacacagaaatctgagattcctgtacatgtgcaataaacaatcaaaaactaaagtgaagaaaacaattccatttataacagcataaaaaatacaatacttaggaataaacttaacaaaagagatataacttgtacactaaaaactagaaaagatcattgaaatgaattgaagaaagcttaaagaaaagacatcccatgcttctgagctggaagacaatattgtttggatggcaatattctccaaaatgttctacaaattcaacacaacccttataaaaatcccagctagatttttttttttttttttttttttttttttgcaaaaatggacaagttgatcctgtaattcatacggaaatgcttggatccagaatagccaaaacaatcttgggaaatcaaagttggaagattcacatttcctgatttcaaaacttactacaaagctactgtaataagcccatacatttatagtcaattgattttcaacaagagtgtcaagtcagtataatgcaaaaggaacagtcttttcaacaaatggtgctgggacaactagatagccacatgtgaaagaataaaattgaacccttgtctcatatcatatacaaaatttaagtcaaaattgatcaaagacctaaatataagaggtaaaactatgaaactcttagaaaaagatatagatgtaaattttcatgatgttggattaggcaatgttttcttagctatgataccagaagaacaagcaaacaaaaaaatagatgggatatcatcaaaattacaaattttgtgcttcaatggacaccatcaagaaagaaagacaatctacaaactggaagaaaaaaattgtaaatcatatgtctgtacaggtctagtatccaaaatacataaataactgttacaactcaataataaaaagacaactcaattggaaaatgagccaaggatttgcatagacatttctccaaaaagagatttgaaggaccaataagcacatgaaaagatgctcaacatctctagtcaggagggaaaagcacatcaaaaccacagcaagaaagcacatcacaatcacaaggatggctgtaataaaaaaaactagaaaatacatgtgttggtgaggatgtgaagtagaacccccacacattgttggtaatgttacgggcaggtctttgttcttagagctcccaagatgtggcagaccactcccaagatggcagcaagccttttgttctctgacctggggttcttggccttatggattccagagttttatagctctattagaagccgtaggtcacggaagagaaccatggaacccagcgactagtgttcagctcgattaggatgaacctgggcactcagccgtgcaggaacaatggcgagcctttagcccagtcggaagcagcaatgggcgcctcgctggatcaggagcacagcagacaccctgccagatctagaggggtgtcagtcagtggcaggtctgcaatggcagccaacagcagtggtggacagcgagcgaaagctcagctcaagccataacaaacatggaccagaagagtgtgcagttgcaagatttaatagagtgaaaatagagctcccatacaagggaggggacccaaagggggttgcccactcccggctcgaatgcctgggtttatatcccgatcattgtccctccccctgtgctctcaggcgatatatgatttcactatttctttacctcttgctttagcctagtttgtattttagtgagccctctttactacctgattggttgggtgtgagctgagttacaagccccgtgtttaaaggcaggtgtgatcacctttcccagctaggcttaggaattcttagtcggcctaggaaatccagctagtcctgtctttcagtaagaatgtaaaatgaagacactttagaaaacaatttggcagttcctcaaatggttaaatccatagttacatatgacccagtaattctattcctaggtacatacccaagaactgaaaacatgtgttcactccaaaacttgtacaggaatgttcacagcagcatcacgcataacaaccaatgtccatcatgcgatgcatggataaacaatggaatatacaactgtttactggaatactattcagccataaaatgaaataaagtattattagatgctcacaaaatagacgaacctcaaaaacattttgctaaatgttaagaaaatagaccactaccaaaattctttcaagaggtaaatgagtaacaaactgtggtgtagccacccactgggatactaccaggcaattaaaggggctaaactaggcacatgaaacaacatggatgaatctcaaaggctttatgctgagtgaaaaaggccagtctcaaaaggttatatgcggtataattccattcacataatattccgcaaaagacaaaactatagtatggagaactggtcagtagttggtggctggcatgggtttgagaggggtatcacaagatgaagccattttacaaggtaatgaaactggtctctaacctgattttggtgatggtaacaggaatggatacatgtattacaattctcagaactgtatacccagaaaacaaaaataaaaacctaaccacaaacagaaagtaaaaacacagaaataaggccctcctttcctgacatgcacattctttagtaactacgaaagtaatttcttcaacttcaaaaagcacaagtttaactgatttatttcaagaatgagctaatcaattctgtatttattaaatgcaaatgtttccaatgggtagatttaatatgctatggcaggagaaaggtacattctataccctgaagtacaagaattgattgtgcaagcttggatgcaaaaagtaaaattaaaattccatgtacgtgatatagtgctacacctggcaaaaagcttttctgtagagtgaactgaaaggcacttgcaaacaactcaatcatctggttaaaaaagaaaagaaaaaataggatcacaactctctcttgttacagggaaagtgtccatcttccaaaaaccaaggctcccctcacgcttctcaaagatggtgtccctcttggacagcctctgactctccacatcattccctctttcctccaacccccactgataaattcccaccttagaggcaagccacagcccacagactgctacttcttaatctccccctgtacagagtattttctttttttcagagacagggtttcattccatcacccaggctagggtgcaatagcgtgatcatagctcactgcagcctcaaactcctgggttcaagcaatcctcccacctcagcctcctgagtaacagactataggcacatgtcaccacacctggctactataaaaaaatttttttttttttaaagatggtgtcttaacgatattgcccaggctggtctcaaactcctgggccatagcaatcctcccgcctcagcctcccaaagtgctgggattacaggtctgagccactgtgcccagcctggaaaggatcatgtttgccccataccttcccatctttccagtcgtgccaacctaacacccccagagaaccatgtctgcctccacactcccactctcccttccatcactcccatctggcctcctcactgattttccacaaaacctgtcctcaaatggtcactaacgatctccatgctgtggaatccggggggcacgtgtttgtccatttgctcagcttctcagttgtcaccaacccatttggccacactttccttctgctgatattttctgctttcaacatccttgaaaccacaccctcctgcttttcccccagatctggccacactttcttggtttcctgtggcagctcagcctgctctcctgagcttctaaatactgaggaaattcctcatggccaggccatgcccccgtttctccacactcttcaatttgttgcctgcctgcatccaatgccatccgtatgcacctgctcgctctgtttcatcggcccaacctttgctgggtttcaggacattttctaattagtctgtgagatctaagtagatgtcccattaaaaagggggttccatgggaaaatacctttgagaaacactgcttcacatgatgccccccagccaccccacgatcagctgatgagtctttaggaaaacaaatctgtctaaaacattcctagaaaaataatcccaacaatcaatagtttgtgtccctgttgtaggctcaggtatttcacaaaatccttctcatcttccccactgaaatttagtctcgtgtgaaatgaaacacagaatttactactttactcctaggtaattcccaagatcacctgcctcacttcctccccagggcacaaaatcagagatgtgccaacagaaggcatccactgcagaccctgtaatcttgccaccaccattcttcatgagccatggagaagcttatagaagctggactcctctccccagaaaaataaacacacacacaacacacaaggatctgtatgtaatctcaaggtctcaccccaggaaattcaccccagggtccatgaattcaaagtaagcccccctcagtaaggatgcttcagcggacccctctgattcacaggggtctccattctcacgggcttgctggtttcgctgctaagattatgacaaactagggctgatgagaccttgcttcactccagcaacacaccagtgcaccataactgaggcctctctgcacacatccgccctgcagacaccgtgcattcatccatttggcaaacactcactgagctcccctaccttccaggtgctgtgctaggtgaaggtgacaaactccatgatccttgccctggggagcagacctcctggtgaacagacgcaaacaataagcacaacaaatgacaggttgtgatggcattataccaaaattcaaggggtcatctgacggggtcagatccttgatattgggtggtccgtagtatcatgtgacagcatctgagattgcattccataaaaatcccatcaagatttgtaaaacctcaaagtccttcaaaataagaagatacagtctcaatgttaaaggctgaccaaaaaaaaaaaaaaataggatgagttggaagagaagctgcatgtccttccaaactaatgaagtgatgctcctcctcttggctccccactcccagtagaaatccagccgctagtacccaagtgagagtgacacattcctgcctagcaagcctacagtacagaccatctggtccactggccttgtgcccacttgaaagataacaagccagtttccaatgataaaggaacccaaaaataaagatgtaaaaacagagcccctgaaatgagtcaaatgatacttcctcaccaaacacatcttctgatagcaaatcaagtccaaaggtctcattacaaagaactgtaattctagatagtaggattagctccaccatgaaatctatatgccaacgctctttcgtaattcacttaaaggcccactcacaggtaattcacttaatttcagatctctgcacttgaaaatcacattttttgtgtttcaaatggaactgtctaaactccatccatcgcagaacagttatatagattatgttcataaaattttgtatatacaaccattaaaaataactgggtaaaactatgttactcaagtgatatgtattgttttatctgcgtaaaactctattcttcttgtaaattctcctttgtcccatgtgattgtacttgaaacttccaattatactctttctagcccctccccagccactgtggctagtccagagataggaccatgacatgaaaccagcctatttgagtcttccctgggattctccaacctgcaaaacaaaagcctcttgcatgtccggtcaaggagctgtgggcacataagctcccaagagctgcaagtggcagagggtccacataaaggtggggttgtgagggcgtggaggggtgtgtgagggtgtggaggggtgtgtgagggtgtggaggggtgtgtggtagctaatccagtaaaggcacaggaaggctacgcctcactcagtttctgagtatcttctctatgaagtcaaaagaagtttgaggatgattggtgccattggtgaggcaggttaagcatggttaggactggctagtttgaagaatccagcagcctctgggctggaggggctgtcatgagttgtctggtacctggctctgaggtgtttagggctggtggaccgtggcctagaaggtgagagccagaagaagtgctggggaactgggctctaggctggctggtttgcattctgaaaggctcactcacaggtgagccattaccacctgcaggaatcagctagcctgggagggacagtccctccagcatcagcaaggccccagatgccagagcacccaaatatacagaataaaagggcacaatgaacacacaccaaaaccttgtctcacagagaatgacacctagagtggctgattgacttgaccaagctcaaatgagctaataaaatttctaccttagggtttacacagcacttacaaactacctcattttagatatagcaaaaactctaaaacatcacaggtttatggccattctgaatctcaggaaaaccgaaggtcagagaagttaagcggtgtttctttagtcatctgactaaagacaaacagagctaaaatgaagctacatcttcttgtctagccttttgcatggattcttcaccacacggcctctgcagacctcaggccccacctaaagctccattctgatggatgaagcccagggcccctcgtgcttataagtcttggttggggtggtctttcccgctcacatctcccatgctcggatgtacggaaggcgcctaggtggggaggggacgctccagaaaatgcaaagctcttccgaacaaggctttagtatccacctgcagctgccttctcaccctagggaactggactgaacaacttagtgctccctgagcctcgcccagagcaatggttctctgggaatctgtgcgggtgctgggttgtcataatggctgtgtagttcctgacctatggggaaaagtggccagggatggtagccatccatctatgcaaggagtgttaacctttacgtgttaatgtaggtgaaacaccaacttataataatcacaacctaaaacttgcttccacttttaacctccaggagttttctcattgtttttatatacactaaggtgcccggcactgcaactaccagatcgatcaagcgaactccaacgtgtctggaactctaccaagagcggttcaccactttggaaaatcatgtccccattgacaaggacactccagtgcaacatcctgtcctgctgtgcggctgccgtcatgtctgtggtgatgggtggaggtgcaagcacccagtcgttccctgtgtctcccagtggtcaacatgcctaagcacagaaacatacattattttcagtgaaaattacatttagggctttgtaatgctttttggaatcgtaagtgagaatacggtgcactttctatgacttccatttggggatatagcaaaaacatcatgacaaagggctgtggatctgacagagttccaaccacaggcccagagcagactctggccagacacctcctgtagcctttcctttgagccctgtccttgatctcgatccagttagcatttcaaggttcaaatgcagacccatcccaaaacggtgccgcacccaagtctgggaccaatgacggagagaagagggaggcacctgcctgcattcttcccctcagtggctctggccacacatggagtcgtgggctcccctgtgcactgttctcagcctcaggtaggctgtgttctaccttccccccagttttcttcttacctacgagggctcttgatttctcctgactttgcaaatcctttatgcgtgacagtctcgccttgagaagacagggaggtaggggacgggaagccagcaattttacccactactgattcattcaagaaacacaaatctgaatgcctactattcattttaccagggctctttgcagacacgccagactttcaaactagccatcatcatttaacatctttcaggatttcacattagaagcttttggtaactgaaagtggactggtgtgggggagggccaggtcccactctgacaagggcctagaagacaggccaactcctgtctgaggtctgaaactgggcagaacatgaagggcagccctggggagggccaaccatggggacggaaggcaaaaggctgtgggaaacccatttttaaattttttaattcatttttaattgacaaataaaaattgtacatatttattgtacaatttgtacaactgcacgtacttcaacatgttgtttgaaatatgtaaacattatggaaagcaaaattgtttctgaggcagggtctcactctgtcacctagactgcagcgcagtggcgcaatctcggctcactgcaacctctgcctcccaggttcaagcgattctcctgcctcagcctggggagaagctgggactaaaggcacccaccaccacgcctggctaatttttgtatttttagtagagatggggtttcactatgttggccaggctggtctcaaacccctgacctcaggtgatccacctgcccctacttcccaaagggctaggattacaggcgtgagccaccgcacccagcttgaaaggctaaactgagctaattagcatatgcattactttgcatccttattttttgtagtaagatcacttaaaatctactcagcaattttcaagaagacaatgctattaactatagtcaccatgttgtacaagagatctctttaacttcctcctcctatcgaactgaaattttgtatacctcagattctaatttttaccctatattacacagagcaattttgaatttatttcgctaaactgtgacctagagaaaatattttattcagaaaacatcactggtaaacaaacagctcaggaagtgatctgtgtttactaaaactttgaaatatattttacacatattctgcattaaaatctgattaaaatgtagttatacaaagagacagtgttttctgatttgtagcattcatggccgagatacactatttaaaaatgcacttgatttaggcatttattcaaaatcataagcataaaacatgatcataccttcctactggcagacacaaaactggtgcatcccacacacttgtttgagtaattacaacaccagctgttctagcacctaccaagagaagctgcaactcagactgactcctggtcactgatgtgccaaacagcatcatcttctaaccaaaaatgaaaatctcactttgataaatgggttgtccaagttaaattagctaaaccaatgcttaagtctaagttccaatttttaaaactttctgtatatgctatactagcaaatgtggatttatctgattttaacacaaaaaggagagactgccaatagaattgatttctgctagattttaaaatctacaaaacctgagatctccccaagaattaaaggcaattctcaggttgaaatatttatgaaacatacaaatttcaatggcatttcacagaaaataaatataaagcattaaatagcaagacaaagattacagccaagactctcaactatccaactgaaactcacttccatatttaccacccaaagacagcagaccctccatgtgctggagcctctacaggaggaaggggaaatggccatgtgctcagtgtgtgttccaatccagggattgtacacaggctactttattcaattttctctgactctggatttcccacaggataggcttcgtagcagcactctacagttggggaaactgaggcctggcaactcccctaaaggctgcccagccaggaagcacccgcccagcaggtctgacgaggcctccattctcttgcagtgcgctatgtctatccactccaaaagccacagcacacacaacttcaactctccagaaaatgtccagtcaccctgtctatatttttcttgtttcataaaaattacgcattttggttggagtagacttatgaccagaaagaggctctctgcaaagcagatgctgcacttgcaatggtgggatgaagggggatggaatgcaatagcttgaaaagtgaccgggacacagcagctggactagactcggggataagaaatacctctctatttttccccaaagttaaatatttctaagcttccacctgttcacctggtgagaaatagcatttcttcatggagtacaagagtcttaagtggtatatgcaacccagaaaatttggcaaacggtccatgatgatcaccattgagctccctgcccataaggtccattgtagaggccctgaccctggaaagtgttctgtctgcagacatctgtggccatcctcaccttggaatttccccttcttagacgagccagtctgacatcagtaaaaaacagaagtcaggcatttctcccctgtagaaagggaacctcccattctggcagaccaagattcaacactctcttggaaaggaagaagggaaataccactcatgcctgcaatgagccaacagcagaccccagtaggcccaaacaatgagaaacaggacagagtttgggtttgctttacatctattccattgtgaaatgccagggccccaggactccccacggctcaggaacgtatggagacgcattaggtggcaatatgtgctgctgcctatagaaacgatatgtgacccacagaaagagtgtcatatgtccaacctaacaccacaccagtgggtcacatctgcaagtgccccttggccaaaaaaaaaaaaaaaaaaaaaaaaaaaaaaagaaggatatgtagccttgctctccttcctaatcaggagctcaccggaacgtgggagccaaccaaaccaaactgtggctccagcttttacaaccctaactactgggaatctattttctcgctggagtgtctgagaggatggagaaatacacactaaaaagggttccgtggagatattggatttagactttataaatgtggctcatgaattccaacacccaaaatggaaaactgggcttccaggatattatactgttttgtacttagctactttatttatacccctcctggttctgaagaatatttaacaggttttatttcaccatgaaaaaaagggttgctttagcaacagggcaaacaagtatacttcttaaatgtctataaatgacccagattagtctccaagtttgtaaaatacttaatctctttcagcaatgaaatgccaagataagagtaaattccaaaaattcttttgagggcatgagggcttacttattgttaagtaggagatgagctaagcctctggtactctcggtccacagaggcaccctataaaaacgtggcaagcccagggcgaggcatcatggaatggaccctgaattctacctcagtggtgccaattcctgagaccttgttaccacaatgtggccaggcacaaagttttcactggccaagacaaaaataagaatagttcccagcacaaaaaaaggcaccaataagtatctgtagactgatggactgataagtgaatgactgatactgtatacttttcaaaagtcaagagataatttattacatgtgaagaacaatccttaaaaataaagctggggccaggcatggtggctcacgcctgtaatcccagcattttgggaggctgatgcaggaagatcacttgagatcaggagtttgagacagcctgggcaacacagggagacctcgtctctataaaaaaaagaacttaaaaactagccgggcatggtggggcaagcctgtagtcctagctgctcaggaggctgaggcagcacaatcgcttgagcccaggagttcaaggctgcagtgggctatgactgtgccgtttgcactccagcctgggcaacagagcaagacatcatctctaaaaaaataataataaaaataaagtaaaaagctaaagttgaacctgagagtgtcccttataacattctcctaataaaatctttttctttgtataataaaatggtgtgataaaagacaatagtttcagtgtgaataaaaactaaacagtaaggccaggcatggtggctcatgcctgtaatcccacaactttgggaggctaaggcagggggactgcttgagtcttgagcccaggagttcaagactagcctggtgagaccctgtctctacaaagaaaaaaaaatttttttaattagccaggtatggtgataagcacctatagtcccagctagtcgggaagctgaagcaggaagatcactcgagcctgggagtgcgggatgcaatgagctgtgattgtgtcactgcactctagcctgggtgataaagcaagaccctgtctcaaaaaacaaactacccaaaaagttagcaactttatgtctgaaccccaaatattcttttttttttttgagacagagtctcactctatcggccaggctggagtgcagtggtgtgatctcggctcaccagaaccccaaatattctcgaactttcattttaactacaaaatctgacagtgtgagaaccactgcttgaagcactggctacaatcccaggaagaagagtggaaatccaagacacaggggctagtcggaaaacattccccaaaggcagggaggcagacccaggcggcagaggagcctgcccaacagccacgttccctcttccctcggacagatccccagctttgttagaggatccttttcccatgtgactcaaggtcaagtgaatctacctcccactctaagaaaaggtcagtattagctaattccccttgccagtgattggttcagggatgatcacatgacttaggtctgaccactgaggggaagtctggtggggggcttctaggaaagatttccttgccactaagaagagacacagggatcagtaacccctcttcttttgtgtacatgtgtcctctgattctggtgcctaaaactacagcagccttctagctggattcaggttaaattaagatactcttaccagcagagcagaaagatggaaaacacatgggtacttgataatgtcaccgaggcactacattaaccaactggaaacctgttatggttgaattctgtcccccataaaagatacatcaaagaattagccaggcatggtgacatacgcctgtaatcccacctactcaggaggctgaggcagaagaatcgcttgaacccgggaggcagaggttgcagtgagctgagatagtgccactgcactccagcctgagcaacagagcctgactctgtctcaaaaaaaaaaaaaaaaaagtcaaagttctaaaccctagtacctcaaaatctcagaatcggagtttatttggaaagaaggtctttgcagatttaaccaaattaagatgaggtcattgggtgggctctaatccaagatgactggtgtccttataaaaaggggaaatttggacacacataccatagaaggatgtggtgaaaacacacaggagagccccaggtgaagacggaggcagagactggactgctgagactgcaaaccaaggaatgcccaaggactgctggccaccaccagaagccaggagaaaggggaggaagggatctatctacctggagtctcagagggagcacagctctgttgatgccttcaggttggacttccagcctccagaactgtgagagaagaaatttctattgttttaagccacctaatctgggcagctctagcaagctaatacaccttctttcttctggacctttttatgtatacgtaacataatatatgtatactatgtaaattaataaattttccttctgcttaagccactttgagtgatgatgtcagtaattgcgattgaaggcaactcgatcaactggtcccaagggaggggactaccaagcagagaaagggtcctaaaggagccaatgcccactagagtccacgcaccgctttaaccagccagcaccaacatccttccttcatcccaaactcacaccgccagacacaaacacaaattgctgctccacacagcatgccgttatccttatatatacaaccaaaagcacacaccacaaattctagaacaagtgcaggacctcaggagaggtccacttcccctttggtttcctcctgattcttcttttagtctaatgtagagattaaactgtaaagctgaggaccagccacgcaccctatatacagtacatgcaaatccaactatttctcctcaaacccttggcctggcccagggccccaccatctctctctggatcattgcattagcctcctaactggaatctccactttgcgaccctggccctccttcaaagcactctacagagctgccaggatgatccggttagaataagttaggtcaggtcactcctctgctcaaaaccctccagtagctcctgtttcattcagagaaaaagccaccgtcctcccagtgactcaggaggcccctactgatggggatccctgtcccatcattgtttcccattgctccccctcttcctcactgcactccgctggcctccttgctgtcctgtgaacaacccaaggcggttcctgccttggcctctgcacttgctctgcccttctccacacttctgcaggtcgctactgaaaaatcacctcattaatgagggcttccctagccatcctttctacaaaggggccttcccaacccctttccactgacccttcacaccccttctcctggatttaacaatacgttttatttatgtggcatgttcattgtccactagaatgcacgctgtaggagggtggggatttttgccaaccttgctacatcccacagcagtgtctgggatagggtctgccacatgcttgaatgagggagagggaggaaagaagaggtgggtgactatgcatgtggttggttaggtcacttagcacggccttgtgttttgtcccagtcatgttcagctgggcagctacaggcctggaggaagcagagagttcaattcagcagggctggagttttgccaacagagtataaggaaggagagaagagccagagagctgaagaggcaaacgatgactgatcataatggctgaactcggaaattattataagttaggtaaagaaggaagtgagggcatgaagagaggacaacatgaaaagataatcaaaggtttatagatcagtgtggggtttaagatcttttgggccgggcgcagtggctcacgcttgtaatcccagcactttgggaggctgaggcgggcagatcacaagatcaggagatcgagaccatcctggctaacacggtgaaaccccgtctctactaaaaatacaaaaaaaaaaaaaaaaaaaaaaggtaggggcgtggtggcgggcgcctgtagtcccagctactcaggaggctgaggcaggagaatggtgtgaacctgggaggcagaacttgcagtgagccgagatcatgccactgcactccagcctgggtgacaaagcgagactctatctcaaaaaaaaaaaatctttctggagtaggtgcacctacattgataatttttgtgtaatctaaaattgtgtttgttcctccttggtctaacaccctcagattccaccagcatatatattagccaagtttgcatccatgtatattagcaaaaattcagttcaagtggcacgtggcatgtaagctttctccctgtggactttataatggcagctgcaccttccctgctggggactgacttcagtctggatatgacaaggggtggtgagggagaaacatcgggagactgccttcccaggtgagatactggggccgggtggaaacgctgcacccgacagaggtcccagcctgcctgggttggcaagcacagttgagagggatcctgagtctcccaatcctctccccaccccccacccccaccagcatccaccagagtgtcagacctcatgcttcctaaatcaacgacagtgttcgggaaccaggcaaggccatgaacacaactgctggtgtgctcagcaaccagaaggatcacactctgaaaccctctgctcctttcttgttgcccccgccttttgtttcagtgcaatcactgcaagttcacgacatgccaggagctgaaagtttcagaatctgggctctgcattctttttctttaagctaatcagcaggagcccctgaatatccaattccccactgcctgccatggacggtgaggagtccaccactcaaccctggctgtactttcactagctctgcccttaaactgggcaaattaccagtcccacatgccctgcccctatttcctggagggtctaccacctgcctccactccttattccaatcctgccttgttctgggttttgacttccaagcaacagaatcaagttggcagagcaaggtggaaaatggcatttacctaaacaatgttggagagggcccagaatcgctaggagggcaaaaggaaaggctgaaggctacagagccaagaacagtgccccacatcctgcccagagcagccaaaatcccctgagtgacaaatgacagatgacggatgacactccaagccaagccctggcgagccctcacaccatgccagggctgcccaggacgcccacctagctgcaaacgtggccaccaacagctctctcactctgtttgcctcactgcctcccaagagacaaagtctaggcagatgtggcccaggcaggccagtggctcccgtgcacccaggatgtatggggatcactcagtttgggtcatatcacagcccattgcctccctgcaccccatactcctgacaccccagcctttctgggacccttatccacagtcttccagtttaaatgaaagaaagtagacctcaaagacaggccaatgtattgaatgtataataatcaagccagggtatccatcaccctagtgtttcccatttctatgtgttaggtacgtttcaactctcttctcgctatgttgaaatgtattatacacactgttgttaactatagccactctactctgctatcaaacattagaacttatttttttctatccaactgtatgattataccccataaatatgtacaaatataatgtatcaaaaagaaagaaagaaagaggccagtggaaggcattcaaaaacaacacacaaacctgacaactctgttttcgcccaccagggctcagtgaaactcttcttaggcatcacacaagagagaaggaaaactggcaagttcacaacataaacacgccgagacaggtagacataccgctaactttatggtgatctggctatctgaatagaaatagaaagagtgctataccatgtcaggagacgaaaacctaacactttgcctgccatctataattgcttgacagcataattgatcatgtaactgacaactgtcccatcatcctattctcaagcactgataaagtgatgtaacactaccaacggcacatgggatcttccctaaacagtgtgatctgcaccaaccagggatcacacagttaataccactggaattttaaaaagctttctctaaacaaaagcatcaaaaagctatcttaaaataaatgaaaagcagacaagttagtcctatagccttgagtatttatcctagatgatgtcctagtggctagtgaactagaaatagactctatctgtggaaatgagggaaatattttttaaaataacaacgcccattagaagaatccagctgccttctcaaaatgacagagccagagcagttctttgtcatcgctatggctcggggcctggggatcacaaacctccaggtattcaccgggtctgcactgaccagaaagcatcactccctccctatgtcaggcatttggacataatgtggatggttaataaaaggcacagcaagctgagaaagactcaccagacccaccttggaggacccaacaactgacccggagcacactgcggaaatttcaactcatctcatctgttcactcgctccttccgtaaatcggtactgagcacctgccgtaggccaagcacggtcctagaaacaggatggacacagctaccaaggcctcagcctcagcctgagggagcccatgttccaggagggaagacagatgagaaacagaatttaatttcagatagtgaggagcatgtaacagaagacaagagcaagcggggaggacacagggcaggaatgcgggctgggagaggggccagccatccagaggagaggcggggagagccttctctgaaagggactgctgggtgagacgtgaagcataagaaggcattactgggacctcggagtcagcttaagggcagaatctcacacccttgtcttagaaaaaaggaatgagaagttttctagacagggaagaaaaggcacccatgcttaaaatgggagggaacaggcagagttcaggtgactgcaagaggccactgtggctgggcacagagagcacacaggagctgcacaagacaggtctgctggtggccacagagccaggacagcgaggtcgtggggaagaaagggaagggctttaagctgctggggctgacacagtcagaactacaacacacacagaaaagcgtaacaggtctttcttcttccaaataagcctatcttttacgcttttctgaattagttggtcctcctgttttggcttgaagtggtagggtttactctattttttggcttgaattggtagggtttattggtttggtttggtttggtttgagagtctcgctcttttgccagactggagggcagtggtgcgatctcggttcactgcaacctctgcctcccaggttcaagcaattctcctgcctcattcagcctccagagtagctgggattacaggcgtgtgccaccatgcccagctaatctttatattttttaagaagggacggggtttcaccatgttggccaggcttgtctcaaactcccgacctcaggtgatccacctgccttggcctccccaagtgctgggattacaggcatgagccagcacacccggctgctttacggagtctcactctgtcacccaggctggagtgcattggcgtgatctcagctcactgcaagctccacttcccgggttcacgccgttctcctgcctcagcttcccgagtagctgggactacaggagcctgcagccatgcccagctaatttgttgtatttttttttttagtagagacggggtttcactgtgttagccaggactgtctcgatctcctgacctcgtgatccgcccacctcggcctcccaaagtgctgggattacaggcgtgagccacggcgcccggccctccttagccatttttaagttacggttctacggcacaacgtacattcacattgttgtgcaaccatcaccaccaaacatgcacagagctctttttatcatgcaaaactgaaactgctcccactgaacactgctcccctgctgtccctggaaaccaccatcctacttcctgcttctatgagtctggctactctgggtacctcatataagtggaatcacacagtatttgtcctttggggactggcttatttcacttagcataatatcttcaaagtctatccatgtcatagtatgtgtcagaatttccttcctttttaagaatgaatagtattccatggtatggagagaccccattttattgatccattcatccaaggatgggttcctgggttgcttccacctcttaactattttggttgatgctgttatgaacatggataaacaagtatctcttcaagtccctgcttttaattctttgggtatatacccagacttgcttttaatgagactctctacatgttaacttcttgcttttaatgagactgtctacatgacatgttagtcacatgtgatttacaacaggaggtaagagcaggctgggtgaatcataatagtgtccattaatgctgcacgtacacagaggactcctatggtgccagtgaacaaaggagcagacacctgctcccaggaccacacaaaactcaccactgcagacatagatgactacctccattctaacacataacataatttggtctcaggtacttagtgaggagagtttccatttttcctccaaagatacctagcagagaaagaatgtcatgtttgatgggagaatttttaaattagcttcagaaaccaattacatacctcaggcttaaaaaaagacagcaaaattggacaggtgcagtggctcacgcctgtaatcccagcattttgggagctgaggtaggtggatcatttgaagtcaggagtcgagaccagcctggccaacatggcaaaaccctgtctttactaaaaatacaaagattggccaggtgtggtggcgggcacctgtggtcctagctattcaggaggctgaggcaggagaatcgcttgaacctgggaggcagaggttgcagtgagccaagattgcgccactgcactccagcctgggcaacagagcaagactctatctcaaaaaaaaaaaaaatcccccaaaaaactttttcaaacccacaatctgactttaaatttcataaagaaggtgatcaacaaagattggtcttggtctattaccaaaatgatgtcaaattttccattctctttctttgttctttacatttccactccgattttatgtaaatgaaattgaacttttactagagctgtttaaacacattctattgaatacaactgtattttatattttcttttatttttatattatataaatttgtatttataaaacagcttttattaaaagtatttttgctctgaataattgtattccatacatgtaaatataaaaaattgctacatggccctttaaggcatttaataattttacaaaatacagtaacactgcagaagaaagacataagaagttttactgttaggaacattctccaagccagaaaaataggcattagagtaaggacatttccacattcaatattaattgatatttggagcagaataattcacagttagtagtcagattgatagagacaggaggtataacagtggttgccagcagctgggggcagacaataggaaaatgttgaaggggtacagagcttcacttttgcaagatgagaagttctggaggtgtatgatgttgatggctgcacagccatgtgaatgtacctactactgaactgtacactttaaaattgttaacatggtaaattttatacatgtattttaccacaattaacatttttttcttaaggttttcaaataaaaaattcggtagttatttgaataactaatgctaggcaggactggtcagcaggaaaaagctgctccaaaggtggctgagggtaaggaaagccttcgtaacccctcaggcaaatcaacaaagagatcttttactacaggaaggtgctacatctgcctcagagcagaagtggtgcagcactgatttaggttctgaatttcttaaggtctaacactgacattcttcacatgctaacagttccgatgttcaggtgcctcacagaagcaatgtcaaaagaaatatgctatctgccaagcaaagaaacaaactgagaaacagctgtgtctgcctgtgcatgcataaacttaaccaggcataaagggttcctagtgacacgtatctgcatggcagtaccacagagtactgccatgtagttgaatttgaattgtcccgtaaatgcctccaaaaagatttcatgatgatatacaactgagactgcacactactgtgtggacagaaggttgccttccatcgggctaagctccacaattaagtaaaaactgccaaatcttttgggcagatcataaaatgttcgaagtcaggacaagctggtgagactgactcacacactgtaaggactatcactgaacatttttctgtcctaagtcccagctgactttccatgacagttgtttaatttccacagatacataatgcaattatggaaaaagtgaaaatccgatatttaccaaagaagaaatgcagacatctggtagtttttaaaatgctttgaaattatgctgtcaatgctaagaggacacaaaaggtcaagaacatgagcatggaatatgaacagtattaaagctgtcaggcaaagctatcaatggccaaaagagataacagaaaacattatcctatgaatgaaaagaaagcttaagagtccagttttgtgatcttgagtaaaacaacagtatgatgtgtgggataaatgtagctgccactgggtagatattttatgaaagctttgtttattatagtatttcttttttctaaaacaatgctgcttagtggagggtaggctttataagagtaggtacatgactagtcttttgctgcagtgatttagtttgtgatgatccacgtcatttttgccacagtgtacaatagctgctgaaggccacccttgtctctcacttttcattattaaaccaaagcaaactcttctgatgaagttagaatacatttttttaagttagtcaaatgtggacactataaatctaacctctagtactatggataggcaatggaaaacatcttgaaatgttaatcctaaataaacactaagcaatgtttaatgtttaagattgatgtcattgactatgcttagctgagaagaaaacatgtgattaaccaagggaaggacttaaaggatatgtaataattctatatcaccactagacatttaaatttcacaaagaggttcaacaacttgaggaagctactgctgcctttgccacagaaccttctatctcaacaatgaaactctatctcattgccctctatctcaacaatgaaacttaggagacttctgatatgacacattgggagatcactttatgttggacactcaaaatagaaagcctgaaatggtaccaaaattgacagctctaatacacaagggaaagccctaccctgtgacactgtaatattaaagcaagcatcttttttaagataaaagtaccacacagtggaaggaaagcaatgaaacatctgcagaccctgagaacaaaagaactccaaaatcgccaacagataatcagtgcaaagtgctggagccagtataaaaatgcagagtccaatttgcaaaacaaaactactgggagtagaaaccaacttgggaagaagataggtaataggggtaaaaaaaaagaaggaaaaggatgatacaagtggcagactagagaagaggagccagatgtcaaaaagtacatggccaaaccaatcgccactttgtgaaaataacgagaatgtgtgctagagctatgaaactagaaatctatcctatatataaacagataaaattggccaggcacggtggctcatgcctgtaatcccagcactttgggaggccgaggcaggcggatcatgaggtcaggagatcgagaccatcctggctaacatggtgaaaccctgtctctactaaaaatacaaacaaattagctgggtgtggtggtgggcacctgtagtcccagctactcgggaggctgaggcagaagaatggcatgaacccgggaggccgaacttgcagtgagccaagatcacgccactgcactccagcctgggtgacagagcgagactccatctcaaaaaaaaaaacaacaacaaaaaaaaaaacggatacaattagaagatgaaaagatagaaaattttaataataaaaaataaagagatatggagcattcaagagaaagggataaagaagacaggtaaagagggctcaacatatgtataaaaggaattctgcaaagaaagaaacagaacaaccactgaaaactacatattgactcaatttttttttttttttgagatggagtctcgctctgtcacccaggctggagtgcagtggcgcaatttcggctcactacacctccgctcccaggttcaagcaattctcctgcctcagcctcccaagtagctgggattataggtgcatgccaccacacctggctaatttttttttttatttttagtagagaccgggtttcaccatattggccaggctggtctcaaactcctgacgttgtgatccacccgcctcagcctctaaaagtgctgggattacaggcgtgagccaccagacctggcccacattgattctatttttaaaaatgagtaaaagacttgaatagacatttctcaaaagaaaatataaaatggtcaacaagcatatgaaaagatgttcaacatcattcatcattagggaaatgcaaatcaaaaccacaacaaggtatcacctcaccctcatcaggatggctatcattaacaacaacaataacaaaacataataacaagtgttggagaggatgtggaaaaattcaaacccttatagactcctggtaggaataaaaaatggtgcagccactgtggaaaacaatttgtctgttcctcaaaaaattaaaattaggattgccatgagatccagcaattccacctctggatatatatcgaaaaaatggaaatcggggtccaagagagatatctgtacacccatgttcatagcagcactattcacaatagccaagaggtggaagcagcccaagtattcactgttagatgaataaataaaatgtggtatagacatacaatggaattcagcctttacaaggaaggagattctgatacatgctaaacatggatgaatcttgatgaggctaagtgaaataaggcagtcacaaaaggacaaatactgtatgattccacttctatgaggtatgtaaaataaccaaattcatagaaacagaaagtagaaggggagttatcaggggctgggttgggggtaaaagtttctcaagatgaaaaagttctgggggttagctgcacaacagtgtgaatatacttaacaatattgaactgtacacttacaatggataagatggggccgggtggctcacatctgtagtcccagtgctttgggaggccaaggtgggcagatatcttgggtccaggattcaagaccagcctggtcaatatggcaaaacaccatctctactaaaaaactacaaaaaattagccaggcattgtggtgcatgcctgtaatcctagctactcagaggctgagacacgagaattgcttaaacttgggagacagaggtgcagtgagctgagatcatgccactgcactccagcctgggcaagagagcgagattctgcctaaaaaaaaaaaaaaagttaagatggtaaactttatgttacgtgtattttaccacaatttttaaaaattgaattaagctgaatatactgaaatatactgaaaaatactgaatatactgaaaaggtacatcacatacctaagaaaaacaatccagagaagccataacaagacatattctagtaaaactattaaagaagaaaggataatgggaccacaaaatcataagagacttccagcactatttgttatgcttcaatcctttagagggaaacaactgtaccatgaagcacataagaaaagagttatatttttcatcataagaggtgcataaatgaggatttgttatattatcctctatactggtctatacacttgtaatatttgatcacacattcccacaaacgattcagggaacctactggctctgttaaattaaactaaatttgggctgaggaggtgcttgtgtaatgaactgcaacttaacttagtatgcaaactaatggaaagcctaactcaggaggatactttgggaacaaattgctgagtctcaggcaatcatagcagctgagctccagttaactgcaggcagcaggacaactgttccaatcctgttcatgtaagacgaacactgagccattaaccatcagctgtctctctacctcacttctgtttctgtacctcacttccctgctatccacaaatgcttttagaccacgttgcagccctggagttctctgaacctgtccctggttctgagggctgcctgattctagaatcacaaataaaaggcgattaaaatctgcaaaactagatttgttatacattttttttttttgagacggagtctcactctgtagcccaggctggagtgcagtggtgtgatatccactcactgcaagctctgcctcccaggttcacaccattctcctgccttagcctcccgagtagctgggactacaggcgcccaccaccacacctggctaatttttttgtatttttagtagagacggggtttcaccgtgttagctaggatggtctcaatctcctgacctcgtgatccgcccgcctcggcctcccaaagtgctgggattacaggcatgagccactgtgcccggcttcattcatcttttagcagtttccataattcaagagttcacagactagtgctgttgttggggcaaaacttgagccaggagctcaatatcacctagtcccaattcttcttcaccttctgctctgcccagttcatccctggactcctcacagaacccctcaggctctcctatgaccatgattaaatgtctatagcagtcccagcctaaatcctcataccagagtaagcaagggcattgcttctagaaactcccattcaggctcctggaactccctctctcaggctgactgaaattggctcctgaaacaatctctgtgtcaagacagtgagattcaatgattcagagtcagagtgagttggggtggagtcaatcctaagaatggaaaagggaaactgaggtgaatgaaggagaaatggattctgtgaggcacccacaacaaggacagcagagaccacagttctggtggctgtttcttaccctccagacactgtccctctgctgagctccttcaaaccctccagacatgatcagactcatctggacttactgtggggacatatctaggccccgactctgtcaaatatgtatagtgacttccatctaaaaggcacaaggttctttacagataggacaaccttgatagcactcatctgagaaagagaacaaattagaaataatcatccttcacttcctaacactcacacaaaaaaaaacaaacctaagggaaagcaagtgcatattaaaacagagttgatcaccaatgagcaagtcctaccaaagatggcagagaagctgaaaaggtcctctaggaactcactcaataaatgctcatttattccatttattgcaaagccaagaattgtaaataatttaactcacttaggaaaggatcttctccattattttatctgaatgttatctgatcttgatgttctgaagtctgacagttaccaaagcgagtaaaaatcctcatgttttccatgctaggaaaatcattaatagtttatccaaactgaaactttcttggcaactgttgcttccttgttcttgccataaattaactgtttttaaaaagctaaaatctaaagaatttccaggaccttaaaaccattagaatacaaagacactctaatttaaataaaattcataaccaaaagttaactcacctaaacacaatgtttccttgtgtcatttatcttctttgaagcccaatcaataacagattcattcattcactcacgcagcaaacatttagtaagtgctctaaatatacctgaagggacctcacacatcatctttcctgagctcttcctttacagattaggagattgaggtcaaagagagcaagtgatctgcccacagtcacacagcaaatatgagaatccatgggtgcaatcagatttcctcacctctggcctgacacgttatccaccctgccatgtttccttggctacagcaggccaatgatgcaatcggcctccagcagagaacactactgtagtaaatatcaatagctgtcaaatttatggccacacaacatggtttgaacacccttcctacaactggaagatctcccatatgagttccttctcctgaaatgtagaggcaaaagctcatccaatcctccctgcagctagagctcaggcatatggcttggctttgccaatcaggggagcagtgtgacgtagtgggcacaagcagggtaggcagcagtggcaaagcttctagtgtttgacctgcagggagctggcacttccatgctgagcgatggtcacagagctgtcttcacttgtcactgcccatcggtgagatttgggcactgatcctggctatatagaattctgtgaaactggctaaaatggactctggggtggggattgcatctaagaaccctgacctctgtgcttcattattacgtgctcaatacatatgcctggagctatatacaaaataaagggagcctctgctcaaaacttcactgtgcatcataagataccagttctcagctatctatctgagtcttaagactttttaaaaactaaatggttcttttctattaaaaaataagacaatgatgggactacttcacttttaacaatatatgctgaattatcaaatgcctatttaaaaaaaaaaaaaagatcaagaaggtggcagagcaaaccccagtattaaaatactccttcaccaaaatccaacagcaaagcaaagctggtcctcgtggctttttggaagcaagaagcaagggagaagcaagtaaacaaaaccctgaaccatttccctaacagctcccatcttaaagaataacagaagggaaagagctgaaggcagcctccagagaataagtagcattttccccaaaaccttcatgtcatctattttttccagagatggaaaaaatgctgtgactccctgctggaagaaaagcaagaaacccttccctgtggttacagatggtaaatgcttaaacgtgacaatgtcaaaggaacagtctcctaaattggacagcatggagtgggaaatggaaagacacataagggccttcctttcctctccccatcttgatgagcagtcctcaagatatggcctaaaattcataaacctagaaacagaggcggcctgagatttaaagtgaaaatgtagccaacaacaaaacaaaaaaactcgggagacagaaggggaaatgtgataattttttcatttttcatagcaagtgaacaatagatataatttaagagttgctaaatcaagaaacagaaggttatacataacaaatatacagagttatatgagtaaccactggaaaaactaaaagtagactctaaaccgtccaaagcaccagaagggaaacagtacacgcacacactcaaataacaaaaaggaaagcagggcaccagagtgtacacctgtagtcccagctattcgggaggccaaggtgggaggatcacttgagcccaggagttcaaggccagcctgggcaacataacaagaccccatctctaaaaataataataataacaaaaaacgaggaaaattggcaacagaaaaaaaccccacaaactagattataaagaattaggacttaaaacatctatgataacaatagatgcagatgagagaaattattattattattggaaaatgatatgttacacgtctacaaaacaagagaatccaatttttaaattattagaaagaattagaatagttagcaagttgactgtttgcagaattttaaagtacctttttcctataaacaagcaaaaccattgagaaaacagctgaaaagaccccactcacagtaactcctgaaaagaacggcacatctgaactagatgtgggcagaacctacatgaagaaaactggaaagttctccaatgaggcaaaaaggagaaattaaaagtagcaccatgtgcttggattggaatgtttcatactgtaaacttggccgggtgtggtggctcacgcctgtaatcccaacactttgggaggccaaggcgggcagatcgtttgaggccaggagttcaagaccagcctagccagcatggcgaaaccccgtctctactaaaaatacaaaaattagccacttatggtggcacatgcctgtaatcccagctgcttgggaggctgaggcatgaaaattgcttgaacccaggaggcagaggttgcagtgagctgagatcgcaccactgtactccagcctgggcaacagagcaagactctgtcaaaaacaaaaacaaaaacaaaaaaacctgtaaagttgttaattctccctaaatcaattcataaatttactgcaaaccaattaaaataccaggaggatttgggaacttactttggaactcagcaaaatgatactaatagtaatctgaaaaaaaatacacgagaattaccaggtgtggctgtttgtattttccacatgcttttctgcagtgtgacccttgtcttcctcccatcaagaggtagggcctatgtcccctccccttaaatgctggcaggtctgtgactgcttcagccaactgagtacagaggaaatggccccatgagacttgtgagcctaggctggaaaaagcaagcagtttccacctagtgttcttgggatactagctctgggggaagcagccatcatgtaggaagtccaactaccctgagaccacagtgctggaggagctacaagtatacacgtggctgaggccccagctgccagcaggccacaactgccagccatgtgagtgggacgtctgggatgtcccaccctgtcgagtcctcagatgagttacaaccccagctgatatccaacacaatcacatgagacctcaagcaagaatcacccagcagagccgttccaaattcctcaccaacaagattataaacaaaataaaacacctgttttaaactgctaagtttgaggataacttgtgatgttacaacagtaactggaattccatttaaaaggaaggaagggggccgtgcacggtggctcatgcctgtgatcccagcactttgggagaccgaggcgggcagatcacaaggtcaggagtttgagaccagcctgatcaacatgttgaaaccccgtctctactaaaaatacaaaagttagctgcgtgtggtggcgcgttgcctgtaatcccaggtactcaggaggctgaggcaagagaattgcttgaacccaggaggcagaaggttgcagtgagccgagatcacaccactgcactccagcctgggcgacagagcgagactccgtctcaaaaaaaaaaaaaaggaaggaaggaagtgaggaaggtaaggaaggaaggaaaggatggagggaggaagggagggagagagggaggaaaggagggaaggaaggaaagaaaggggagggaagggggaaggagagccgaaggggattggccctatcacatttaacaacataatgaatcaaaatccattcataaattcattgaacaaatattgaagatctacaggtccaccacaagctaggcattagagagacactgtgttgtgcaaaatctttgtctttatgggatttagattttagtgaaaaagaaatttcagatagtattaagtgtgctgaaggaaaataaaaatcaggataagagaaagtgctgcttaaaatagagtgctcagagaggcctcttggaggaggtggctgtggcgctgagccagggaagggcccgggtattctcacctactgctgtggggttttgcaaacggttcagcctgtccttggggcaatttgaaaaatctatttccatctaaaaggcatggacctcttgacctagaaacctcttggctaggaaattaccccatgaacattcttacacacgttagcaatacttccaagtatgttatgacaaaaatgagatacacaaaaatgtcagctcaatgggagcttattaaataaattacattatagtcattcaatagagcaccataagactttttaaaaattacatgagctatatccactgacaaacagctacatgagacactgttaggtgacaataagaaaggctggaactgtgtgcacagtatctcctcttctgactcacagagagagaaggaaccggggaagagggaaggatactcatctatgatctggaagaaatccccctttcctcggggaacacctctggggagaggagagagatttgggtttttcatttggtacctctccgtagcacctgaattttctaacaagatgctgtacaacttttacttttgtcctttcaatgcccgctagggttacctggaccatgagtcagtgtttgacagcttctccccaaagaaagaattggggctactagaccggacaaggttggttttctcttttggtactctgtatttccaaaaataactgaatggtatttttttaaataaaataatttgaaagaataaagccctataacaacaaagtattaaactgttaaaatattttcattctattgtaattataagaaagcctgcatggtcccactgcagcagccaccatgacgagcagcactctctgtaaatgcagcccttccacgctgctcagggtgacccaccccagtgagctggctatttgcatattcccagatcccccacctgcgccaggcaggcatatgctagatcagctcagaactagaaaagatgggcaccaggaagaaaggcaccaagccctccctaactcccctctgagagttgcatccttctttcctacctctttcctttttacagagcccactgtgctctgggtcccccatgacctgggggtcagagtcagacacactcctgtgcacaaatggaaccattcgttcttcaccaccacctgtgcccacacccctgtcaaagctcccccgcacccacctctgaatctcccgcatgggtaggacagcttcttcccgaagaaggggaattcctggccaggcacggtgctcacgcttgtaatcccaacactttgaaaggccaaggcaggtgggtcgcttgagcccaggagtttgagaccagtctgggcaacataacgagacctcctctctacaaaaattaaaattaaaaaattagccgggagtggtggcatgccagtagccccagctacttgggagactgaggtgggaggatcgtttgagcccatgaggttgaggctgcagtgagccgtgatcctgccactgcactccagcctgggctgtagagagagaccctgttggaaggatctctccgacagttatctcctggataactgcaatgggtcaagtgacaactttctctagctctcctaagccacagtgcagtacggtttggaaacagcaataagagtcaatcccccttttcacaaatgatcaaatgaggctcagagagattaaagaattaggcagtcattcttcacaaggaaggaagggagggagggaggaaaatttcttgtgaaattcccaaggaacagagaacatttttaaatgtttccttactcattagttaactcagtattttcatgcccaaaaaatgtcaacaaccagttttgccaagaataataaaaacagatactgactctgagcctttcttgcaagatctctcagggtacacacccggctgactcccgcacatttctgtctctcctgccttctcaaatctcgctgtctccatcagtgtctcttcttccatgcaaggctctgtcctctgaagttctctctcccctggcttcagccccatgcaggtgccccccccccgccccacatgtggattcagttccccacctgtggtccccatgattgttctactccaactccggctctcatcacccaccgccagtgtgactggggcacaatgtgactgggtgcaggatggggcagccacctcaggccccagagcgctccatcccatggccaaaggggtggatattccgccctgaaacacctgggagtgcataatgctcaaggtattccttcttcgaagctgataagtttgtctatgagcaaataatccactagttcctctgcaaggggactgcctgacttagaaagaacacagatgtaaaagattagtctttctcaaacactgccggtcatgtgtcagatatctagaacagcccctcaccagcaaacctggctggccccagccctgtctcaggcccttgtgttaatgctgggtctctggcccaggctcccctccctgcctgatgagttcccactgtgctttcaagggctctttcaggtgaagagacttagatcaataccaccttaggtgacccgaactttgactctccctcagggagcagcgacggggttttagtgtcttctctctgacagcccaaagcgcagatgccagctgctccacctcattcccagggacgagctccacagttgaggatcccagggagcagagcaggggttgagatgcaaacaattctgatcacaggcccctctctccaccctccccaaaagtgccacctgctgcatctacataattctgagagcccattcaagagaccgctgctggaaccaagaagctagttatctggatgatgtgggtccccatcggagacacgggaggggagaagtggtgggactgcttcatacccacacccacttcatgtttgccctagcaggcactgtgtagcactcatctggggccaaaaaggaataaatgacaacttgtttacagaaactgtgttgtaaaaatacctagtgggaccttgtttcaccacctggatctttagggaggtgcccgttctccccttcgagctcagcctgcccttaccaagttcctctgtttcccctcactgggaactctcaggaattgtcccccaacattattcccagaaacctgtgccaaccgctcatgcctatcttggagcatcacactatcagatacctggataactgcaatgggtaaagtgacaattttctctagctctcctaaaccacagtgcaatatggtttggaaacagcaataagtcaatcccccttttcacaaatgatcaaatgaggctcagagaggttaaggaattaggcagtcattcttcaatcattctacaaacttttcttcaacacccacctgtgccagcggatacctgcccctcataaaatactcccctccccagagatctgggggtggggtttcttgctcctggaaacaagggaaaaaggagagaaagaggtgtgagggcactcagagaggagcagcctgtcatcatgtgaacactgcccacgctgcctagcaggcctctgaagccaccccacgggagaatggctctgctgtttcccacgcctggggtctccctctcccactccagcatcctagcccaccaggtaggatgagtgatgctacatggacttccaaacatgcttaatctctgcagaccatggcacaggcccgaagctggcccgcagcacccaggctcagtacatgcccgccctcttcacgacctcccagaccagcccggccggtcacccatcttctgcacacatccctccccaacctcccctcaaacccttcacccaggtggggcttcccaggcaatctccaatctacggctgaccctgaaaaacccaggtttgaattgtataggtgcatttatacatggatttttttcagtcaaagttacaccaagtgtgccagcctctcctgactccctctgcagttgaaaatccacctcctccacctcttccttctctgccaccctgacacagcaaaactaagtcctcctcttcctcctcctcctcagcccactcagtgggaagacgacaaagatgaagatctttatgatgatccacctccacttaatgaatagtaaatacattttctcttccctatgattttcttaatgatattttctttcctccagcttactttatggtaagaatacagcatataacgcatatacaaaagatgtattaatcatctatttacatttccagtcaatatgaggctattagtagttacgttttggaggagtcaaaagttacacgtggattttcaactgcagagggagtcagtgcccctaaccgtgtactgttcaagggtcagctgtacaaaatgaggacaagacgtagtacccattccccagggtttactgctaggcttaaataagttgatatgaaacactgttagaatcgcgtctggcaaaaaaagtaagcactcattagttcttgtgatcgatccagttacagtttcacatacagatgactgtacccacccaccagcactcaccagagggggcccttggatctaaacagtgtggaagccacgcctgttcccctcacctcacacaggcctgtgtgcaaggtgactgagcccccctggatttctgactaatcatctttggaccaccagcaggtaaacaactctcccctcctgtgtccccagaatgcctcagcagcattagtttcctattgctgctgtaacaaattgccacaaacctggtgacttatagcaacacacagctatcatcctacattctggaggtcagaggtgcaaatcagtctcactgggctaaattcaaggggtcacaagcctcgatcctcctgggggctccaggagagaatctgcttccctgcctttccgggcttccagaggccacctgccttcattggctcataactctcttcctcacatcattccagtcactgcgttcatcatcccacctcctactactgactcagatcttctgtctccctctcaggaggacccctgtgattacacagggcctgcctacataatccaggatagtctccctctctcaagatccttaaccgaatcacatccgcaaagtccctttttgccatgtgagacacagattcacagcttctagggattaggatgtggacttctctgggggaccacagttccatctaccacattgacctaacccatattcaacctacccagctttgctagctcttagacgttgggttagtcccaatacctggtccacaaaactggaactgaatatgacatttcacatttgcatcataaagattctccggatgctgtgtgaaggggaaattgagaggacaagagcagaagtggagaagccacttacggggctaccagaataatctgggtaagagagacacagcaggcagaagtctgtatttttgaagaagaatcagtaggatgacaagaggctacgttaggaaggaccactggtgtctggttggaggaactgggtgaatggtggttccactccttgaaaacagagcagaagacacttatttggaggggaaatgagcaacttggttggggatatcctgaattttaagtgtctatgacttgtccaagtgcagatgtaaagtcagcaatagggtatgtcaagaggagagaggtaacagcttcaaatgcagagacctgtgtgagtgacagaagtgtccagtggggcagagagagagaagcctgggcccaggaatgtcctcctgctgaccagctgcagtgaagctccgctggccccatctctcagtgtcagccctgcccttgctgtgtccactgccagggtgtcccttgcaggggcactcactgcacagtcatcattcccagggagcatggccacttcaccttgctgctccgccacacctctgttttgggcggccctgaggatgctctgagactgggctacagtctccacaggttccagctatggatgtctgccccacagcctcatctagggaggtctgtttgcccaccattgagggccctgtggcagcacctggctcttccctctctgctatgttcaacatgtcccacagcaacatggaaattagcaaatgtctttattccacacactgtccatgggaaatttcagacccaatcttgtagaccagaggtcaacaaactatgatccctaggccaaatctggcctgctgcttttgcaaacaaagttatactggaacacagttatacccattcatttataaatggtctatggttgcctccacacaatgatggcagggttgagtagttgccacatcactaatcatcagggaaatgcaagtctaaaccacaatgagatatcatctcacacctgttacaatggctattctcacaatgacaaaagacagcaagtgttggcaaagatacggagaaaggggaacaatttctctgctggtgggaaggtaagttagtacagccattacggaaaacagcatgaaagctcctttaaaacttaaaaatagaactatcccatgtagcaattccacctttgggtatatatccaaaggaaatgaaaccagtatgaatgaagaaatatctgcacccccatgttctaaaatgaattcataaatccatacatatatacatacatacataggagagaatggaaaagctcttcctacagtagaataacaattaataaatgtagaaggaatgggccgggtgtggtggctcacgcctgtaatccccgcactttgggaggctgaggcaggccgatcacgaggtcaggagatcgagaccatcttggctaacacggtgaaaccccatctctactaaaaatacaaaagaattagccaggcatggtggcgggtgcctatagtcccagctactcgggaggctgaggcaggagaatggcgtgaacccagcaggcagagcttgcagtgagccgagactacgccactgcgctccagcctgggcaacagagcgagactccatctcaaaattataataataataataataaaataaataaataaataaatgtacaaggaacggaaatataaaattatgacttggcaatcatcgtagaggaggctggtttgggtggcaatcatcaacggatgtgaagttgaaagagagaggtttgaccagaaacaggatattggcataatctgagacttccttacacaaattataattaaaggggaaatggtgaatttaaaatgataacacctggaggacagcaataatgttaggtgatcaaggtgaatatcgccaatggtgagaagggctgacatcaacgcctcctgatgcgatgcactgagaaaagcatggcatcaactttgggattgtcctgccaagaatgcatgagccaagtctgcccatgaggataatcagatggatccaggttcagggtcatcctacagaatgcaaggcctgtgcccttcaaaactgtggaaaacgtgaaacagagaggaaggctgaggagagtgaagacacacaaggaatgctcatgttcctgggtaggaccctgggccagagaggaaaaagaaacactacttggtcaggtgatgaaattggaatggggtctacagattggataacaatgttcttccaatgttgttttcctaatttggagaggtttatgatgagtacataaagagcatccatgagtggtgagaatatacactgagttttttaggggtgaagcaacatcatgtccacagctttctcccaaaacactgagaaaaagactaatgataattgagaatttttttaccttgagaaagacaatgtgcacaagctcaagccatggggtaaatgcaataacatgtttacaattcgggaatttaagagaagagacacaggaattcttggttctgttctgtaacttttctataagttagaaattatttcaaaaaatttccagaaaacaatattaagacagagtttcattgtttattagcatagaatttggctatgagcattccagtgtactatatcttcaaatgactaggactttttacccgatgcccaagggagggttctgtctatgtgtgtgtgttgttgttggttttttttggtgtttttgttttgtatttgtttttgtttttgtttttgagataggatttctcgctgtcacccagactggagtgcagtggtgcaatcgaagctcactgtggcctcaacctcccagactcaggtgatcctcccacctcagcctcccaagtaggtggaactacagctgtgtgccaccatgcccagctaattttttgtattttcagtagaaacagggttttgccacgttgtccaggctggtcttcaactcctggctcatgtgatccacctgcgtcagcctcccaaagtgctgagattacaggtgtgagccaccacgccctgtcaagtttttctccttatctttaaaatccattattttacagggaaacatgtcaatgctgactattctacattgatttttcccagttacacaatgtaacctttcaaatcttattttaggaaggttttcttgcattatagttctaaatatttatgctattctattgctttgtttttctgtccctggacactaattatacatatattgaacctcctttgcctgtgtcctacattcctttaattcactatatcaccttcttttttttattatttttctccttttcaccctctatttttatttctgtgcttcctaagaatatctatttgctcccatgttccttctaattaagtcttcatttttgaaactcatttttccaaattcttttctgacatctctctgttctcctttcataatttcctgtcatctagccatatcttttgtagtttttacaatttctgattcaggatgggagcagtggctcgtgcctataatcccagcactttgggaggccaaggctggtggaccacctgaggtcagcagttgaagatcggcctgctaacatggcaaaaccacgtctctactaaaaatacaaaaattagctgggtgtggtggaaagcacctgtaatcccagctactcaggaggctgaggctgaggcaggagaatcgcttgaacccgggaggctgaggatgtagtgagccaagattgcttcattgcactccagcctgagcaacacagcgagactctgcctcaaaaataaaaataaataaataaataaataagtaaaataaagtttctgattcatactactcttaggaaactttattttcttttagcttatattgaaatattaatttataatttttctggtgtgctctcattttcagtagtaccattatgttcattttcatcatgttttcactgaataaatgttgcatgaggctggatcgtattccttttttgttgtccatgattaaatgaggtggattttcctgatctattaggaggaagttcccaatagatcaggaaagttcctaataaagggatggactaggatacctttcccatttggctctactgatctgtgaaagactcaaaataggaattctccaggtacccacttgtttcccagcatcaagtccagaacctttgtaaagctcagaaagatctcttgcctctagtcctttgctccagctctagaactttgaagtccttcttttccaaggctatatgctctcagcttttgatgttatctttcactgttaaagcagtttttgagatctttttccttgggggtccccttccatatctccaccatctgaacctattttctctcgccatctgtcttctgcttaacttggtgtatgtttccagtaatttctgctcaaggtgaggtgcttagaagggaggacttactgtacgtttctaagattctccaaggcctctgccaccacatcgacgctgattctcccaggtccacacacagttagttgctctcacctgttgccagaagcctgggagcccctttccagttttgccagttgctctcaggtctgcccaccagacttccatcctactttaaagggtgagcagctcatggtagtttttgggttccaccacctgtcaatagtttctttcatttcccatcactcccctgaggccactgcggctcttctccaggtccttctgatgctggtggtttggccaaacccacccagtcctgggaataaaggagtggggagagagtccccaacacttttgttgacatatcctctttgagctttatctatggctgtcttgctgattggtttagcttccaggaagagttcaggggagactgaaaaactactttgccaccatgaatacatccccataaaacatgttctgaagggcataaaacaaggaacaaagaaatgaagagacatactctgtttctgaattggaagatttaatatgataaaactgtcagtactcccaaaattgatgcactatattaaaagttttaaagttttctatctggcaagacatcaaaaattaagcaaaatgagaaaatatttgcaacacataataaagtatccatggaaattcagatccaatgaaatatctttctgcttctatgaaattaataaaaatgctcagccttgctaatatcccacgctgcaagaggacagaaaaaggggcacacactgtaggcttctgtgggtggatgtgcctacattcttttgtgaaaattaatccagaaatagctaacaaaactcccaatttgaatactcatcagctagcaattccactttggggaatctatcctcaaaaaaaaaaaaagcagtggcatctcaggctggataagcagcactgtttgtagacacatagaactggtagagattattcccagcaggagaataactgaataacttgtaataattcatactttggactactccacagccattaaagataatgtgttaaaaaataataataatgagttatggctgggaatattcgttatacattaaatttttaaaagaagttacagagtaatatgggtggtataatgtcatttttgtaaattgtttttaaaaagaaaagaaacattttccggccgggtgcggtggctcacgcctgtaatctcagcactttgggaggctgaggcaggcggatcacgaggtcaggagatagagaccatcctggctaacacggggaaaccccatctctactaaaaatacaaaattagcagggtgtggtggcgggcgcctgtagtcccagctactcgggaggctgaggcaggagaatggcatgaacccgggaggcggagtttgcagtgagccgagatcacgccactgcactccagcctgggcgatagagcaaggctctgtctcaaaaaaaaaaagaaagaaaagaaacattttccatacatatatatacaaattctaatacattttatgattgtaaagggaagcatggaaggattgcattaaacaacactggtaatgttggtggtctatgggtagagaattggggtaggcgaaagctatacattgtttgtgtgtatgtgtgtgtatatatattttttgtttgtttgtttgtttgttttctgagacagagtcttactccatcgcccaggctggagtgcagtggcgcgatctcactcactgcaagctccgcctcctgggttcacgccattctcctgcctcagcctccagagcagctggaactacaggcacctgccaccacgcccagctagttttttgtattgttttttttagtagagacaggattccaccatgttggccaggatggtctcgatctcctgacctcgtgatccacctgcctcggcctcccaaagtgatgggattacaggcgtgacccaccgcacccaacctattttttttgagatggagtttcactcttgtcccccaggctggagtgcagtggagtgatcttggctcactgcaacctccgcctcctgggctcaagcaattctcctgcctcagcctcccaagtacctgggattacaggtgcccaccatcacacctgactattttttgtatttttagtagagacagggtttcgccatgtgggccaggctggtctccaactcctgacttccagtggtccgcccgcctcagtctcccaaagtgttgggattacaggcatgagccaaccatgcccagtcacttttttatcttcagttatttttactttttatatattaatttcagagtatgaaaaaaatccagtggagttgctttttaaaggaaaaatacacacacacacacacacacacacacacacagagtcagcttccaatggctacgtctttaccaacatatgtaactggtaatgtggataactcacaatgtagctgtttgtccctgagttctgggcattaataaaatctccaagaaaaataacaaactactctattaaaggataactattcaagacctccatccagctctcttagtcttctaaactatgaacacagctcattacctctcaaaatgggcaggacatctatccacaagggaactgatccacctgctgactcactggctggcacagcccggcacaggaaaaccacctgcagggggtcctcaaacaatggaaactgcacagctctgtattcatcacagacctccggccaggcctgacacccacccctgtctccaaccttgccgagtcctcccctttcaaccttaaacttcttcaacttggtccagtggaatggctccttaaatttctcttgtatcttcacctttccaggcatgttttatgcttttcctaagaaagagagagcctccttgctaaagtggacccctttaccagcatgctttatttcatccccttctgcctaatcgttagcaggagtttggcctctaaaaagtcagagcaactaagttcaaagctacttcatagctgagtgaccttgggtaagtcactcatccctcttccccttagtttactcagcagaagcaccaagatttcttgaggctttggcttggaacagagtcaggctcagttctgctgtgttccaatggctaaggcaaatcagaggcccagtccaaactcagggagagggaaccacacaaaaccctgagcaccagcaggcagaggccaccagagtaacaggctattacacacacaataagtaagtgctcactaagcatgggctgtctgtcttagctaataattttgtttcttaaatccaggagagttgtttctacaatgggttttcaccatgtgcaaaccacagagagggcctagaaagccatatgttgctaaagagcacataggtctcattttagaagatttagagaaaccagagggcagccctaagccccacagtatggatttctttatgaagccagcccagccatcccagctgccattcttaaatgacgaacaaccttggcaaggcagttgcaccaatctcagagggcaggcatatatatggcaatgggtcagtgttccccactcacaaccatgttaacatgcaaacctgtctcaacacagcaggaaccaatcatcatttctgcaaagtgttgtagacaacagatgaaaaatggtatacactgtaccgtactgaaagaactttcaaggtgcttgcagcaaagtaagtttgaagacagaaaataagcccatgaaaaaacagacaggagggtgggagatggaggactcaggacagaagtcatcttataatctccaaaatgtaagcagagtgtgctgtgttcattgttgatccccagaccctagagtaatgtccatacataggagaactgtgtggaattgctcagaatcataggaagctagaactaacaggttataggtcgggcacagtggctcaagcttgtaatctcagtgctttgggaggctgaggcaggagcatcccttgagataaggagtttgagtttgaatccagcctgggcaacataacgagaccccatctcttaaaaaaaaaatgtttttagtattagccaggcatggtggtacacacctgtagtcctagctacttgcaaggcagaggcaggaggatcgcttcagcccagcagttccaggctgccgtgagctatgatagtgtcactgcactccagcctgggcaaaagagcgagatcctgcctcttaaggcaaaaaaaaaaaaaaaaaaaaaaaaagaataggttagagctgttgaagagaataacactgcaaaagcaaactgaattaactgttttacacatttatttaactctttaaactaaaatgtaggggatgatgtgcatttttcacataaataagcttttctactgtgtccaattaatgttttcccctttaggtttattattaaaaggcagttctctctccacacccttgggaacccaaggctaaaccaggaagggcgggctcagggaggagccaggaagtggagctaattcaccagtctgccacctgtaggctggttccagcagacttaaacctcagtgcccgctagacagacatgaaaacaatgcatattaaataatggtaaaaactgagcaatagatgtgtgaaaactatatagagaggggcatttaaatcatggctcccgtgtgcttgcctccaacctcctctcttttctttgaatactcccagctatgaccacacagtctgttgttcctattcagctctccaaggctcacccttgatctaaaatacgcttcgaaaattaatactcccattaggatgaacaaccacacctgtatcgatcgaggtgttccagaggcaattttgctcagatcttatggtaaaagccatgcaatgaacttaaaaaacaaagaccattatgaaataaacaaataagcaaagctggacgaatttttcaaattttaaaactcaagaacaaatagcaaacattagttttaaaggattggtttggatttctgtagatggaagtaaaacatactgagtttacaagcctatgcgatgtatttcagcacgatccaccaaatgcagttacagatgtcaagagttctcagaacaagtgcctctcttcataaatatctgctctgcatatatatctctcccattcccataacgtccattctttgttaatataggaaaaaaaccgactttcatcaaaatgctacaaaacgccaaaaattaactcttggggacagtcactttaatcgagacgtctttcttctatggagatttgttcaccactggcttctctgatttggtggttaagagtctgaaaatcggtcatccttaaggtctggagctcagaaagcacgccgcccccccttgcctgccccctgccccaggacgccggatgcgggtcgcctgcccagtcccgtcgcccacaaaccacgccgttctgggcggacgcgggaaaccagaagtccccgaagccaagtcagcgagcgaccacaggggccgcccggccgatccccgatatccgggctgacccaaaacccgacgggaggcgcccctcccccgcccccccaccccaccccccacccccaccgcccccggtcagggccgccgcgagggtgagaggcgcgcccacatgctgctccgctccgggttcggctcccacctcctcgcctcggccgcggccgctcggatggcgaggtcgtgtccccggcgcgcgcggtccccggcgctccctccggccgctgcgggctcggaggacggcgggcgcctggctgctgtttcctccaagaaaagtaactccgggaatcagcgcaataggagcgggaacgcgatgctccgagagcggcgagccgggccctggagttattctgctcggagtttcgaactgcgccccgcgctgcagctactcggccccggcgttggccgccggaacttgccgcccgcggtggcgtcccggcggccgcagcgcctagcccccccggcccgcgcagtccccggagcccgtccccgcctggtcgcggacactcaccgagaagcctgcccagaaggggcaggagtggcggacgcgggccgaggtggtgagcgccagcgcggcgaagctgactgccacgatgaggcatccgagcgccatctgcgtggccccgagcgccagcacgatgcgggagcggcccgggcactcgcgcaggcgggacaggctgcggggcagcgcggcgggacgcggcgctcgggggccgccggccggaggcatcgcgccgggcgcccgcacgcctcgcccgctcccgcccggcccggcgcgcgccgccgcctctcctcacagagggtccgaggcaagttgcgccgggtgcagggacggcctcccagccggctgccagggctgcggcggccgcgcgccgggagcgggccgggccgggcggggagccgggcgcccgcagcccccgccggtgcccgcgcccatgccgccgccgccgcgccgcccgcccgccggccgcgccgcgctgcgccctcccccgcccgccccgcgcgctccccggcccgagcgcgggcgcgagccgccgccgctgctgccgtaccgggcgcgagccgctgccgtccccgggcgcgagccccgccgccgtgcgctgggccccagctggggcgggagcgggagccgggacccgggagccgggagaggggcggggaaggcgcaggtgcggtcctggcgtcccagcctccgcgctcacgcctcgcgccctggcggctgcaggtctgcggaaggagagcgggggcggcagcgcatcaagggcaacggcatcagcctccgcggcggagccctgggtcggctgcgcggaggggcccgatagcggcagcgggccagccgagccttcagagcctggggacggctcgggatgggcgcgcggggcgctgaggacggggagacgggctgggagcagacaggagggaaattccgagcgctgggccgcaggtgtggcgaacaggagcctcttgaatgcaaaaatccaagatccaagatgctgcttttctgcagttcgagaatctcccaagccatccgctgagagaactcagctctggaggacattccgagaacattgccaggacacacacgatgtcccttacccacctttggtttgcatgcttttgatacaagttaaaagtttgggctttaaaaaaaaattgcacaaaacgaatttaaatgcgcaatatcattaataaccgattaaaccatctccactccctcttgccaacatagagtttaaaatatctaagtactggctcccttggaataccgggaaatcctgcaagttttgattgccataattcctttgtggccctgttgatgagccaactttaagactctgcttgtgttgaaaagggctgcattgacagattaagagatcaccagcgttagggagtctgaagggaccagacgtgaaaaggcaaagttcagagtaataaagggaaacggccggtcatttcctgagaccattcttccgtgtctttctagcagaccttactgttggatgagaaacgctagagagtgtagtcccaaaatatctcggttgctggtgcttgaaatttcaccgttagagatattgattcctttggggcttgacgatcctctattaaaatgcaaattccccttgaaggggctatagctcaagcctttatcagccaacactttagcagggatgggatttattttccaatttaacgagatggccaagggatgaacagggggtagggaattccacagatagagtgactgatctcaaaatgctggcccgtggccaaacgctgccttctcccccagttcttatctttaacaggactaagcctctggccggcattgtttaaagcactccagtacaaattccaatttcctggagacattttctgcctagaagttcgcagtgcagcactttttaagagcttgaaacaatacaaggcatgaccctggactggcaggaagttatgttcgcatttgatcatctcccccattcattcattcattcattcatccgttcattcattcctccaacaaaagttcataaagagctctctaatcataaggctttttttttttttacgttcttagggtacatcagtgaacaaaacagacaaaaatccctgcctttaagggattcagagagaaacacacaatagcctaacaaattagtgaattacagtttattgacattgtatactattcaaaaaatagtatacacccactatgtgccaggcactgaagatcgaagaatgagttgcaagccccctgtactcagagaactttcggtctagtgggaagactggcggcacactgggttcagtgttatggagactacacagtgcccccccaaccccacccccaccaaaaaaaaggaatcagatgataaggagatttgaaaagagttttctgaccacaataccaaaaatgggttgaggggtgcccaagtgaaagagtgttcagaggctgttactgtcagctggcaagaggtgatagtgttttggattaaagtggggttagtggagatgtcgagaattgggtgtgtttgggagatgtttcggaggtgtcagtgatgaattaaacagaagggggagccagttggtgacctccagtgatctcccatttatgaatgagagatgcttccaaaatatatgtgaattgatttgttttatttatttatttaagaaaggtacggaaagagagctccaagcaatacagcaggagattttggtgaaggtgggttaggagagggatctactttcgctgtaaaatttcgtttgcatccaaagggagagactgatctagaaattaaacttacttcacatttctatcaatgaaaaagcagttttgttgataaaatgaaaactttagacaaataaatttaacagagtttacttaaacaatgaacaattcatgaataaggcagccctcagaatcataagaggttcagagaactccactctgccatgtgggcagtgagtatgtatagacagaaaaagattgaagaaagtagaaatgaggaacaaaaagcagattagttgtttcaaagttactttccccataatggttaaaacggaacttccttatcatgtctgctcaaactggcctttctggatatttgtctattctctctcttctttctctctctctcttctctctctctccccccctctctctctccctctctctctctctctttctctctgtgtctgtctttcccccacccctcttcctctccttctcctgatttctcataaagtcagctaaacaaccgagtttcagcttggtggattaggactttagcatgactgactccattttaatttggtctgttggtgggagctctgtccaaatcaatggcctccaaaaatttttatttcatactatgttttacagaattttttaatcctgttgtattaaatgcaacagccaaagttaccttgatgaacacttgcaatttggagatataaatagggagataaaagtagttaaagtgagttgatttcatgggagtgaatcataaagaaagaaaggaaagaagaatgaaagggaagggaggaaaagaacagaaagaagggaaggagaaaggtagggagagagggtgctggcctgagcttagcctccctggcactgatcacgacaactcattgactctctttgatcttcagtgtttgtctcttgtaaaagcattataatcatacatgtcctagtgttacagaagattcttggagacccctggaaccaagttatggcttttattctccctggatcagatgggactaatagacaaaaccattgttcttttgggttttgtttctttgtttttgtttttttaaagacagagtctcagtctgtcatcaggctggagtgcagtggcatgatctcagctcactgcaacctccacctcctgagttcaagcgattctcgtgcctcagcctcctgagtagctgggactacaggcgcacgcccccatgcccagctcatttttgtatttttagtagagacaaggtttcaccatgttggccaggatggtctagatcgcttgactttgtgatccacccaccttggcctcccgaagtactgggaattacagatgtgagccaccacacccggccaagaccattgttcttaagcaaagcatgacaaggtggctgagcttcttgctgaaagacaggtttcagggctgcttgcaccatggggagacaaggaacacttacaaatgcctcagtcaccacatgcttgtttcagattcctgctctttttgacctgtacctgtccatacataatggatgagaaagaatctagacccttggtagcctctcttacgcagtagagagttgtgcttggatctcacaatttctgcctatggaagagtaataggggagaaactctacttctaggaatgtcagaccagctacttctcctactaaagacaacttagaaaccagggggactttttttaagtatctccttaaaagtatcaaagattatggagataatgagggaacaccaagcctagatgcaataggagaaggaatgcggagaggtgtgtgcagcacgtgggctgcctttctagctctggcagctgcacacagaatcagaaagatgaatttgagttcaggagtctccaaaggtggggacccagtaaaccagtcccctgccttgtgacagaaccccaaatggctgcatccctggagcaggaaataagtcaaacttccctctttttgcaggtgcccagaaaccccaattctgcattgcacaagcccctaggagctggcaaaacaatagaaaattctctctaaagaaagatattatcattctaggcctccaattatttctatgaatagaatttttaaaactcactttcccttaacttcctcaacacgataaaggacatttatgaaagacccaccactaacatcataatcaatggtgagagactgaaagcttcttcccaagatcaggaatttgacatgtggtgaatgtccacattcaccaccactgttcaatattttattggaagttcagccagaacaattagacaagaaaaggaaataaaggacatccaaattgtaaaggaagaagcaaaactatctctatttgcaggtgacatgatttgatatatagaaaatctcaaagaattcacaagaaagctactagaactaataaacaaattcagcaaagttaccaggtacaagatcaacacatagaagttagttgtgtttctatacaccaataatgaataatctgaaaaggaaaacaataagacaattataataatatctaaaagaatgaaatacctgggaataaatttaaccaaggaagtgaaggcttgtacactgaaaacattgctcaaataaattaaatacctaaataaatgaaaagacttgctatgttcatgcatagaaagacaatattaagatgacaacaccccaaattctctacagattcaaagcaatccctatcaaaactccaacagccctttttgcagaaatggaaaagccaatcttcaaaatcatatggaattccaagggtccccagatagccaaagggtcttgaaaaagaacaaagttgaaagactcatacttctagatttcaaaacttaccacaaaggtatagtaatctaaacagcatggtactggcataagagtagacatctagaccattggaatataattgagggtccataaataaatccatacatctaaggacaactgatctttaacaagggtgccaagttcattcaatgggagaaagaatagtctcttcaacagatggtgctgggacaactggacttgtacttacaaaagaaagaagttggactccaagctcatatcataatcaaaagttaactcaaaatggacctaaataaaagagcaaaaactatggaagtcttagaagaaaacataggcataaaccgtgaccttggctctggctgtagattcttagatatgacaagagaagtatgagcaatgaaagaaaaaataaacaaattatacttcatcaaagttaaacacttttgtacatcaaagcacattgtcaagaaagtgaaaagacaaactataacatggaaagaaatatatgcaaagcatttatcttgaccagagatatatgccatgtattcagattatggatagaactactcaaaacaaaatgacaacccaatttaaaagtgggaaaatgacttgaatagacatttctcctaagaagataaacgagtgtcctgtgaacacctgaaaagatgctcatcactcatcattggggaaatgcaaattaaaaccataatgtgatgccacttcacacccatcaggatagctatattattaacttgtttttgtttttgtttttgagacggagtctcgctctgtcacccaggctggagtgcagtggcgtgatctcggctcactgcaagctccgcctcccaggttcacaccattctcctgcctcagcctcccgagtagctgggactacaggcgcccgccaccgcacccgctaatttttttgtatttttaatggagatggggtttcaccgtgttagccaggatggtctcgatctcctgacctcatgatctgcccacctcagcctcccaaagtgctgggattacaggtgtgagccaccagacctggccagctatattatttaaaaaaaaaaagaaagaaagaaaggagcaagtgttggtcaagatatggagaaattagaacccttgtgcatttctggtgggaatgtaaaatggtgcagccactgtggaaaatggcatggtgacccctcaaaaaaatcaaacaaattctacttctggataaatacccaaatgaattgaaagcagggactcaaagaggtgtgtgtgtgtgtgtgtgtgtgtgtgtgtgtgtgtgagagagagaaagggaacacgtgtgatagggtgttactctgtcacccaggctggagtgcagtggcacaaagacggctcattgcagcctggacctcccagactcaggcaatcctctcacctcagcctctcaggtagcttggactacaggtgcgcaccaccgtgcctgactaatttttgtattttttgtagagatggggttttgccgtgttgccccagttggtctcaaactcctgagctcaagcaatccacctgtcttggcctcctgaagtgctgggattacaggcataatacccatgttcatagcatcattattccaaaggtggaagcaaaccaagtgtccatccttggatgaatggataaacaaaatgtggtctgtacatacattggaatcttattcagcctttataaggaaggaaattttgacacatgctacaacatgaacaaaccatgaacattaggctaagtgaaataaggcagtcacaaaaggataaatattgttcagatccaccttatgaagtacctagagtagtcaaattcataatgacagaaagcagggtggtagttgctaggggcagaggggtggtgggaatggggagttagtgtttggtgggtacagtttcaattgcagaagatgaagagttcctggagatggttggtggtgctacttgcacaactatgggaatgtgcttaatgccacagaattgcacacttaaatttgttaaaatggtaaattttatattatgtatattttaccacaataagaaaaaaacaatgaaattctcaaatccacgaggatggctataataaaaaaaatgaaaataacaagtgttggagaggatgtggagaaattgaaacacttgtaggttgctggaatgaacgtaaaatgctgcagccaacgtggaaaacagtctggctgttcctcaaaaataaacgtagtatttccacatgacccagtagttccactcctaggtatatacccaaaggaagtgaaagcagtgactggaaaagatatgtgtgcaccagtgtcctggagcatgtttgttcaggtgattatcattggagggctggaagcaagctggactccctggacactgatggagaatcaggcacatatagaattttgacttgtctttgttcgttaggtttaaaatgtctgtctcattgctaccaaaataattaaaggtcaactaagtgcagggagagaagaaatctaatttgacaggccttgaaatacttattacttcataggttttgtgatgagatttaagttagatcatgaatacagaaaagtattttttcaaacattacgcactttatgaatgctggccttattccgttagcagtaagttccttacggacaggaatcattcacgtttgcagtatcctaatgcacttagcacagtcctagcagatagtggtattcaattactatttattcaagctaattctgtatcttaaactatgttaaaattgaagtttttaacacttctgggatagtattgactagaattttgtgaaaaacccctgagaagtaaatgacttaattattgaaggagggtaataaggctaagaagtgagttccagttaactcaactagcactattaaatcaggttattagaaacctatgcattctaatggtttcattagaataagcagttattcatatgctcagactcaaacaaacttatacatgaaagaggtgttttgcctttagggaaaaactatgaaaattatgagtcaagcctcatgagatttgataattctcatccatcaactgaacagaaaataatggagtaaaatttatcatttggctctaaagtatgggtcaccttcaatcagaactccttcacttttattttattaagaagcaaaagtaaaacactttgcttgtggataaatggaaagttgcttagagaaataagcattaggatgcactcatttttggtgtcgattatgtgattggcccacatttttatagcaacagcaagagcagcagcagcaaattgctgagacgtaattcttatggcatatgttggcttttttcatgcaagcaagctatatgttcagtggtaacctggaccattcagcaaaatccatttctctcttcactctctccaacatgtttctctaatcctctgctccagcaaaatactggcctttggtttctttctttttttttttttttttgagatggagtctcgctctgtccctcaggctggagtgcagtggcgcgatctcagctcactgccatctccacctcctggattcaagtgattctcctgcctcagcctccagagtagctgggactacacgcacctgccaccacacccagctaattttttttttttttttttttttttttttttttttttttttttgagacggagtctcactctgtcgcccaggctggagtgcagtggcgcgatctcggctcactgcaaggtccacgttccgggttcacgccattctcctgcctcagcctcccgagtagctgggcctacagatgtccgccaccacacctggctaattttttgtatttttagtacagacagagtttcaccgtgttagccaggatggtctcaatctcctgacctcaagatccacctgtctcggcctcccaaagtgctgggattacaggtgtgagccaccgcgcccggccaattttttctatttttaggagagacagggtttttccatgttgccaaggctggtctctaaactcctgagctcaggcagtcggcccatctcagcctcccaaaatgcggggattaaaggcatgagtcaccacgcctagcctggcctttggtttctaagcttctggacagtaatgggtcactcctgctgagaatgactttcttcatcacctttgcaaattctatccctctcttaggtcttctctcacatctaaaagtcagggcagcagaatggttagggcacccatgttagtgtcacactgccttagtaaaaaccccaactccacttcctaatgaaggtaataataatacctatcttataaatttcttgtgaggattaaatgatttcatttatctagagttcttagagcagtacctggcatatagcaaacactaagtgccagttatttttctattattgtgtcagtacttctatttgaacatattcccgttaggtctagctttccctggcctatagcggcagaacagattatgctggaaaagaccaaagggaaagttaggcctacagggtctgcatccagaagatgaagttatattagaacctcaaatgcaagactgaaccaaaataggaggaaaggtgagatctaacaccattggtagactaagagcagaatacagatattcagcaaaggtggcttggtacctggcacccatcttctaagtcagcataaggcaaagaggttaggctgtttcctcaaatatggtataataactgagaagagacttcacaatgggtatttatttgaatttcccacagtgtacagaataacaccttattagaataaaagctatagtaaatatttgtatattgatgtcttaaaattaagaaagtatttaaaatgctcccccttttaagccatctattctataaatatctattgagtgaaataatatacaagacattaccctaagccatgtaaagatcagtaagacctcgcaccagacctcatatttcttatgggctaattactacctataattcaatagtcattattgtaatgactttattagttttagtcttctaattatatcattatttcaatatctttagaataaacagaccaagtaatgaaatttcagaaatgatttagtgatgtaagtgtgggatctaaacaaaaacaactttctaggaggtttcagatttgattataatcatctcctaacatggaaaggatgtagaaatcctttttctactcttttcttgtagggattaagtatcgttgattcttaagaaggatattgaaaaaaggcaataagaaatacaataacatccctatagacagtgagagcataccagaaagacataaccacaaaatagatcaactgattagatgagtgagggccacccacattatggaggggaatctacttcacttaaattccactgggttaaatttccatctcatccataaacaccttcacagaaatacccaaaataatatttggccaaatatctgggtactgtggcccagcaaagttgacacaaaattaatcaccacaatgatgaaatttttaaaaaactcctaaacaaatggagaggcatagtgtattcatgaattgcaagagtcaacatagtaaagatgtaaattctccccaaatttcctgataggtttactgcaattcctatcaaaatcccagcaagttggttttttttttaaaagacatatgtacatttatttttaaatgtatgcaaaaaggcacaggctctagaatagctaaaataatccgggaaaagaattaagtgggagtaattacttgatattaaggcttactacagagatagagtaatcaatatattgtggtgttggcagaaggatagacacacagttcaatgtaactgaatagagaacccagaaatagatccccaaaatatgctggttttttttttttttttttagatagaggcttgctctgttgcccaagctggagtgcagtggcatggtctcagctcactgcaacctctgcctcccaggttcaagagattctcatgcttcagcctcccaagtagctgggattataggcgtgcaccaccatgcccggctaatttttttgtatttttagtagagatgggtttcaccatcttggccaggctggctaattgatttctgacaaaggtgcaaaagcaattcaatacaggaagaaaataactgtttcaacaaatggtattggagcaaatggacatctgtaagcaaaaacaaataaataacaacttctatttaaacctcacactttatacaacaatgtattcaaaatgaatcatggacggacttacatgtaaaacagaaatgaaaggaaaaaagaatttcagaaataaagactaaacaaaaagcagtacaagagtgaataaacacaataaataaaaacctgaggagcaataaaaagcaaaaaggaggaaaatttttaagatcataaagaaattaaaaagataaaaaagattttagatagtggcatatttgaagagtgttaaagaagatccaacatgtggctgaaaggagtttctgaaaagggaaaccaaagcaagggaacaaaacaaatattaagaactgtctctcaagaaaataatcctgaatttattttattttattttattttattatttttttttgagatgaagtctcactgtgttgctcagcctggagtgcagtggcacaatcttggctcactgcaacctctgcctcccaggttcaagcgattctcctgcctcagcctcctgagtagctgggattacaggcaggcgccaccacgcctggctgatttttgtatttttagtagagatggggtttctccatgttggtcaggctggtctcgaactcctgacctcatgacccgccccattggcctcccaaagtgctgggattacaggcatgagccaccgtgcccagccctgaatttttaaaaagatttgaaattgcacattaaaggaggatactctgtaccagacaatatcaaaccagaatgatcatgaccaaaatatattggaataaaatttctgagctctaaagaaaaagaagatattttgggggatcacggcaaaaagaccaggtgacttaaaagggaaataaaatattggacaataattcattatgccagaaaaatgacatgaaagcattttaaggaaaatcaagtaaagaaaatattactcaaagattttatatccagtaaaactaaatttcaagtagaaaggacacagatagactgaataaagaaaatgtggtacatatacaccagggaatactatgcagccataaaaaggaacaagatcatgttctttgcagcgacatggatgaagctggaagccattatcctcagcaaactaatgcaagaacagaaaaccaaacatgcatgttcttacttacgagtgggagctgaacaatgagaacacatggacacagggagggcacaacacttactggggcatgtcaggggagagcaatgagggggagagcattagagaaaagagctaatacatgctgggcttaatacctaggtgatgggttgataggtgcagcaaaccaccatggcacacatttacctatgtaacaaacctgcacatcctacacatgtaccctggaacttaaaaactaataataataatttttttaaaaagtaaggatgcagataaactatcatcaatgtgcaaaaattcaaggaatcttgttccccataatccctttctgaagaattgtgttaatgtgcttcaaacaaccaaaataactagacagacattgacctaagtatagatggtgagcactgatatattgctccttttagaactgaaagtaaatgagggccctttcctcacaccatatacaacaattaactcaaaatccatgaaaggcctaatgtaagaactaaaactgtgaaactctttgaagaaaatataggtgtacatgtacttgaccctggattggaagtggtttcttagctatgaaacctaaatcacaagcaaccaaagaaaaaaatagataaattggacttcatcaaaattaaaacttttttcaaaagacactatcaagaaaatgaaaagacaatgcacagatagggagaaaatgtttgcaaatcatgtatcgcttaagggtctaatatcagaaaataaatgtatatatttatcctacaaatacagtaaacatgtatttgtaaactgttgcagctcaacagtaaggaaataaacaacccaattaaaaagtgggcaaaagatctgaagtgatgtttctccaacaaaggaaagaaatggccgctgaagaaaacaaaatctatatcttgaagagatatctgcacttcatcttcattgcagcattattcacaatagtcaagttatggaatcaacctaatcatccattgatggatgaaggaattttttaaatgtatgtgtgtgtgcatgtgtgtgtgtgtgtgtgtatgaaatggaatattattcagccataaaaaagaaggaagtcctgtcatttgcaacaacatatatgaacacagaagacattatgctaaatgaaataaaccaggcagagaaggacaaacagtgtatgatctcacttacatgtggaatctaaaaaagttaaactcacagaaacagagtagaatagtggctgccagggactttggggtgggggaaatggggagatgttggtcaaagggcaaaaactttcacttataagatgagtaagctctgagaatctaatgtacagcatgctgattattgttaataacactgtattttgtatttgaaatttgctaagacagatcttcagtgttcacatacacaaagaatggtaattatgtgagatgatggatgtattaatttacttaatcatggaaacaatttcataatgtatatgtatatcaagtcatcacatttcatatcttaaatatatacaattttgtcaattatacttcaataaagctggaaaaatataaacagtaaactcaaagatcgatggatagatagatagatagatagatagatagatagatgatggatagaatgatttagttgtttctccattcattgtaaagttaaagatgaatacaaattatgttgcattcctcttatatacacctaattacatcagagagctaatatgtacctcagaaaaatacatgaaaatgagtgctttataagacaacaaggattgaagctaactgggaaatccttatatacttttatacccctatatacacttaaacaggagtttcaacatcattcctaatttttcagagaagcacatccattttcaaaattattgattcactgaaatttatctctgatcattttcaaatcatattgaattgcgtgaaaccctcgaaaaaaagaaatagccaataagcacatgcagagatgcccaacatcatcagtcattagggaaatgcaaatcaaaaccatggtgagacacctcttcacacacacatgaaaagatgatcataatcaaaactatggacgagagaaagtgtgggtgaggatatggagaaagtggagcctttatacagccagtggaacataaaacggcacaaccacaggccgggcgcggtggctcacgcctgtaattccagaactttgggaggccgaggccggcagatcacgaggtcaggagatcgagaccatcctggctaatacggggaaaccccgtctctactaaaaatacaaaaaattagccgggcgcggtggcgggcgcctgtaatcccagctactcgggaggctgaggcaggagaatggcgtgaacccagaaggcggaacttgcagtgagccaagatcccgccattgcactccagcctgggcaacagagtgagactctgtctcaaaaaaaaaaaaaaaaaaaaaaaatggcacaaccactttggaaaacagtctggcaatttctcaacatgttaaactttgatttaccatatgactcagcaattccagtcataggtatatacccaagagaactgaaaatgtattttcgcacaaaaactaatatacaaatattgacagcactatgattcataatagccaaaaatggtaacaacctatatatccctcaacagatgaatgaacagacaaaatgtggtatatcccaactagacagtattttcagccacagaaagtaattaactattgatacatgctataacacagatgaattttgaaaatattatgctaagtgaaaaaagccagtcacaaaaggccacgattctattggtatgaaatgcccagaagaggcaaatccacagagagaaggaaaatagattaatggctgtcagggctggaaggaggaggaatgggaatctctactaatgggtagaggtttctttttgaggtgacaaaaaagttctaaaattggatagtggtgatggttgcagaactctgtgactatactaaaaaacaatgaattgcgtacactttaaaagagtgaattttatggtatgtgaattatatttcgtaaaggtgttatttttctaaaagaccaatggagggttaaaaagaaagtataggctggccacagaggctgacacctgtaatcccagcactttgggaggccaaggtgggcggatccctttaggtcaggagaattagctgggcgtggtggtgcacacccagctactcaggaggctgagacacgagaatcacttgaacccgggacggggaggttgcaatgagccaagattgcaccactgcactccagcctgggcaacagagcaagatactgtctcaaaaaaataaaaaagaagaaaagaaaaaagaaagaaagtatagtatgctctgattatatgctctgacaatatagatgtaatttggctatttttaaaaacgagttgaatggggaaaacatatgtaaaactgggaactacttgcagtaatcaattgattctggtagtattagtattagcatggggagatacttagcataatacaagattaagcaaatgaggtattatgggatattctatcatcccttgtgttcttgaaaaccaaattctcgaggtagaggaaaggagttggagacatacccaggctaggttacatacagaactctgtagtcctgaatttgaactagaaatgggaatatgagttcatgagataggctatctgtgtagctaaccgtgtgtgtgtgtgtgtgtgtgtgtgtgtgtgtgtgtgtgtgtgtgtgtgtgtttcgtagctctgtccactgaaaaaatctagaaacaatgaccaacccagtagcaatgaacatcccaagggccccaactatggtcctgaaatattacaccatttctcaataagagaaatggctgagctgaagtttgggatcatacaggactgcaaaagagctgtgaaagactgttatactagagcgatgacaaaagggttcaggagcccactttagatgttcttatttgctaaagattaaaacaatttttttctgagtgccaataagaatactcattgtaaggcattcaaacctaccaaatatgtttaaattcagaagtttataatcatatgttttaaaactcactggttgccctcagaggatgataggaaaacaactcattatcttaaaacctggcaaattagaaaacaattatcttgccttcctatatgaagtgtatcattgggaaaccagttagtagatgagaggaagtgtctttttttattttttgagagacagtctcgctctgtcacccaggctggagagcagtggtatgatctcagctcactgcaacctctgccgcctggttcaagcaatctgctggcctcagtctcccgagtagctgggactacaggcatgcaccaccatgcctggttaatttttgtatttttagtagaaacggggtttcaccatgttggccaggctggtctcaaattcttaatctcaagtgatctgcctgcctcagcttcctaaagtgctggaattacaggtgtgagccaccacgcccggctggaagtgtctttttgtaataatactgcaaacaataattgaaaaagatattgaattaaaatgtcatcattttgcaaatcacaattagttaaaagatacaggcactgagcatcgacagcggctaacattgaaaaaagacatgaactgaaacaagacatgaaggcctcctgatgaaagaacaagccatttatatcctgcaatggggatcaagccagactccaattcagtccagttccaggtaccaattttcaggaaactcagaagacagagtaatcatgttgaactgcaccaagagggtacacttggcaaactccagactccaaatgtcctcggcacttcagcctgtaaattgcagggaaaagaaagggatagagggtggcgggcgcctgtaatcccagctacccaggaggctgaggcaggagaatcgcttgaacctgggaggccggggttgtagtgagcagatattgtgccactgtattccagcctgggcagcagagcaagactctgtatcaaaaagaaaagaaagagagatcaagagagagagagagagagggagggagggaggaaggaaggaaggaagagaaagaaagagagagagagagagagagagaaggagaagggagggagggagggaggaaggaaggaaggaaagaaaagacagaaagacagaaggaaggaaggaaggagaaagaggaaacctgtacattaaaagagacttgatgacatagtacaaatttttaatggacaagactaaactataggccggggctgtgactcatgtctgtaatcctagcactttgggaggctgaggcaggcagatcacttgagcttagagttctgggcaacataatgaaaccctgtctctacaaaaaatacaaaaaaattagcctggcatggtgggacgcacctgtagtcccagctactcaggaggatgaagtgagaggatcacttgagccctgggaagttgcggctgccatgacccatgattgtgccgctgcactccagcctgggtgacagagcgagaccttgtctcagaaaaaaaaaaaaagaaaaaagaaaaaaaaggctaaactacagtgtctagggatagctacttgagtgataaaaccatacagaaatgaaaggaagtgattactataaatcagagagtgactactttgaaagagaaggaagaggattgtcattggggccaggcacgtggaggagattctggggcagctggcaaagtttaatttcttgaccagagagggtgattacaagcccactcacctcacaataacttatccagctccacacttgatttgggtggatttctgtgtctgttttgtctttccataaaaaggtttttaaaatctctaccagagcatgtttgtttacaatttcagattaaaacctcgccttcttggctcgtccaagttccatatgaccttcctgcaccatgacttttgttctgtatttgagagcaagtttttaaacaactcaattttgtgtctgacatcaatgaacaaagatgtagatgctgttctggaatctgcctctgcgtgtcttcattcgtcacggagaaggggctgcatatcatcttccagatggtgcttgacaagcacactctttatagaatgaaaggaaactgtggccatgaacaccgcattcagctttccctccgctacctctgcagccttttagatgctaacatagactgcctgccccgctgcggatttacagctattcggatgtcaactctattccttccagactttgtctgcgtcagattagtcaaggcaggcagctgtgatacagacagtaggaaaaacagtaggcttggaatcaagacacctggcctccactggcaactccttccagctctgtaacctgggacaggctgctcaatattcctgcatccgtttcctcatccggaaggtggggattatacacgggattgttgtgagggaggtgatgcgtgaaaaagcaacttgtgaactttgaaatgcactctcaccattcagaggtcttcagcatcctcacacagctcactcccagtgaatttctttctctatgtcattacccacagtaatgggtcacattatcatgctgccctatccaacacaaaaaatgatcagaagatcttattgtcctttgaatgcccttgcagctgggccactgaggtttgaagagatatggtgttggaatgggaagaaggcctcagggggtctcagagccatctggttccctgagtgttctcttgtgtcccttctgaggtgcctggggttccatggccaggttcagcgaccaccttagggtcaggaagtagatatcggccactctgaccctcatgcctgcctcttcagaggagctctgccttatccaatccacatcctggcgcatttgtaagtaagagttcacgtcacaggttctgaaaacaacagcagcaacaagtatgagttcaaggccaggcgcggtggctcacgcctgtaatcctagcactttgcgaggccgaggtgggcagatcacctgaggtcaggagttcgagaccagcctgaccaacatggagaaaccccgtctctactaaaaatacaaaaaattagccaggcgtggtggcaggcacctgtagtcccagctactcaggaggctgaggcaggagaattgcttgaacccaggaagcagaggttgcagtgagcagagatggcgccactgtactccagcctgggcgacagagcaagactccgtctcaaaaaaaaaaaaaaaaaaaaagaaaaagaaaaaaaaatacacttgaaggggagaaggagggaaggaagggaaattttacatgattgatataatggtatgtttaaagacacaacacaaaaggtttttaagggagccaaatattcataaacacactgataagaagcctgtgctttataaatgttctaacataacttcctgttaatatgcaaataatgccccaggggatctataatgtgattctcttcagaagtttaacaaactgctgtgtaaactagtagctattaatactttctgcattcatcttacacattaattaaaccttcaaacattgctgtcagttgttcttttgccaatcttctgtcaaacattattaaatacaatttctcatttctttctatctaaaaacatcctttttttcctgaaatatttaaaaaaacactgtaatgtaccaaaagatttgagaaaacttgtctcttctgggagatgctgtggcaaatcaattccttctaaataattaattttcttgagatcaatgcctaattagttttgcattttcttttaaagaactcactcaattttagaagattattgttaagggaaaacttatttcccgtcttcatgccctggaaggggcagtatcagaacacacagctcgggcttctcgactcctcacttgcttcttccccaaaaggagtgacttatttcatggataagcagaccccatatgtagggcagtgacccccatcctacctgctacctgttatgggttgaattatgtctcctaaaaggtacgttgaaatccaaatctccagtaactgtgaatgtgtctttattttgaaataggatctttgcagatagaatcaggttaaaatgaggtcactacagtgagccctaatccaaaatgactggtatcctcataaaaagagaaggctgggtgcggtggttcacacctgcaatcccagcactttgagagggagaccccatctctgcaaaaaataaaaaaatacagccaggcatggtggtgcacacctgtagtcccagctactcaggaggctgaggtgggaggatcatttgaaacccaggaattcaagcatcgatcacaccattgcactccagcctaggtgacagagtgagaccccatctcaaaagagaagaagaagaagaagaagaagaagaagaagaagaagaagaagaagaagaagaagaagaagaagagagaaaacacagatgtttctacaaaccaagtgtgtatcttcaagccaagcaatgccaaggatggctggcaaacacagaaactagaagaggaaggaaggattctccccaacaaatttcagagaaagcgtggccctcctgacaccttgatcttggacttctagcttccacaactgtgaagtgacaaatttctgttgttaaaccacccagtttggggtactttgttacggctgccttcacagatggatacaccatccttgctctctctgccccctggttctgctggcacccaggcatggcaagggcttcctcaagccaggtctgatctttccaacccatctctcatctgtgccaaaatcaggcaagtcatgctcatgaaattcctataggtctaggttcagggaaggagacaaggggcctgtctttgttttgtgttgctataacagaatacctgaaactgaataacttataaagaaacgtattggctcatggctctggaagctgggaagtccaagactgaggggctgacatctgatgagggccttcttaccatgtcatcctatggtggatgatgagagagtgagagaaagcaagaaggccaaattcaagctcactcccatgataaagttaatccatttgcggggggcggagccctcagggcctaattccctcttaaagttcccacctgttaacactgttgcactggggattctgtttacaacacatgcttcttgggggtgctatagtttggatgtttcacctcttcaaacctcacattgaaatttgatcctcagtgttgaagctgggttctcacgggaggtgtttgggttgtgaggatggatccctcatgaatagattaatgctgtccctggtgggggtggggaagaagtgagtgaattctcactctactttgttgctgcaaaagctggatgttcaaaagaatgggcatctcccttctctcttgcttcctctcttgttatgtgatctctgcaatctctgcacacagcagctccccttcaccttacaccatgagtggaagctccctgaggcccttaccagaagcagatgctggcaccatgcttcttgtaacagcctgcagaaccatgagccgaataataaacctcttttctttagaaattccccagcctcagatattcattacagcaacacaaatagactaagacagagggacacatttgaaccatagcaaatctctctgcagtccagatctgttacttactagcactgctctagaactttccttccgtttgttccttgtgtctatgtttctacaactatgtcatataactatatgtatagttacagcctgccgtttagctataacgtactctcccactgtgtcacttggctcacctcctgtgccagttaacaagctaatgtcagggcaaaatccactcttctattctctgctctttgtggctggtatgccctcattcattcctgatagcttctccactcaagcctgcatcaccctgagtaacttcaacatccccgtgacaactcccccaccagtgacagcctcttgactcctcctctgtatgtcccagtccactccatctcagctgccccctcccataggcatacctaggattttgtcttcaccagaagctgttctcctccaaaatagcaaatccacaaacagcccatgccctgtccatggcttccagcttgctcactcagcaatgttcaccctttgactatcatttcttcccttggctgatattcttatatttgtccttgcctcctccaatctactttatgcatcaaaaacagagaatgcttttcacattgcgtcaggtcactctgtgcatgtcaattatcaatataatgtatatagaaggggcacagactgatggttgccagggaatcataataatggctgttatggaagggtgtggtgagtgtggcttgcagtgatgtaacagtatcttgattgtggtggttacataaatctgcaaatgtggcagaattgcatagaactatatacacacaagtaagtactatgaaactgctgaaatctcaataagctctatggattgtatcaatgttaatgtctcagttttgatattgtactatagttatacaagatgttatggtgggggaaactggatgaagggtacagaggaccttcctgcacattttttttgcaacttctagtgaatctataatcgttttccaaaaaggtttaaaaaaaaaggaaataaaaatttcttcctgaccttctgctaggtggtgaggatgcagctatgagcgcaacaggctgtatctctagactcatatgactgaaacagatagggaggataagttgtggttctcatcactcttgggacaagccaggatcctgaataaggtctattagttcccctaatgggccctgccaatcctggcagcctcacctcccgctgttcttcagtaaccaccttggcttttacaagtttcctagcgtgtaggagcttcctccccgacatgcctcccaactctcacctgggagcagcctcccctgtgctcctaacctggtcaggtccctgtacaggctctgccagctccttgaacctcttctccagaggtgcaatagatctaatctcccctattaaactataagaatcgatgttttcgttgctcatgattaaatcctcagcaatgtacacggtggccagaacataggagtcactcatgaattttttgaatgagtgaatgactgaaagggctttaagcagaggataatgcaatctgatttgctttttaaaaaataaacttttgtgggggctgggcacagtagctcacgcctgtaatcccagcactttgggaggccaaggtgggcaaatcacttgaggtcaggaattcgagacaagcatgaccaatgaggtgaagccccctctctactaaaaatttaaaaattagtcactttgggaggccgaggcgggcggatcacgaggtcaggagatcgagatcatcctggctaacacggtgaaaccccgtctctactaaaaatacaaaaatcattagccgggcgtggtggcaggcacgtgtagccccagctactggggaggctgaggcaggagaatggcgtgaacccaggaggcggagcttggagtgagccgagatcacgccactgcactccagactgggcgacagagtcagactccgtctcaaaaaaaaaaaaaaaaaaaaaaaaaaaaaatttaaaattagccaggtgtgatggcacacacctgtaaacccagcggggagggaactgaggcaggagaatctcttgaacctgggaggcggaggttgcagtgagctgagttcgcgccactacgctccagcctgggcggcagagtgaaactccgtctcaaaaataaaataaaataaaataaaataagcttttgtgttttagggtagctatagaattacagaataattactgaagtagcatagagctcccaaatgttccatacccattttcccctattattattaacatcttaccttaatctggtagatttgtcacaatcaatgaaacaatactgacacattattattcactggagtccatactttgtccagaattcctgtttttctccctaatgttctttttgggatcccatccagaacacacgtccacagtataattagttgtcgcgtctcctacagctcctcgtggtgtgtcagcttctcaggcattccttatctaaagtcttatctatgcttcaccttcttaagagcagctacacagattgaagttcttctgctcgggtttgtctcttcttcactgtgtctttacttatttactggactgtttatttatataaattaatctatccttcattcacctactgaaggacattttggacatatatttatttatataaatatggtctcatggatatttatgttttgggttatagcctcctttttttggtgttcaaattgttctagctttggactttgggggctctttcagttggcctatgtgtccctttaacataaccctttctttatgggaatttattttgtgagcacttcgttattttctggcactaaaagatgctcccggcttatcctgtatatttccaacctgagtcctaggttcagcctttctcaaaaaagccctggttccttccactgaaaatggtattagaaaccaagctctgagcagtaggtatgctcattgctactggggagtcattgcttcattgcttgtaggcctgctcagttggcagaagagcaaaatatattaggtttgtgcaaaagtaattgcggttttgctgttacttttaatgtaactgtctgtatctataattctatatgtaaccatttatagatatacctctgcatatatataatgctgtgtgtaaccatctgcatctatattgagaagcatgagttcctactgaatgcttcacctctaatccattaccacatagatccttccagactcctctctttatctggaatctcccatgcctgcagtgaggagcctagcttccattatttgcttactttagttaattctttaatcccagtatacgtgtacggtggtttcagaattgttagctcatatccctagggggcacaactttatcagctagaatagagtgtgtatgtagagttcctgtgcctttagtcattcatttccaaagatacctaagccagcactttattcctcatctccttcaacaacattgttccatacatttgtggtacatttagatccttttgtcgcattctgcctctcattctgggttccccaacatcctaattatttttatttttttatttttttttagacagattcttgctctgttattcaggctggagtgcagtggtatgatctcagctcactgcaacctctgtttcctgggttcaagccattctccctgcctcagcttcccgagtagctgggattacaggcgcccgctgccatgcccagctaatttttgtattttttagtagagacaggctttcgccatgctaactaggctggtcttgaactcctgaactcaaatgatcctctcatctcagcctcccaaagtgctgggattacagatgtgagccaccgcactcggctcctaattttttttaaatttacctgattagggtttgctctctgcactgtaaagttcatagaaatcccccatagggttttgccaaatccttgtatatgccattatagtatcactcatacaaaaaaaaaaaaaaatccctgtgcttcacctattcaatcatccccccaacttctaacctcttggcaaacactgatctgtttattgtctctgtcgcttgctttttccagaatgtcatatagttggactcatacagtatattgctttttcagactagtttatttcatttagcaatatgcatttaagattcatccataactagagtcaggcgcggtggctcatgcctgtaatcccagcactttgggaggctgaggcaggtggatcagctgaggtcaggagttcgagaccagcctggccaacatggagaaaccccatctctactaaaaatacaaaattagccaggcctggtagtgaacgcctgtaatcccagctactcaggaggctgaggcaggagaatcgcttgaacccgggaggcggaggttgctgtgagccgagattgcgccattgcactctagcctgggcaacaagagcgaaactctgtctcaaaaaaaaaaaaaagattcatccataactttgttgggcttgatagctcagttctagttgctgaataatattctattgtgtgaatgtaccatagtttgttcatccattcacctattgaaggatatattggttgcttctaattttggaccattatgaatagagctgctataaacattggcatgctggtttatgtagggacatacgcttccaaatcagttcagtttcaaatcacctgagtgtgattgttgactctgatagtaagactatgtttaggctgggcacagtggctcatgtctgtaatcccagcattttgggaggccgaggagtgtggattgcttgagcccaggagttcaagaccagcctgggcaacatgatgaaaccctgtgtttccaaaatatacaaagattagccaggcctcatggcatgcaccgtgtagtcccagatactaaggaggctgaggatgggggatctcttgagcctgggaggcagaggttgcagtgaggtaagatcacaccacgcactctagccggggcaacagagtgagacccctgtctcaaaaaaaaaagaaaaagactaggtttagttttgtaagaaagcgcaaattctcttccaaagtggctgtaccatttttgcattcccaccaataaatgaacattcctgttgctccacatcccctccagcagttggtattgttggtttttggatgtccgccattctagtagatgtgtgggggtatgtcattattgtggtgatttgcaattctctagtaacaaattatgtttaactacagattaagtattctaaaatcatcattttgggccaatgcccattatttaactggcttaacagtaataataatattgattcagaaattttatttagtcagttatttaagagaacattttgcagctagttttgcttgaggtgttcatcaggtcatgacatggtttaaagctatttcatcattgcactgatgagatattttatcattgcactggtaagatattttatcactaagattatatctgttttaaaattttcaaactaaaactactaaatgtatggtaacaaattttgaggcttccattcatccattgttgaagtgacctaaaatcttttttttctttctttctttttttctttttttgagacggagtctcgctttgtcgcccaggctggagtgcagtggcgtgatcttggctcactgcaagcttcacctctcaggttcacgctgttctcctgcctcagcctccggagtagctgggactacaggcgcccgccaccgcgcccagctaattttttgtatttttagtagagacggggtttcaccgtgttagccaggatggtctcggtctcctgacctcgtgatccgcccgcctcggcctcccaaagtgctgggattacaggcatgagccacggcgcctggccaaagtgacctaaaatcttgacccagtccaagggtacttcctcatcccatctccatgcagggaatgttcatccttttagaacatgttgatagcaagtccatcatttttaagaggatttttaaaccatattctcagctctactggatgttaaatcatgtgactatgaacttaataggcaacgtgcatcacaggacatgtcagggaagataggttcaaatgtattgctgctgagcatgcacagaaagcttaagtaagagaaataataatgatgcaggattacttgaaggctgtattgaccatctattcatttagactaataaggatggagatagattcaaattgatcacaatggtgatgctctaaagagacagaccatgaggttctgcttcccagttccctagaactcccttggtccaggaccttctgagggctggtggttgaggttttcatttgattctcacagttgatagagcaaactttaagaagctgatatagaggagaaaaaggatcaagttaggcatcaggttcctgggtccactacctaacaccagtgcttccttggacaagttacttaagctccataagcctatttcctcatgtggaaactggtcataacaatcgcattataatccctactttgtccaaattagatgaacactgtgtgtaagacagcaccattgtcttacaaagcagttacaaactggcagccagatcaggcacaggggcaggccatttaccctgcaagatgatatatgttttaaaagtttgagtcaactttttcaagttcaaaaacttcatattaagccaagatttatggcttcctttaaaaactttaatggatctcacaatacagtccctacatttccaagagccgagcagcagccctgccctttaggcaaagcaccagctctccaggtgcctcagctccctaccttcctagctgtctctatgttttttttattaaaaccacaaataaactgtaaagccataaaataagtgattaatattattgctggagataacttacggaaggcttcttaacacctgagaggcgatgtttcactcagagtaaaggtgagggtagcctctatacggctggtgacagaaggtgcccatggcacaattcagtttgttgagccaaattttctgtgcttcattccacagtctttgtaatctgagcatgcatggcttgagaaacactttttaggcacacactttgatataaaacaatttgtcaaaaaaaaaagatgctggaaattccagagtcaagtagtctgccttactgacatcattcatggcaataatattatatgggctgctatgagcatctgctcaatattatatgggctgctaggggcatctgcccactttcctagaatgccacttttctttcactgggtctatccaaattggaaactccaaagcccatcccagttctctcccaccatcatcatcatcatcatcatcatcatcatcaatcatcatcatcgtcatctcatcatcatagatgtgatgatgatgatctctctctcccttgacctcttagggaaattactatctataaaaattaactggcaatgagtcacatgttgctttgaaacctgttctatcatatcatgatgtcttattgtatgacctataatttatttgattcttttgtagggacagggtcttgctatattgccggggccagtctcaaactcctggcctcaagtgatcctcccacctcagcctttcaagtagctgagactacaggcatgagccaccacacccagcttatgacttaattattcatatacaggtagtattcactttgcatggtactgtggaactgtaaaaatcaccatgcaatctgaaaccacgcaaagaaatattaataatcaatggggaaaatatgatttttctttctttttttttttttgagacagagtctcgctcttttgcccaggctggagtgcagtggcgcgatctctgctcactgcaagctccgcctcccgggttcacgccattctcctgcctcagcctcccaagtagctgggattacaggtgcccgccaccacgcccggctaattttttgtattttcagtagagacggggtttcaccgtgttagccaggatggtctcgatctcctgacctcgtgatccgcctgcctcggcctcccaaagtgctgggattacaggcgtgagccaccgcgcccggcctgatttttcaatgatacgttctaatgcttgtaaaaacattaaaatctctcttactggcagttataaacaataggaaaatgaaaaggaacagtaaaactgatatttgattatgccttggtgaattggcatactcctttctaagtttgcatcacttccaacattttcccctttgtgctttcaatgtcataaaatatatctgagagttccattaacttaaagtgtttccccaccaccaccttttttttttttttctagagttacttcctctggggtatcttcttcattctttttgtcatgaccttttccctcatttatgtctgtaagtttattgtcaataagtccttctggctgtatatctagagtttctccgaaggtggcagggtcaacattcacatgatcagctatgtcttccataactccacatggtcagctatttcttctataactccatttacatcccattcaaatttcacttccatctttaacactttttgtttcttttgtgtactttcatctttgttggccaatttgaccttctaattatctgtttttataaaatgccacctgggtttatcactgagaatcaccgaggcagcacaactacacactttgctggcagtgcaattgaatgacatatgcacaatgaccaatcactgcagattttgaaagaacttgctgcgattggtcaccaagcactgcaggtgttggaataaaggtcatgattggtaactgactgtggtgcgcatctgttacttacatagtgatttgtggactgaagagctagcagccccatttgtgctccatgcaatgactcacagttaatatgccatggtaactgtaatttgaaccgtgttgttggaagactgagttatttaatgaaaccatggtaaatgagttcgtttcatgcttaatcagaaccacgagaagcaaagcctgcctgtatttgtattctgtcttcacaagtccagtgtaagccccatgagggcaggacccatgactcaagaagtcatctgcacatattccccatgctcaccccaagcacctactacagtaccttgtgtatgaaaaaatactcgataaatatttactgaattttattttcttcaccagagaaagaactgtgtagatgtaacacagtattgaaagtcaagagacttcaattcttggtctgggtctggaactaattgagtatgatttttcagacactctctcttttaaaaaaatgtattttaagcaaaatctctacctatggtaaggatataatcagaattctaacaactattgtgtcttagtcatattcaagatgaaaaaactgttttagtttattattttattatttatattattttattattttttgagatggagtcttgctttgttgcccagtctggagtgcagtggcgcgatctcagctcattgcaacctccacctcctggattcatgcaattctcatgcctcagcctcctgagtagctgggattacaggcatgcaccaacatgcccggctaatttttgtatttttattagagatatattccctctttcagtgttcctgggagctccttaatgagccaaaacacaaagccattctgacagagaatgctggctgtcagctgcattcattcagagctaagtgatctgatccacacaccagcctaacagccaaagtgatctcactaaaatgaccaatatcactgcaaaggaaggttttccaggccaagagaacgtgcatgtgcaaagaccctggggcaagaaagaacctggcatttcgtagctaccaaaagcccatatgcaggagagcacagagggcagaaagatgtgaagagaatcacgagatggcccaatgacgaaaggggaagagctggaagggagtgccatgagcccctgttgaaatccctctggctgcagtgtggtgagtggatggcagaagagtcacaaaggatgtgggggaagaagctgtgaaaggatgccagaagagatgtgatgtgacctggccctgggtggaagcaagggagatgggaacaaaggcatagcttccagagaggtcaagatgtcaaaccagtgtttgaggcaggtggtccatgtgtggtcccagaacagcagcatcagcagcatctgcagggaacttgttagaacacgaattctcaggcccactgtagacttcctgaatcagaagctctgagatttctgaacagttggggttttctcaagccctctggaggagtctgcctcttgctcaagtgtgaggtccaccagacgaggtgatagaaacagaaaagaacctgcaaagatgactcctgagcaagggggctctcccacagggcctgggtgtcagtgagtgctcttcgggggcaagagagaaccctgggaagcactgagaagcagacagcaaagcccctccaaaaaatggtgtgaaactccaatttcattttatttaattaattaatttatttatttatttgagacagagcctcgctctgtcatccaggccagagtgcaatggcatgatcttggctcactgcaacctccgccgcccgggttcaagcgattctcctgcctcagcctcccgagtagctgggattataggcaagcaccaccacgcctggctaactttcgtatttttaggagagatggggtttcactatgttggccaggctggtcttgaactcgtgacctcaggtgatccgcctgccttggcctcccaaagtactccgattataggcatgagccaacatgcctggcctgaaactccaattttaatttgaaggacacatttgacaacatatgaattaaatatatctatatggtagatttctcaccaagaatttagatgaaaaaaagagggaaaggagacagttgcaacatttatgacgagggaaacggtcactatccctaatatgcaaaggagtccatgaggaaactcgatagaaaactggataaagaaagtgagtgggaatttcacaaaacgaagaaataccgataatgaataaaaagatcatcagtctacttagtaaccaaggcaatgcaaattaaagtggcaatgacatttctgcctatcagatggccacaagaattttttagaccaaataacatccagtggatcatattccacattgtggtcgagaatagaaattggtacaatcttcggtgatggtaatttgatggagtcttttaaaacttaaaaatgctcattctctgaaaatgagcagaaaaaaagaatttgtatgacaataatttttgaaagtgataaaataaactgttaagacagtttaatttctacgtagataccatcttattcataacatattataccaagtaattctcaatttactttcaaggtaattataaatccctgaagtcattatacatctcacccaaggaattataatatctagcaataacaaaaatacattgaaaaggagtaaactgctcagcagattttgaatattttattttgaaattcaacgtggaacttaaccaaaatattgttttatttctcttggcaaagtatctcaacagagagctatttccctaggaaaaaaagaaaatcttttattccctatgaaatcaagtccactctaaggaagctgattaggaaggagaactgagtgcctcaagctcagtagtgctgtcccgtgaagatgatgtgacttggcccccaaagggtggaagagcccttaccggcatcacgagtaagggcaggtgagaaaggtgggcacctgcaggtggtgctctggggtctacacacagtgacatgcacaggtgacacaaaccgtggtatttataggagtattcaaaggcaggctaacctcaaacactctcagcttagaaatgtacagatagataacgtttaaactgagacaaagctttgcagtttatgtgaagctcaaatgctgctgaagctgctctgtttcctggcccacccatccaccagcctgtgtatcctccccaatgaacaaatgatggaccaaaatgtggtatggcaaatggcaaatgtaaaactggagcaaagagattgtcaggctctttgagaatattactttttctaaaatatagttgattgattattcttttgagagataatcataggcccagtggaagttcaaaggtatatatcgaaagtcaattggcctcccaccctctgaacttgctttgaattccttgtgtgtcctcccaggacagtctatgcatacacaaatacctcctctatgtgtaaatgtcagtggcatgctattcacactcttctgagtttgtcttatttcacttaaccatatactttggaaattgatccacatctgtatctctaaatctgactcattttttaaaagtcattttattttaaataaaatgtggattcagggcagggcatggtagcacatgcctgtaatcccagcactttgggagaccaaggcaggcagatcacctgaggtcaggagttcaagaccagcctggccaacatggtgaaaccctgtctctacaaaaatacaaaaactagctgggcatgatgggggggtgcctataatcccagctactcgggaggctgaggtaggagaattgcttgaacctgggaggcagaggttgcagtgagccgagagcaccattgcactccagcttgggtgacagagtgagacaccatatcaaaagaaaaaaataaaatatggattcagaaaactgcaaaataaaatatatggcttaatgaattatttgaaggtaaatactacctaggataagaaatagaactttgccagccaccccagaagcacctccatattccctacctaatccctgtcttctccctcccaccataagtgacattaatctgacttgttttcatttttatttttatagctttatcacccaaatttgctcccctagaccttatactttagtcctacctattctaaaaaatgtgtgctaggtcttttaagtctcttttaatctatatggttcctcctccatccatttcatttctttacaacttatcgttgacaaatctgggctagtcgaatttcccatgtctgtctttttcttttcttttccttctttttttttttttttagatggggtctcactctgtcacccagactggagtgcagtggctcaatctcggctcactgcaacctccacctcctgggttcaagtgattatcctgcctcagcctccagagtaggtgggactacaagcgcgcgccaccacacctggctaattttctgtatttttagtagagacggggtttcaccatgttagccaggatggtcttgatctcctgaccttgtgatccacccgcctcagcctcccaaattgcatgttggtagcaatttgctatgccctttacacttaagggtcagtttttctgggtataacatttttggcttatactgtctttccttgagtatgttaaatatgctaatccattctcctttggtataaagcatttttctcaaaaaatcctggtaatagtctatttttcttttccttataagtcacataagactttttcaagatgtccaaagaatttctctagaggttcaaatgattttttttttcttaagtactaataatttcagtaggatatatcttgacagcagtcatcctgggccgatattctcaagtgtgcattgaaccttttctttctttctttctttcttttttgagacaggttcttgctctgtcacccaggctggagtgagtacagtggtacaacctcagctaactgcaacctctgcctcccgggttcaagcaattctagtgccccagcttcctgagtagctgggattacaggtgcaagccaccacacccagctaatttttgtattattatagaaatgagatttcaccatgttggccaggctgttctcgaattcctggcctcaagtgatctgctcacctcagcctcccaaagtgctgagattacaggcatgagccaccgcattcacatttcaatatacattatcaaatcttttatttcaaggaagttttcttggattatagctcttagtacttcctctgttctcttgctttggttttcttcatgaggaaaacctattattcatatgtacaatagccttcaatgttcactactttctcttaaatccttctctcttcatttctttttttttttttttgtcttatttcaccttttatgtctctcgaggcattacccttgtatttgtttacttttgtgttccttccaggaacacaggtattgacatccatcaaatgtatttaaatccatggattcataataattagtctaccttacagaataattatttttagttctacttttttcctgagttgtcacttcatttccaagtttctctaattctgattgatgctgttctgccatgtctatcatgtacttaatgtctttttctgaaatagatcaaacagaagcttgctgttttatgactatgtctctctgccatgacttgtcagttacagtgttaccctattctttattctctctagtttttaaaattactttgcataggattgaacttgatactcttctagtgctcgttttttcatgtgaaatcaagttttcctaaacttttagaacaagtcagggttccctagggggacagaactaatagaatagagggatagatagatagatagatagatagatagacagacagacagacagatagatagatatagatagatagacagagaaaggggagtttattaagtattaaattatatggtcacaaggtcccacaataggccgtctgcaagcctgaggaacaaggagagccggtccgagtcccaaaactgaagaacttggagtctgatgtttgagggcaggaagcatccagcatggaagaaagatgtaggctgggagactaggccagtcttgccttttcacgtttttctgcctgctttatatttgctggcagctgattagattgtgcccaccagattaagggtgggtctacctctccaagcccactgactcaaatgttaatctcctttggcaacacctcacagacacacccaggatcaatactttgcatccttcaatccaatcaagttgacactcagtactaatcatcacaaaggccatgttaaggaatgcttttcaaacttcacagggctcctacttctgtgttcaaaaatagagccacctgctttcagggatttgctggctgtttctttcccccaatgcagatggaaactgctccttcctttctttcatccttgtcttgctcaattttgattcctctcccagcgctttctcctgagtgtggagcccttcctgatcagtcttgggaattcctaggggctcgactgctcctgcctcctcctgcctcctcctgccttctttattattattattattattattattatttatttattattattattttttgagacagagtctcgctctgttacccaggctggagtgcagtggcgccatctcggctcactgcaagctccgcctcccaggttcgcctcccaggttcgcccattctcctgactcagcctcccgagtagctgggactacaggcacctgccaccacacctggctaatttttttgtatttttagtagagacagggtttcaccctgttagccaggatggtctcgatctcctgacctcgtgatgcgcccgcctcggcctcctaaagtgctgggattacaggcttgagccaccgtgcctggcctcctcctgccttcttactgtgggcacctgaactacctcgcactagagaggcaactcttcagctccacctgctcgtctcgaattggcccacaatactttctagtgaatactggtatatctggggttcttctgttctcaggtctatcatgcctcacccccttgctttctaacttctttcagcccctcaaacccagataccatgcaactcttgaggctgttggccatttatatatgctaggttagtgggaataatttgtcacctagttttgtcataaatattttccttgggttgtgggttttgctgcctagtttctgtgtgtctgcatggggacttggaaaaactgaaaacttggacccctttgcctagaatctggtttattctttataacaggggcactgtatttatctaaccagtcccctattgatggatatgtgggttgtttctgaattttgctatcacaatcaatgtgccctattattgtttgaatgtttgccccctcccaaactcatgttgaaatttaattaccattgtaacagtattaagaggtgggacctctaagaggtgattaggccatgagggctctgccctcatgaatggattaatactgttattgtgggagtggattcacccccgttcatctctctctcacctctctttgcccttctgccatgttatgactgatcaagaaggccctcaccccatacacagttcccagaactgtgcaccagtcatctgtttattatagattgcccaatctataatattaattattattgttacccaattattactaattaatactcaatctataataataataatctgtttattatatattacccaatctgtgatattcagtcattgcagcacaaaatggaccaagtcataccctttacacaagtgcatatgagcaggtacatctgtaggatacatttctagaggtggaatagttcaataaggatatgaacacagtaggtgctcaaaaatatttgctaatttgagttagaaaatgtatttgccacaatagtaataaaatttgttctggcccacagcccaggtagacttctattgagaacaatgtacttaaatactgttaagcacaactttggggctccttgagcagaagaaagaggaaacaaaaaaagacactgattcattcctgcagttagcaatcaggtgttgcctagtgtactacagactctactggggcctggggatatagcagaggtcctagccctgttggagctcacagttcagagtggagatgcctttgttgtttgagcaactttgagaattaaatgattgctcttcatactcacaattgagtaacacttcgtaaaacgtaccatccaatctttgtctacacctagaaaaacttcagggtaaatttcagtgcagagcacagggagaacagctgtccaggataaatacttagatgtcagctgtccatttggtcatatgccatttctgagagtcagtctacaacctcctcttcagaaggcacccaaggttttctgtaaacagatgaggctgcttcaggggtacactgcgatgcttcattcctgttggtactggagtacaaatctgggaactttaaaatgcatcgatggtggaaaaaaagaaaaaaacaaaacaaaaacaaatagcaaaagcggtgtgcattgcttcagtttcagccaagttcattctctcttccagaaacccagcttccatgctgatgtccttaagccatcaatgccgtcaacaatgctgttattccctaagttcagggtcaataaaggcagagctagctccgcagctcatggcaaagatctccatttggccataacattttcccagattgacctcgtaatgtttttcaacacggtgctctggacaacctctacaaagaggtgaaggcatccaagctgagtctcatctcccatcccctatgtgactattctgcactgaaacctgggactcttcctccttctttatccctctgcagtgattcagtccccaagtccaagtctattccaatgatcccttcacctctatatttcttctactctttctgatcatcctccataagttctgctgccagattaacctgtcacccctttgaagccatgattcatgtgggctggtctcaggctgatgtgatgttcaaagaaacgcagtctagcatccacttgtattttcaaaaattgctcccgtcctttatgtctctttagtcccatgcaggagatactttgcctatagaaacatttctcaaacaccctctttgtctgtctcctactcccatcacttcctggggcttcttctgtgctttcttgtctaaactcccccagtccctagccccggactctgagacacttctcactccacccttcccccttccctggtctttgcatcacaaaagcccaaagagtcagcagggaaatgacccagcctttcttagagagcttggggaaagaaacctggtggggaaactcttttagtcggacagacagaggcatattaaaactcattaaaaaaaaaactcttaaaaaagaaaaacactttgtaaatgtaattttttctgctccttgacacagattttcccatcatcccctagcgtctaatggatagagtccacgctcctggcctgggagtcaagaccctccacgtgcacccttaacttatgtctcaagcttctctactgcttcccagccttacccctctgcccttcccagccactttatctgctgtccctgaccacaccaccaatatcccagcatgctggctcctctcttcttccccatccaattcccgattttccttccagtgtcatctcaagtggctttatctcggggtttgatgttttctgctcctcccaaacctcccaagccttctgactcttcataagagtttgttcggtgaatgaatgaagccctcacttcatgcccttctctggtacaggaatcgcatcattcaggaagcttctttgagcaactaacaggcattttcttagcttatttcgttgcctttaaaccaaggctgccatttctgcctgtgcgttctgtctgccttcgctgcacctccactccttcaagcttggattgatgacttctgttctctaattttatctgggcaatcaaattcccaaaatatgtgtaaaagagaagattgcattcctattttacaaacgtggcaactctgtggaatttttaatcagataccagcttttctgcatctctgtgatgtttttcctccttcggagtcagtagatagggccttttgctttgcattgttgaccattgtccttgccttctgacattttttgctgtcttcctcacgtgcattccacagtcagaatactgggctttgtccttccctctttcattacaagaagctctgctataaggatgttttgtgggttcctcagctctaatgaaattccaggcatttccttgaagctggcccccagggagaagctactctcactggtctgtgacgctcagctagagaggagatgacggcgtgagtttggttctgggctggaatttcttgttgcaacatcccagcgtggcccctcttagaaccttcccaccaccacattcaaatcttattcctccagcctctggcacaccttcagcctgctaccagcagagaaaaaaaaaaaaaagacatatgttcttgctccatatatccttgaggtgggcaaaaaaattaaatgttaaccatggaggaaattgtgcacatccagacaggacactgtggcagtcagatcagtgccaaattctgggaagttatcagtgatggtcatagcatggacctaccagtacctgcccagggaccacgatctgtagctggaccacatcttggtgtgccacagtgaaggcactggggacaaatatgttcctcccactatcctggtggatccagaacctgggatcatggactctgctcagatccttttgaaaccatgccccaaagagttaaagaaaccagtgactcacagaaattcttaagcctgcaggatggcagataagaaaagaaacagcttgctgaaattccctccaactataaggtaacaaaacaggctgaaatcagttgaaaccaatacggcccactggagtatacgcagaacgagactggtgatgctacgacctgaatttcctctgcatgtttcatcctaactcccccagaatttgcacgtgggccccataaaaaggcaggaagagataattgtccatgcccaaggactttgcagaccacccttttcactccctgaaccttttctaacaaaagtacagccttatgcccagcacagggagaccgatttgagctagaatgctatctccttgttgatagacctgcaataaaaagcgtttcttttctgaaaaacccagtgtcatagcgttggcttctagcgcatcgggtagtgagcacttttgcttagatctgcagaccagaccactttgttttcggtcagtttggggcaggcagcagtacacagtggagctgagctggttgattcattcctggatatgtgcagaaggaagctgagagctgtgactgccttcagggcttccagctgacccactcactgggtgagggcacaggctctggaatgggcaccctcctccacagcaagatccgagaagaggatcctgaccacatcatgaacacctccagtgtaatgccctcactcaaagtgtttggcactgtggctgagccctgcagtgccccctccccatccatccactggtagagaacactgatgagacctgcggcacagacattgaggctccttataatattcgcttccgcaccctcgagctgaccacacaaaactatgaggacctgacccacctgtctcagctaacatgcgtggggtcaccaccttcctctgcttccctcaccagctcaattcggacctctgcaagctagcagtcaatacagtgtccttcccacgcctccagttcttcatggctacctttgcccctctcaccagttgtggaagccagctgtatagggctctcaccatgcccaaactcacccagcaggtctttgatgccaagaacatgatggctgccccaccaggactgccttcttccatgaatatccatccattcatgaaggaagtcaatgagcagatgctcagtgtgcagaacaagagtcgccagcagctatttcatggaatggatgctaacaacggtcaagacagccatgtgggacatccttcctcatggccacaagatggcggtcacgttcgtcggcaacagcgcggccacccagaagctctccatggcctctcagggcagttccctgctgtattgtgcgggaaggctgtcctccactggtatgcaggggagggcatgaacgagatggagttcgctgaggccgagaacaacatgaatgacttcatctctgaacatcgacagtctaggacgccgccgcagaagagggagaggactcagtgaggaagcccagtgggaggcctaaggcagagctcccatcacctctggcatctcaattccttcagccttcttccttggctgcccctttcttctccctcagtagtcgtgtttgctgcctttaccttgtttatctggggagagggagggtctagagcagtgcctggtacatagtaagtgctcaataaatatttgtctgctgaatgtctcctctctctttccactccaggaaacctagatttctgccgatctgggtaaccgtgtatttccttctggtaccctcctcccatctgcccaattaatatgtccctctgttttcaaaataattctccaggaagctgggtcccattcagatcccatttagaaccaaccgggtgctgaaaacccagataatgtgcaccatcctatgtccacgtagtagccagcactgggaaggtagaaggtggcaggaagaagttactgcaaggggctgggcatggtggctcacgccagtcatcccagcactttgagaggctgaggctggaagattgcttgagcttagatgtttgaaaccagcctgggcaacatagcaagaccacgtctctattttttttttaagtaacaataaaaaaaaagaaagaagttactgcaaggaagaggatgggattttccattctagaacggttttggagagggaaatccaggctcataaagccataattcccaggtatttctgtgctccaattctcaggttcaggggaggtggtaacagcattatcccattttcagtttcctttggaggagtcgccccgcttcaccaagagaggtctttccttctcccaccactcctcttctctcacaaatttttttttcttttttttttttttgagacggagtctccctccattgcccaggctggagtgtaatggtgcgatctcagctcactgcaacctctgccttccgggttcaagcgattctgctgcctcagcttcctgagtagctgggatcacaggcacacaccaccatgctgggctaattcttgtatttttaatggagctgggttttcaccatgttggccagtctggtctcgaactcctgacctcaggtgatccgcccacctctgcctcccaaagtgctgggattagacgtgagccacaacgcctggccccctctcacattttggatcccttccttttccctaatcagaaaaggagattaagagggagagatctgcctgggtcccttagcctctagaaatgccctctccattcccaatttgtcttaccccttaaaaggtgtaacatccctgacatatgtgggaaggtgtgttcccccacctaaatgtttgagtcattcccaagatgagaggggatggggcaacatctcatctcttccttttgctattcccttttttcccctgctcttggttttgtcctaccctacacttcagatttctattttgggttgaacttgctgctttttcctcataatgaaaagatgacattgtcccaagagccaaaattaaatgggaattggaaaaaaatccactgtgcagattgtctttcttccctacccggcagggatgatacagggaagcagcgtccaataccacctttgttaagagcctagaagctcaaagtgtgggcactcctgagagagggccctcatgcacatgccatggcaccagaggacctggtgggacagcagcccccaccccggttcacagagcagctgccatcgcccaggctaacctggagcatgcaggtaacagtgtctgttggaggatcacacatatgttgttgctagacaatgtaccctgaacaatgcaaatatacagcagttttgcaaacatcagagcagacaaaagtcattcttgatgtattaccctcaatttggaataaatcctttgtgcaacagagcatttcccttaccctttataaaaagctccttttaaggcagacctttggacaaaccaaggggacgatgaccccttggtcagacttctttttaccaggatgtggcagagttagcctgcagtgtgagaagacaagtcctctgacaccacttgaaggggctgagacagacccggtcagggctgatggctgtcagagggctcaccactccacactcagaggtggatttttttccaattcccctgctctgtgagacagtcacactcacagagtgtctctttagaagcttttatggaagcttttaaatttgcttcacaaaatgttaacctggctgtgttttctgcattgcatatatttaaggtgtatgacttgatgatctgattggttgaatttttgattgtttaccttttccttttttcatactgctttaagtataacaaaaagggaaaggaaacttttaaaatacattggatctcatttcccctttacagacaagtattttgcttcctatgactcaacttttatattagtcaggattctccagagaaacacactcaataggctatacagagataaataagaggaaatttaggggctgggcatggtgcctcacacctgtaaacccagcactttgggaggctgaggcaggcagatcacttgaggtcaggagtttcagaccagcctggcccatctctactaaaaatacaaaaattagccaggtgtggtggcacatgcctgtaatctcagctactccggaggctgaggcaagagaatcacttgaacctgggaggcggaggttgcagtgagccgagatcatgccactgcactccagtctgggcaactgagtgagacgccctctcaaattataataaaaataaataaataaataagataagatttattataggaactggctcatgtgattatggaggctgggaagtcccacggcaggctgtctgcaggctggaggcccgggaaagccaggggtgtactgcagcctgagcccaaaggccagagaacctggggagcttatggtgtaagtcctggagtccaaaggcctgagcaccaggaatgcacacgtccaagggctggagaaaatgcaggtcccagatccagaaaagagagagagagaattccctttgcctcctccttttttgttttgtctggcttctcagtggatgggatatgcccacccacattggtgagggtgatctttacttagtcaatggattcaaatgccaatccctttcagaaacaccctcacacacacccagaaagactgctctacaggccatctgggcatcccttaatccagtcaagttgacctgtgacattagctgctgcaactcattatttcatgtcttcagctgcgatattaagaaacatgatggaatccatcaacctacgccatcagcattcatcaacacaggtgcaacttaggttaaaagatgaggctttgggggaagatattcaaagcaccaagccctacttgtcaccaaaagcagaatttcagatcagtgggtggacattgggcaggaggcgctcttatgtggcatctctcagagagctctgcagggtctcatcccgatggctgcacaaggtggtgggtgacggggatgcccgctgagcctgaggcccagggcagcctgacagagggcctgtgtctcagccctctcgggcagaaggttaggaccaggcagcctggcatcttgatttccacagcccttttcctcatcctcttggtctcatgtcctgctctggactctctaactagctggttagttcctgaccaaggttgggcttcctccactcccacctctgtttctgtttcctaattttcgtgggctgcctatctctttcttagagtcttagaaataatggctagttcatctgtctgtagccatgtctatagtgtccataggcttaaaaatgttttcacagaggccgggcgtggtagctcacgcctgtaattccagcactttgggaggccgagtcgggcagatcacaaggtcaggagttcgagaccagcctgaccaacatagtgaaaccccgtctctactaaaaatacaaaaaattagctgggcgtggtggcagacccctgtaatcccagctatttgggaggctaaaacaggagaatcgattgaacccgggaggcggaggttgcagtgagctgagatcacgccattgcactccagttcaggcgacagtgtgagactctgtctcaaaaaaaaaaaaaaaaaatgttttcacagatgatccaggaaacgcactttgaagggtcctaaatctgctttccctcccgtgagcctcttgtgaatctgaagttctcagcaggttgccagccactaatagaacagagaaacacagaaatcaatgcgaaaacctttgttgctatgttcttcttacaaaaattacagacatgtcctaggtaagataagcatatgttctctgataatgatgatcaatatcattcttctctgaaatgcaatctagaaaacaggtccccagaggctgccctgatgggtggtggctgccagcagtgtgccctgaaggagactgatctggtcacatggccctcccaccccagggtggcagcacccacagacttaggagagacacacaggagggtgactcagcctggctctcaagaaagggccaaaacacccttggtgagaaagcacagaagacgctaagacaacccctggagaaaccaaaggaagaaagttacatgcaggagacagagcctaagcagacaagagctggaagattcccctggctgcggctggagtggaggaggaccacactcccagtgcagagccacccggcaggggcccatttgagttttgaagcgaaatcaccctttctgagtactctttgtgtgtcaggcatgtgctagctgttttgcatgcatggctgggcgcggtggctcacgcctgtaatcccagcactttggaaggccaagacaggtggatcacaaggtcaggagatcaagaccatcctggctaacacggtgaaaccccatctctactaaaaatacaaaaaattggccaggtgtggtcgctggcgcctgtaatcccagctacttgggaggctgaggcaggaaaattgcttgaacccaggaggcggaggttgcagtgagcctaggttgtgtcactgcactcccagcctgggtgacagagcgagactccatctcaaaaataaataaataaataagtcacaacaacctcatgagatagacatccttacttacagatggggaaactgaaacactgagggttaaataactcgctaaatatcccatggctggtcatggtgtagctgggacacacacaaacccaggcctatcaactccagtgcctacacgcttatccagtgcctctagagggacagacacagtactgaaaagtgcctgtgaaagacaaagtgtcacctgtctcattgcagtagtggacaaatggaactctgactgctcaggaaagaagaggtcggtgctcttggagcttcactctcttgtcccatgcaggtgcagggtagaggctacggatttcctgacacccaccctcctggccatcccctgatctcatcaccaggctcatcctcccactcctggccacgtgcctggaggttctcctgtctctgcctcaggtggcttttctggtttctgggccatctctcatggcctctgtgagccctgtcctcccatgactcacagtttgctccctgaatctcaccctcagactctaactggaggatccattccagctttcccgcatctcagtcccagtgagtggttctgtgtctgtgaagcctcagaagcagaaccaatgggatgatatagaatgtgggggtttattataggaatttgatctcatgcaaatgtgggaactggttagagtttatgtacgttttttgcttctgtgcctggtcagctgtgaggaaggacagatgacacaaagtgaggaaaaggacaagctcaccctggagaatgagtttggagccctcctgggcttctccctacctctgggaagcacctgtcaggtgaattgcaggagaagctggtgcctttgccatggagctgagcatgaactacctggcccagcagacagggaattgggagaaaccggggggaagtggttgctgcaggccgggttgctctcccatgcccaggaggtgggccggcaggtcagggacagtgcacctgggctgtgaagcttgtggtgcctgcactgacattctgagcaaggtggctgctgttttcccctccaccttgcaaatctcaagaatgggtctgggccaggtgcagtggctcacacctatagtcccagctacttgggaggctgaggcaggaggatcatttgagctcaggagttccaggctccgatgaagtatgatcacaccactgcactccagcctgggcgacagagtgagaccatgtctctaaaataaataaatgaaaaggaaaaataatggttttgctaggctcttttccacactgactgatgaggccaaagaaataagtgggaagaaggagttcatggaaactgcctggctgtttctgagccactgtcccctgtcccagaggctttgcttgggcagacagagggttcatcttactgagaggtggggaaaagggcaggaaatggagagaaaggaagaacaaatccctctcatttgatcagttcatttattggatgtttcttgttagaagctgagaataaagacatgcaaaagatgcagcctgacctctggaagcagacagtatcgattatcccaggcatgtgggaggagccgggtggactctcagggtctcatcgtgctgctctcccaggtcttgccttaggcaccaccattactgcatttgagaaatggcgctggcagtagttgctcctgcttaaaatgtaagggggcggccaggcgcagtggctcatgcctgtaatcccagcactttgggaggccgaggcaggcggatcacaaggtcaggagatcaagaccatcctggctaacacggtgaaaccccgtctctactaaaaataaaaaaaataggcggggcacagtggctcacgcctgtaatcccagcactatgggaggccgagacaggtggatcacgaggtcaggagatcgagaccatcctggctaacatggtgaaacctgtctctactaaaaatacaaaaatattagccaggcgtggtggcgggcgcctgtagtcccagctactcgggaggctgaggcaggagaatggcgtgaacccaggaggcggagcttgcagtgagccgagatcgtgccactgcactccagcctgggtgacagagtgagactctgtctcaaaaaaaaaaaaaaaaaaaaaaaaaaaagtaagggggcagctcgcaccattaggatggccactatcaaaaaaaaaaaaaaaaaaaacccagaaaataagtattggtgaggatgtggaaaaatcggaacccttgtgcactgttggtaggaatgtaaaatagtgcaggcactatgtaaaacaggatggcagttcctcaaaaacttaaaaatagaattaccatatgatccaaaaattccactgttgagtatacatgccaaagaaagcagggtcttgaagtgatatttgtacactgcgttcgaagcactatcattcacattaaccaaaaagtggaagcaagccaagcatccatccacagacaagtacataaacaaaatgtggtggattcatacaatggaatagtattgaggacaacatttctactaagtgaaatgagctaatcacaaaagaacaaataccgcgttattccacttatatgaggtgcctagactcatcaaattcacaaagacagaaagtaacatggtggttgccaggggccatgcagtggggaggggatggggacacagtttcagttttgcaagatgaaaagagtcctggagatagatgatggggatggctgcacaacactgtgaatgtatttaacactactaactgtacacttaaaatggttaaaatagtttattttattttattttattttattttgagatggagtctagctctgttgcccaggctgggggcaatggcatgatctcggcttactgcaacctctgcctcccaggttcaagcaattctcctgcttcagcctcccaagtagctgggattacaggtgcccatgaccacgcccggctaatttttttgtatttttagtagagacagggtttcaccatgttgaccaggctggttttgaactcctgacctcaagtgacctgctggcctcggcctcccaaagtgctaagattacaggcgtgagccaccacgcccagccaaaatggtaaattttattatatgtgtttttcaccataacttttataaaaaacctaaggagaaatgttgaaactaccaaggagaaggtgttattgagaataaactccaacagccgagacctgttggtcctctttggtcaactggagcaggtgagaggggatgccctgacctcaagcctctcctctccaattgtttcaaggtttgcttctgtgaaaaggaaaatggaagtttacttaaaccccggcatgtgttttattttgtcctaattgtgtagccaggcattcactgttctcattagttctgccaagtcagcaccagaggctggcgaggtggccgtggagatgaacgagtccttccagatggcagagagcggtgtgaggctgaggcttgtcatagtgatatgcaatgcccctgaactctgaagctgagaacttcctttgggaagctgggtgaccatctgcgaacacttccaccccaaacatcatcatcagtggttttacgatgatgtttgagttcctagtgtagcagttaaattttacagcaaaagctataatgctcctttatactttgttaaattatctttggacaaagagttatgggagaaggtgaagaatgaagaattcctttctgaaacacaataaaaagagtggatcaatgtttttcggtagctcctggggccgtcttcccctgacaatgtttctcaacgctgaaacacacacatggtcttgcagagccagcctctgagcgaggaaaagcttggcacccccatgtcctgagtgggctcaagttcaggtttccaaggccatggtgcccaagctacaggcagccaaagtttcagatgttaccatagctaattgtaatttactcagcttcatcctcacaaagctgaggacattaacactgtagttagcaccattttccagcaggggaactggggtttagacacagagttaggttttgctcaaggtcatgcagcaagtaaacgtgaaaaatgaggtttgaacccaggcaatctgggtttagaggctgaagactttactacatgcagcttgggctctggtggcagagatgtcaacgccatcagaacaatacagaactcatgaaagctccagttccagataggatgttgaggacaccacaatgtcagaaggtgtcacactggttttgtttttaaatcaagaaggtgctaaaaggaggcaatcagataataggagaaaaaaagtcactactgggttggggcacatgcatgagcctgcagggacaggaaggagggagggtaaggtatctccaccagaccctcaactcaccctctccctcctcctgggttcaagtgattctcctgcctcagcctcccaagtagctgggattacaggcgcccaccactacgcccagctaagttttgtatttttagtagagacggtttcatcatgttggttggtcaggctggtcttgaactcctgacctcaggtgatccacctgcctcggcctcccaaagtgctgggattataggcgtgagccaccgcaccaggcttccagtcccttcttttggcctctagttataaaggtaattgtaaccatgaaatatccaggatataagttccctttgcccactggtactttcgacttggtttatccacgttttcgtgcactctgtgtcttcttagtctatatcctatgatagttattctacgattcacacaatatccattctctcatttcttacgaccaaatttaacttcaaccttttctaactttgtgataccagaaaatcaaaatgatttatctctttccttctgtctcccaataacgcgcacacatgcacgtgcgcacacacacacacacacgtacaatatagtttctagaaaatgttcatctagctcggttttctggcccttaaccgaatgtgtgagtagtgtaaggatgcattttcttgatcctgtgctatgtttaaagcaatatgtctccatctgatcagggttatgtctctctacaaatgctggatttatgtaaatgccactctgtctccaaccagtacagcacatgatttagctgtcgttcagtgatgttattttggagaactgcatgagctctaactacagaatttaagaaattctatattaaaggagaagaaccagcatcagtgctggcttttacaaaactatttatttcaaaataattggagacccacagggacttgtaaaaataagaaatagagtttgttgagccctccctcaccttacttcctccagtggtgacatcttttataactctattgcaacatgagagccaaggaccaagaaattaacactgctacattacactgcaaccttactcagttttcacttatttttaccctgcattaatttgtgtgtgtgtgtgtgtgtgtgtgtgtgtgtgtgtgtatagttttatgcaattttaccctatgtgtagatttatgtaatgtcaggatcaggatacggaaccattctatcatctctggggaactatctcatacccatcctatccaggctcacccatccacccacccgtccctaacagcaaccactaacctgttctctatctctatagttttgtcattttgaggatgttttgaaatgaacttgtacaatattttttaaaaaaaccatttcaaattggctgtttttactaagtaaaatgaatgcccttaatatccatccaagctactgcatgcatcaatagttttcattgctgagtaatattttcttttatggatgaaccagtttgttcaactcttcaccctttgaaggacatttgggttgtttccactgtttggttattatgaataaaatcgctgtgagtgtacaagtttgtgtgtgaatataactttccatttcactactgggttgtattgttagtacatgcctagtttgttgttctctttttgagatgaagtctggctctgtcgctcaggctggagtgcagtggcaccatctcggctcactgcaacctccgcctcccaggctcaagtagttctcctgcctcagcctcccgagtagctaagactacatgtacttgccaccacacctggctaatttttgtatttttagtggagacagggtttcaccatgtcggccaggctggtcttgaactctgacctcaagtgatccacccacctcagcctcccaaagtgctgggattacaggcatgagcctccacacctggttgtacatgcctagtttttaaagaaacttattttccagagtggttataccattttcacacttccactagctatgtgtgagaattccagtttctcaacatccttgccaagatttcatgttatgcctatttttatattttagctatttaaaaaacaatttttttcttttcttttttattttattttttgctctgtgcccaggctggagtgcagtggcatgatctccactcactgcaacctccgcctccctcgttcaagtgattctcctgcctcagcctcctaagtagctggaattacaggcatgtgccaccacacttggctaatttttttgtattttagtagagacagggtttcgccatgttggccaggctggtcttgaactcgtgacctatatgatcaacccacctcggcctcccaaacttagaatggtttcttcatgttgttgctagtacataaaaatacaattgatttttctgtgttgatcttgtatcttcaaactttgctatactcacttagctctaggagttttcctagatttctgatagggtttggctgtgtccccacccaaatctcaccttgaattgtaataatcccgacatgtcaaaggcagggccaagtggagacaattgaatcatgggggcggtttcccccatactgttcttgtggtagtgaataagtctcatgagatttgacggttttataaatgggagctcccctgcacaagctctcttgcctgcctccatgtaggatgtgactttgctcatttgccttctgccacaattgcgaggcctcccagccatgtggaactgtgagttcattaaacctctttccattataaattacccaatcttgagtatgtctttattagcagcaggagaacagactaatacagtatcttacttagcattttttacctaatcaggtcatctgaaaatatggacagttttatttcttcctttttgagctgtatgctttttattttcttttcttgccttattttactgactgaaaacttgacaggacacatccttatcttgttccatatcttacaagaaaaacgtgagctttcaccattgagatgatgtcaactgtaggattttctgtagatgatcttactcaagtttaggaggttccccttcatacctagtttgctgagggtttttatcataaaatgataaagacaaataaaacaaatacaataaaaaaacaaataaaaataaactgtctttattgttgccagtcttgagataattttgtcatttttactgatattttcaaagagccagctttttctttgatttctgctcttctctttgttattttttccttcttttcctggtttcctggggtgggtgcttaatttttgaccttaggatctttcttctttcctaatataagcatttggtgctgtaaatttccctctgtgcagtgctttagctgcatgtcacaaatttcgatgtgatgtgttttcgtttcatgcagctatgggcacttttatttttctaactgactttttaagccattttaaagtatacaattcagtggtattagtgcattcaaaatgtcatgttaggccaggcgtggtggctcacgcctgtaatcccagcactttgggaggccgaggtgggtggatcacgaggtcaagacatcaagaccatcctgggcaacatggtgaaacttcgtctctactaaaaatacaaaaattagccagccatggtggtgcatgcctgtagtcccagctactcgggaggctgaggcaggagaattgcttgaacctgagaggcggaggttgcagtgagccaagatctcaccactgcactccagcctggtgacagagcaagactccatctaaaaaaaaaaaaaaaaaaaagtcatgttaccattaccagtatccatctccagaatttttttcattatctcaaactgaaactctatccattaaatggtaagtccttattccccgttttgctagttcctggtaacctctattctactgtctgtctatacatttgccagtcctaggtgcttcatacaagtgaaatcatacactttgcctttttgagtctggcttatttcactttgcacatgttttcaaggttcatcacatgtggtagcatatgtcaaaatttccttcttttttaagactggataataattcagttcatcgtatgtatgtgccatatttcatttattcatccatccattggtgggctcttgggttcttttcacctattgtgaataatgctgctgtgaacagcaatgaacaactacctatatttctgctttccattccgtgtaagtatatacccagaagttagatgactggattgtaaggtaattctatgtttaactttttgcacaactcaaactgttttccacagtgactgcatcattttacattcctaccagcagtgcacaagggttaaatttcttcacatcctcaccaacacttgtcattttcaatttgggaggataataagtcatcctaatgggtatgaagtaatattacattttgatctgcatttctctagtaataatgtttaacatctttgatgtgtttattggccatttgtacagctcctttggagaaatgtctattcatgtcctttgcccatttttaaattgagttgcttgtggtttgttactattgttgttgagttgtaggagttctttatatattcaggaaattattctatgtgatcttactctctttacatttgtgaaggtttgttttttatgatccaggttttcatctatcttaaatgttccacggtgcttgaaaagaatgtatactatgctgttgtcacttagaatattctatcgatgtccattagatcatgttgattgatggtgatgttcagttcatctgtatctttgctgattttctatctaatatttctatcaattgctgacagaggggaattcaagtacccaaccataattggggaatcgtctagttcttttttcagttctgtttttacttcatgcattttgatgttctgtcctttggtgtttggtacatgcacatttaagatcactgtgtgtttttggatggttgcatctttatttatttatttaagacagatcctcactctgtcatccaggctggagtgcagtggcaccatcttgactcactgcaacctctacctcctgggtttgagtgattctcctgcctcagcctcccaagtagctgggattacaagtgggcgccaacacacccggctaatttttgtaattttagtagagacagcatttcaccgtgttggccaggctggtcttgaactcctgacctcaagtgctctacccgcctcggcctcccagagtgctgggattagatgtgtaatccactatgcccggccaggttgcatctttttatcattatgtaatgtccctggtaattttctcttggaagtctactatatctgttatgaagccactccagttggcatggcatatcttttccatccttttatattcaatctacttatgtcattatagtgagtttcttaggtgcatcacatagatgggtcattttttaatccattcttccaatctctgtttttcagttcgtcactaattatattttacagagatcatttatattaaaaataattattaatcgattagggctcaagtctaccattttattattgatctcctgtgtgttgtctccagttcttgttcctttgtgtacctcttcttgatttcttgtggattacctgaatgttatttagaatttcattttgatttgttcataatgttttttattcatttgaataattttcttagtgtttgctctaggtataccaaaatatatgaagcatatcgcagtctactagtattgacatttaccatagtcaagtgtagaaactttacttccctttatttccctttgccctctccaatttttaaatatcgttttaagtacttctatatacactgagtaccataccagatggcattataatgtttgttttaaccatcaaatataattgcataaggagaaggatagtctattacgtttgccctttttacttattctattgtttttttctttcattctgtatttcctttcctctttctgtcatctccatctgctatcacttgcattttgtttctttagctgttctttaaaagtagatttggctgggcatggtggctcatgcctgtaatcccagcacttcaggaggccaaagcaggtggatcacttggggccaggaattcgagaccagcctggccaacatggtgaaaccccatctctactaaaaatacaaaaattggcggggcatggtagtgcacacctgtaatcccagctactcgggaggctgaggcagcagaacgcttgaacccaggaggcggagggtgcagtgagccgagagcatgccaccgcactccggcccgggtgacacaatgagaccctgtctcaaaaattaaaataaataaataaataaaatttttaaaaagagtaaatctgatggcaacaaattctattcctttgtctgcgaatgtctttatccttcagaaataaatggtactttcactagttttaggacatagggtttataattctttatttttcagcccttgaaaaatgctgggctacttcctcctggtctccatggtttcagatgatgaacattctgtcattcaaatcattgttcccctgtaactaattcatcgtttctttctagctgctttcaattgtgttttttggggatttttgtcttcagttttcagaagttttattataatgtatcttgatgtggattcttttggttttattctgtttgagattcacttagctttttgaatctaagtttatgccttgcaccaaagttggggaattttcagccattatttcttctggcgccttttcagcttcacaaattttctcctatcctggaactctgatgacataaacgctagttcttttgtcattgtcctgcaggttatgagactttgttcatttttttcccccaggctattttctctatttatttatttacttagtttttgagacacagtcttgctctgtcacccaggctggagtgcagtggcatgatctcagctcactgctacctccacctcccgggttcaagtgattctcctgcctcagcctcccgagtagttgggattacaggtgctcaccaccacgctaatttttgtatttttagtacagacgggatttcaccatgttggccaggctgatctcgaactcctcacttcaggtgatcccccgcctcggcctctcaaaatggtggcattacaggcataagcctgtattatttagattgagtaaattttatttctctattctcacattcactaattttattctccgtcatctctaagctagtacggagctcattcagcaaactgtttctttcagttcctgtatttttagttctatgattttcatttagttccttttttacatcttctatttctttgctgagactttctatgtttacttgtttcaggagtatttgtaattgcttgttgaaactttttgtgatggcggctttgaaatcttcatcagcaaatttcaactgctgaatcatcttcatgtgtgcttttgtttgtggtctgtggccattcaagttattttctgggttcctggcatgacaagcggtctttgattgtatcttggagactttgggtactatgttagaagactcagggtctgtcttctttaaagtttccattttagcaggcagtttccccgtttagacttaggatgcaagtcccttaggctgcgggtccaatgacgactgagttttcagagcccctgtagtgctactgtagtcaagtttgttagtgtgccacctgcggggcactctgcaatgcgtatgtacatctgcatgtgtgaaactttcacactggtccagttctaatcttttgatgtgttgaactggtcagtttttacctttgggttgatcagctgtctgcgccagaccttctaggcagggcttaaagaatcattttctccagctttttcctatctgagatcctcttccccatgtctagctgggggtggggacagaagtccagactccccactccatctctgtggacaccatgccagtagggaaggaacttgctgccaacagctgccaacaacttgctgccaacagctgccacctggccctggtggatgggagtgggagtccacaccccctccctggcctctgctgatggcaccagcccaggctgcctgctgctgctgggcggggcataggagtctagactctcctttgagacttcactgcagtgctggagttgctaaggtgtgcacttagctggaggtaaagtggatattatcaaaaaggacttccgtcctgtgggctgcccatttccctgtctctgctagataaataaggtttttcttcaagctttattttccatctgtgccttatggtggttctggattgcaggcttctctagcacccagtccagaatatagcaaagataaaaagaaaacccagagtgtcgccaccacctcagtcctcaagtcttgagttctcgaaccaggctgcctgcctctttttacttttccaagggtccttatgattatccattaaattatttccagggtttttagttttacttaacaaaaaggagcagagggaagtgaatctacttgtctaggaccagaaagccagctgcttttttatgctgtcttttattttgtagctagaaactcctggatttttttcctcagaatgttggagtcaatgtttcttttattttcaaatacagaaatgtcttataacctgtttactaaaatgataaagaatcaggttaacagaggccaggcacggtggctcatgcctgtaatcccaacactttgggaagctgaggcaggtggatcacctcacatcaggagttcaagaccagcctggtcaacatggcaaaactctgtttctactaaaaaaaatgcaaaaattagctaggcatggtggtaggcacctgtaatcccagctactcacaaggctgaagcagggagaattgcttcaacccaggaggcagaggttgcagtgagccgagatcccaccactgcactccagcctgggcaggtcccaagagcaagccgcaaaggtccctggcaagtctcagcccgtggctggatcctccctctgctgcctctacctgttggttttacatcaggtttcccacctggtttcttcctggaagcccagtcttgcagggggtacaggtgattttggacggtaatgcagagagaccagccactctccactgtgagacaagttgcatgaggatgaggcttcagaggtctggcctgaccttgattcaggtgcgatgtcaggaaggaaacaaacgttggcattaggattgcatccagcatgaatgaattgtgattgctgaatgagtaaacttttagttggaggaacatttccactccaaactcccgtgggagtaagttcttcagaaactgccttcagtgtgccccaggattctgtgaaagtgcagagactggcaccaccaactgtcagccttctccagggcaggatgacaacatgtgtcaggtcccactgaattgcccaaaaggctgaataagcacatgtaccagctttccaaggtccccgaggcttcagggagagggaggggttggaggaaatattgattccaacttttgaaagaaaagaaaatcaacattaacatccatagatctataagatgtattttatgtcaaataatccattgtaattcaatttacatgtaggaatataaaattgcatttgatgttggggggggcgggcattgaaatgtatttggtatgacatggagtggagccttcagtgtttttaaaagggcccagctgaaccaggaaaggagggacaaaaatagaagggtggggagggaaaagatcagcttcaatcagttcatgcacaattttgcaatcagaaatgtcagaaggaaactattttagtgtccacacacttaagttttgtgaaatggggtgagggggccgggcacggtggctcacgcctgtaatcccagcactttgggaggccgatgtgggaggatcacctgagctcgggagttcaacaccagcctggccaaaatggtgaaactgtctctactaaaaatacaagaattcactgggcgtggtgacgggtgcctgtaatcccagctactcgggaggctgaggcgagagaatcgcttgaacccgggaggcgaaggttgcagtgagtcgagatcgtgcctctgcactccagcctgggtggagacttcatctcaaaaaaaagaaaaagaaaaaacggggtgggggtttcatgaggggctcactgctcggggtcttacctgggttctgccagtggtggggctgttactttccactggcagccacaccaagctggccacacctggcacctctggtgtggtggctggggatgccctggagacgaggtcttcagatgccccttcatgtgcaccagatgccaagtgcctgctgtaggggagggtggcggagaccctaaggttcggtgtgcaggaggattagccggtttgccagacaagcttagagcatgtctttaccccacttgccctgtggggtaagggtaagaactgtcaccctttggtgctggctcctgtgccaggaccccctcccaggacaagtgcacacgatcccctcccagcagagcttggatatagccctgcaacttgcagtaggctccgcccacctcttccctacaacccccactcctgtttggggctgtaaaagtagaaaaaaactcccataaaacccaaaatgctttttctactctcaccccacaaaaatcaacacagaagacttctatggccaaatgtgcagggatttctccccaaaaataaacaagcaatcggttctgcagtggacaccagctgggtatcccccaattcagttccaatactgtctacctggagagagtatcagatcccagagggtgagggctctgtgcccaagactaccccccttcccagccccgctagataccagcaacaagtccggggcctccagaactcctgcctgactggcttcaagttggggtccccatggctcctcttttggtttgattaatttgctggagcagctcacataactcaggggaacacttaacttacctttagtggctgatcacaaaggacacaaatgaagagatgcacagggtgaggcatggaagagggagcacgaagcttctacgccctccccagggaccaccctccaagaagctccccgtgttcagccatccaaaagctcctgccatccagcctcccgagtagctgggactacaggcgcctgccaccacacccggctattctttgtatttttagtagagacggggtttcaccgtgttagccaggatggtctcaatctcctgacctcatgatctgcccgcctcggcctcccaaagtgctggtattacaggcatgagccaccgcacccggcctccttagggtttttatggaagcttcatgactgattaaaccactggccattggtgatcaactcaacctccacgttggggggttgggctgaaagtcctaaccctctaatcctgcctaggtgttgctcgtaaccagccccaaccttcctaggtgctgccagccagcagtcagttcattcatgtgcaaaaagacatcactgtgtagttgctaaggatttcaagagtcatgtgccaggaaacggggttcacaatatcacaggggccatgctgggtctcccatgagcctgagacacccagcctcgtccatagtgtgctcaggagtcctgcactgtagggcgggatgtgcaccccgtgcatgggacaggggacacagaggacacagaggagctcggaagtgtggcaggactaggccacgatgacccattctcctgccaaggaatagcgagagaaggctccccagggtgcagccacagcacacctagggggtccacggaaacagaccccgtgtaggcctctccctgtgagttcaggtcatctgagactgatcattcaagccccagccatgcgctgttgatgatgtgagaccacagcttatccaggaatcaaaacagaggtgtctgctccagccacctgtgatttatgggctttaattgcagacctgctcctgtcttataaaatcaggatggagcctccactgctgaggcaaggaaaagatttgtctaaaatattggctgctgtcgtcgatactgggacctcttgagccaggtcccttccacattctgatgaggtaaggctgctctggaagaaaaagccctccagaacataaatctatttgacaacaaatgtctccttctcatggcgagccaaatccccctgtgcaggagccagagatacagacacagaaaaagaggagctggttcagtcttcaaggacagaaagaaagagaaactctgcctggtgctaaagcaggccctctttgcagctcattccaagcctaaaccagctcctgcaactctcaccaaagctgtagctcttcacggggatggaaaagcaatctcgtcgcgtgtggccattgggatgattttctcctcccctcatgcctgctgtggacgaggggcgtttcctcacgtcgcaactgttgctttggccaatggaacgttagcagttgaggtgtgggcaaagtcctggaatgtgcttgtgcgtacagttggctcagctcctgggctctggcccttcaccatgagaacacgtccaggtgctgctgatcaaaggaggaggaacccgtggggcacatcagaggccgccctgcagcttagagcccagtgcagctgagcccagtggcctgcacagctgtgcatgaagaatgaacattggttgctacaagccactgaaattgtgaagttgtctgctacacagcaatattatgccagtagtccatcaccacatccaggactttagagaagcaagaccctgatacgacgctcctgccaccatctcagaattatctgaaaaacaaccctgacaccaacataattttttctctctcacaaattcaaattatattattccctcagtctgtgagtcaggggttattttatttttaaagtttgctgcctcctcagtatatgtaatttgaccctaattttgtaagacatgaatatagctaaatatattccagagatgagactgaaatgctcaagatggtgacagcagtatttctgggttgagagatttagagtgacttatgttccaccaaaaacatttctatatttgttcacattttctataatgtcattattttatgatcaactatatatacttgatttttgaacagataaagcttaacataaacatggtttaaacataaagtttactccccagaaactttgttcagaatgtcaaaaacacaggacaggaagataagtaaatcctcatacagcagagtcactgttcaccctgggaagggaggtaactgccagaaacccaaacaaagggatcctcagatgctgttggcctcttctgcttaggaactgatgtcagaaaatatttgtccttgagaaagccagcccctgattaaatgttactatgctctgatacaatgtcagtaaatcatttccaaaaccccaaacactgaaatagtagggggtggcaatgaccacttgggtgatttctcacctgggaggacatcataaaggtaaagatgagcactggggtacaaatgtgcttgcaatggggacatatgcagtgagcagagagtggggcacacacctccctagactcatttctcagaaacacatcaggtcacccactttctctccaaaagcagaagtcagattgagctcatgttcccttgtccatgaataactggatgtgtgaggttatgacagatttagaacctgccaaaatcagagtgagtgagagagtgagtgtccttcctgggctagaacatactctacttctctgaagttgaacaagatggaaatttcataacctcaagggacagagagaacactgcccactgcagatggtaatattcaggggcatcctccagggttcctcaggtgggcagaaccagaatgggtcatgggatgagagatctattacgggaacgagaccttgccagttgcaggaggagctagagaagagaaggtatgagagggaagtgtgcagagcggaggagtcaccaactagctggtctgagaaatcaagctcgtcgcactgccaacgctggtccatgaaagcagaggagacatctacagcaagctatttcttcagccaagcacctgaagatggtcggagttattgttggccaggaggatgccccacagtgaagaagaccaaatggacatggagtacaaggacacgcaggaggctgtggcacctccaagtgtgtctgtcactgcacctaactgcgttgaccttcagagggtaatggctgctgcctgctgatcagaattggctcagtcctttctgcaaggaaggaaggggaaagggaaatcaaaaggaatctggccttgtcagtttctatggcgaggctctgccagcaaaaaacagtggctatgggccaggcagcccagagtgcctgctgcagggccagctcttccagctaagggcttctccacctcggcactgctgatgtttccagcccagtgatccttggtggtgggggtttatcctgaacaccactggtctctatccacaggattccaagggcatagtccctgcaagtcataaccaaaaccatctccagacattgccaaatgtccccagagtggtggcagacaaaaccctgccagctgagaaccactgttttaccttctgcatctcagagtgctgaatcaaggtttaagaacataatgaagcttattcagtcacattgtgctcactaaaaacattgttttaaaaagttttagtgagaatagaaaggatttctgtgcaattaataaaaaacaaagggctgggtgtggtggttcacacctgtaatcccagcagtttaggaggctgaagcaggaggatcccttcaggccaggagtttgagactagcctaggtaacatagcaagaccccatctctacaaaagtttaaaaattagccgggcgtggctgttgcctagcaagtaaataaatccagtgttctatttttctatcactgtggcattcattgcctttcctttaacaattctggagattccactaagattgccttgtcgattctccttgtctggagcagtggacagcccaatctgaggagtgtgagccctcagctcaaagggctgagcccacggtcaggggctctgctgctttttgtggtgagtcactcaacagcaataatgcctttcttgtttgtggagttataacctgaatcctggtcagcagtttccaatgcatgactcagtgtgagactttgttgggatgctaaagtgatttgttgagttttcaaccttgatttgtaacttatctattaactctcttttgaaagaaatctttgtcgtggaggagtaaataagctactgagcatctgcagagtcccacggctctctaaatttctgcctattccatttatagtctgcacttcttgttcaaatgcatgttgggtcgtggagaccaatgctgtccagaaaaaaactggccgagtcttgactcaatctgaaagtctctctgttacacaaaattgtcatttgccatacttatcataattatctgtcggtttgtctctctgtttcttgtcctaaaagttctgccgaaagtttgtgattgaagcatttatgcaaaagtcagacgtaacaattaaaatggtaaattttatgttacatatattttatcacaataaaaaataagtcaaatgctggctgtacaaactaaaagtaaagagtgagacatagacttacgggaggcagctagagcagttcttacagataaatttataattgtaaatacttataataacaaagaaaaaagatctcaaatcaacaacttaaccttccacagtaagacactgtgaaagaacagcaagctaaacccaaagcaagcataagaaaggaaataagaagaattagagaggaatttaatgaaataacaattagaaaaacaatagagaaaatcaacaaaatcaaaagttggtttttgtttgctttttttttttttttttgagacgaagtctcactcttgtcacccaggctggagtgcaatggcataatctcggctcactgcaacctctacctcccaggttcaagcgattctcctgcctcagcctcctgagtagctgggattacaggtgcgcaccaccacgcccagctaatttttgtatttttagtagagatggggtttcaccacgttggccaggctggtcatgaactcctgacgtcaggcagtctgcccgccttggcctcccaaagtgctgtgattacaggtgtgagccaccacgcccagccagaagttggttcttgtaaaagatcaacaaagttggccaacctttacctaggctgactgacagaaaagagagagaaatcaaattactaaaatcagaaatgaatgagaagccattgccaccaacttacagaaataaaaaagaattgtgaggaaatactatggacatctgtatgccaacaaattagatgacttaggtgaaatggacaaattcctagaaagacacaaactccaaaactgattctagggaaacatagaagatataaatagtcatagaaaagagattgaattagtaataaaagaaaaaatctaggccaggtacagtggtataagcttgtaatcccagcactttggaaggctgaggtgggtggatggtctgagctcagaagtttgagactagcctgggcaacatggtgaaaccccatctctacaaatacaaaaaataaaaattagccaggttcagtggtgtgtgcctgtagacccagctactctgggagatggaggtggaaagattgcttgagcccaggaggtcaaggctgcagtgagactgcactccagtctgggcaacagagtgagggcctgtctcaaacaaaacaaaacaaaacaaaacaaaaaaaccaaaaagaaaagaaaagaaaaaagattcccacaaagaaaagcacagcactgaggaattctaccaaacatttactaaagaattatactgatctttcacaaaatcttccaaaaaatacaacagaagccaacactttccaactcttcctatgagcctgataatagcccaataccaaaaacaaagatatcacaagaagagaaaactacagaccagtatctcttatgagtacagatgcaaaaattctgaacaaattactaccaaattgaatccagcaatgtgtaaaaaggatttacaccataatcaagtgggatttatcccaggaatggaaagttggcttaatatctaacaatagattattttaatacaccatgcctttacaataaaggaaaaaacacacaacaatcttaatagatgcaaaaaagcacttggtaaaatttaatactctttcataatttaaaaaagtcacttttaaaaactagcaatagaagttcctaagcctgataaaaagcatctatgaaaaacttacagctaatatcatacttagtagagagactgcctacttttcccctaagatcaagatgtctgttcttgccacctctactcaatattataccggaagttctagccagcgaaattaggcaagaaaatgaaacaaaagtcatcaaaattggaaaggaaaaaataaaaccatcactatttgtagattatctaatcctgtctttacaaaatcctaaggggtctaagaaaaaaattaatattagaactaataaatgagttcagccaagtttcaggatacaagatcaatatcaaaaaatcagttgtatttctatacattagcatgcacaatcaaaaaatgaaagtagaaaaacaggctgggcacggtggctcacgcctgtaatcccagcactttgcaaggctaaggtgggcagatcacttgaggtcaggagttccacatcagcctggccaacatggtgaaaccctgtctctaaaaaaagcacaaaaattagccgggcatggtggtgcgcacctgtagtcccagctactcagaaggctgaggcacaagaatctcttgaacacgggaggcagaggttggagtgagccaagattgcgccactgcactccaccctgggcaacagagtaagactctgtctcaaaaaaaaaaaaaaaaagaaagaaattagaaaaacaaattcatttacgagatcattaaaaggaataaaatacctaggagtaaatttgacaaaagaagtgcataacttatgctctgaataccacaaaatgttgttgaaagagattaaagaaactctaaatatatgcaaaaacatatcccatgttcatgtattcaaagacttaataatgttaacatggcaatattacccaaattgatctacaaaattaaagcaattcctatcaaaatcccagctgacttatttgcaaaaattgacaagctgattctaaaattcatataggaactcatggacccaaaatagtaaaaaagaaaacattttggaaaagaagaacaaatctgtagcacttaaaattcccaatttcataacttaatgcaaagttaacaataatcaagacagcgtggtattggcataaggatagatatatagatcagtggaatagaattaagaatctagaaatgaacctgtgcatctctatattcaactgattttcattaatggtgccaaaaccattcaataggggggagagaataatcttttcaactgggtgtggggaataacaattatatatatacatatatatatacacacacacatatatatactgtatatacacatatatacatatatacacatatatatcatatatacatatatacacatatatatcatatgtacatatatacacatatatatactatatactatatatatactatatatatagtgtatatgtatacatacatacatactatatatttttttgagacggtgttttgctctgtccccaggctgaagtgcagtggcacgatctcggctcactgcaacctctgcctcccaggttcaagcgattcttctgcctcagactgccaagtagctgggactgtaggcacacgccacgacacacggctaattttttgtatttttagtagagatgggatttcaccatgctggccaggatgatctcgatctcttgaccttgtgatccacccgccttggcctcccaaagtgcagggattacaggcatgagccatcgcgcctggccaataatattcttttcaacaaatggtgctgggacaactggatgtctacatgcaaaagaattaaattgaacccctacctcattccacatgcaaaactgaaaggcaagtaaaaacgaattaaagacctaaacgtaagagctaaaactacggaattcttagaagaacacatagacttaaatcttcacaaccttggattaagcaacattttcttagagatgacaccaaaagcacaagaagcaaaaccaaaagtagataaattggacttcactaaaactaaaatttctgtatttcaaaggacaacattaaggtagttaaaatacaagcacagaatgggagaaaatatttgcaaattatcctatcaactcaacaataaaaacacaaataacacgactgaaaagtggacaaaggattagaatagatagacatttctcccactatacaaatggaccaataagcacacaaaaagatgttcaacatcattagccaccagggaaatgcaaatctaaaccacatgagacggcacttcacatccaacagaaaatctagactcgaaaatacaagtgataacaagcatcaaaaaagacatgaagaggctgggcacagtggctcacgcctgtaatcccagcactttgggaggcggaagcaggtggatcatgaggtcaggagattgagaccatcctggctaacacggtgaaaccccatctctactgaaaatacaaaaaattagccgggcatggtggtgagcacctgagtcccagctactctggaggctgaggcaggagaatgatgggaacctgggaggcggagcttgcagtgagccaagatggggccactgcactccagcctgggtgacggagcgagactctgtctcaaaaaaaaaaaaaaaaaagaaagaaagaaaaagacttgaaggaattgtaactctcatacactactgatgagaatgtaaattggtacagtcactttggagaacagactggccattcctcaaatggttaccatataccccagtaattccatttgtaggcgtatactgaatataaataaaaacatatgcctgcataaaagcttgtacgtgaatgttcaaagcagcattattcataatatccaaaaagtggaaacaacccaaatgtccaccaactgatgtatgaataaaataaaatgtggtatacattttactggatatcatttgtcaagaagaataaatgaactgatacatgcttcagcaggaatgaaccctggaaacagcatgctaagtgaaggaaactcgttccaaaagaccatatgttctatgattttacttttgtgatgtgtccagaaccggcaggtctttacagatagaaagtagattaccggttgccaagggctgatgggacaatgacaaaggggtgcagagttcctcttgggaaaataaaaacgttctaaaatggattatgtgataaccctatgaatatatactaaaggccatttaattgtgcactttacatgggcagattgccagtatataaatgatatctcaataaagccggttatcgaaaggagtcatatagagacagggaagtaaacgctcaaagggttctgcctgaattcatcatcacagaagtgagtcctggccgggcgcggtggcccacgcctgtaatcctagcactttgggaggccgaggcgggtggattgcctgagctcaggagtttaagaccagcctgggcaacatggtgaaaccccgtctctactaacatacaaaaaattagccaggcatggcagcatgcacctgtagtcccagctactcgggaagctgaggtaggagaattgcttgaaccggggaggtggaggttgcagtgagctgagatcatgccactgccctccagcctgggcaacagagcgagactccaagactccatctccataaaaaaaaaaaaaagaaaaaaaaagaaagaaaagaaaaagaaaagtaaagaagaaaaataaaaaaaagaagtgggtcccaaagttactaacccagtcagaagaaattgggatcagccaggcatggtagctcatgcttgtaatcccataattccagctctttgggaggccaaggcaagaagattgcttgagcccaggaattaaagaccagactgggaaacacggcaaggtgccatctctgaaaaaagagaaataaattgagttcattgggagaccacaaacttaagaggaacaccaaatacacactatagcaggacattatcagagaattcttagaaatggagcatatggaaaagaaaagaaatccatggccctccaatctgcagagctcactccaaaccttaaagccagggatgatgagacgtgagaattctgtttctcagttaacctagaattaagtctaaatggtgaaaaaaaatagatgtagatcctgccaacagcagggactttggaaaaatgtgtccagcatcaaaggaggactcaaaggcaaaagcattttgaaaagaaaaggcaaagcatgcaaggcagtcagacatcaggagcatttacccaccaaatcagaaagcacgaatgttgaaaaccgcagcaatgatgcctccctgcaacctcaccaaagttgccacattacagtagcttgttcatggtggggaaccagtcgtttttctcatgtgattaccttatttatttatttatttatttattttgagacagagtctcgctctgtcacccaggctgcagtgcagtggtgtggtctcggctcactacaagctctgcctcccagggttcacgccattctcctgcctcagcttcccaagtagctgggactacaggtgcccgccaccatacccagctacttttttgtatttttttagtagagacagggtttcaccatgttagccagaatggtctcaatctcctgacctcgtgatccgcccactcagcctcccaaagtgctgggattacaggcgtgagccactgcgcctggccgtgattaccatatttctgaaagacataatacttttgtgggaaatgctcagtattttattgattctgggtactagaataagacatgatttatttcagagtgaaatatgtgaggtttttcctgactgtggcaggtcacactggaagcagggcaaatgtcagatttatgtttttggtcttgtcttgaaagtaaaaggccagttgtagtcaacagagctcttgctggcataattccaaaggccataagagtgcttggctatgtcttctgttctctgattcagaagaaaagaaatcattgattgtgttagctttctattgatgcctaacaaattacctcaaaattagcagcttaaaacagcacccgttgatcacctcaccattctggaggtcagaagtccaggtggcttgactggcttctctgctcaaggtctcacaaagctgatattgaggtgtgggccaggctgggtttttatctgaaggctcgaggaataacccatttcgtgcttactcgggatgccggcacagttccgttccatacagttgtaggactggggagcttgtttcctttctggttgtcagctaggggtgaagagccactgtccttctctacgtgaggccctctgtgtcttcaaaccagtgatggcacttcagttccttcttgtggttgggctctttctccttctgccttctcttctacctgcctcttctcccatcagctggggaaagtcctctacatttaaggactcgtgtaattagattaggctcacacagataatctcacaggttaatctctgaatcttaagttcagctgacttgggaacttaattataactgcaaaatcccttgttggcagtacctagatgaacatttgatggaataaccagggatggaaatcttggggcatggaggcacttttaggacatggcctaccatatctatagacataaagagacacaaaggcctatttctagttgacacaagggccactctgtctatcctgaaccctactgcaataaaacaatcactcactcagagaaatcaatgggttactacagtgggtatttcaaacccacttctctatccattgccttgaccaccatatgaggaccaacagaagacaacattgatttctcctccgtggtttcatgcctctccacccacctggaacaggccctttatataaatgcagctgtcatattaagtgcccacctgcaagaaccacccaatttcacagcatgctatttctacacttgactttcctaaacttgcctagaccatgactcttgaaactgtagataacttactctggctggtacattgcaatttatgagcaaaagctctgttaatggaggacatacaataggaacagagcctaaaaacacacaggtagatcctctcaagtccttgcctaagccactctaatgtcctctgaaagcagaagttattcaaggaataaaaccaattatacattctcaaatcaaaagtgtctcacagaagtctatgtatcgcctttttacaaacctaatggaaagggatgggatgttcatttgttcaagacttaagaaacattcctaaagttatccctaggtttcccgcagtgccccactctaatgctattctatctccagtttcacttacaggcaaatgtactgtaatgtacagtacaggcaaatgtactgtgagagacctttctcagccttctttggcatatctgtaaatatagtcgataggtattttctttatttagaatgactaacagtatacaggtatttgggcagtaatacctcagagacaccttatattccttccagtctttaaatcatgatttaaaggacatactcccaaaagggtacaatttcattcaatatagaagactttgcctcatatatacctctcccggaaaaccctccagaggactcaatccaccttttaaaggagcaagtggctacatatgataaagcctcaaaggaaaaatgaccattttgccaagaggtgggacatgatttaggaggtgacctctccaccaacaggcacactctacccaaaaattggacactcataggatttgggaaacttaagaggtatgaaaagcaatggattcccagtttttccagcgtaacttgactcctccatgaacttaacaaaaacacgcaaccagaaaacttccttgatgaaactgaccttgtcactttgaaatctaaatcacaacaggccccaataccggctccacctgaacatcatcatcatttaccttacgcccatttggcacatttcctttagctgaagcaaaaaggaggtgccatggggtaccaaaaagaggctttagctcaacaacatgggaagtaccagaaaccgctcctgatttaggcacttctctagactcagtggctagggttttcttccttgttatgtgccttaacagtggttgcaaaacggtcagtgcttctgtagatattatccttgtcgcaccattaactccatgggttgcccaggctgttcagtccatactactgacaagcaacagccagcactgctctgcaagcccattagctcaggctggctgctgttgttggtctctcatgttacccaccatgtgtcagtgttatcatctcagtcttgcagtattgcttccaccacctgaagaagagccccaggactatagtacagcaaacatgaagtcgagtatttccaaggaagatctagttgatgttctcctagagaatctgcagcaagtgttgcttttaaatgatcaaggtcaataccattgaagttacgcaatgattacataaaactgtattagggccgggcacagtggctcatgcctgtaatcccagtactttgggaggctgaggcaggcagatcacctgaggtcaggagttcaagaccagcctggccaacatggcgaaaccccatctctactaaaaatacaaaaaattatctgggcgtggtggcatgtgcctgtcatcccagctacttgggaggctgaggcaggagaattgcttgaactagggaggcggaagttgcagtgagccaagactgtgccattgtactccagcctgggcaacaagagcgaaaactctaaaaaaaaaaaacaacaacaaaaaaaactgtactagatgataacctttcacccaaagttgagccatctcaaatagtagaactagtagcccttaccagagctgatgccaaaagggacacatgtacacacacacacacacacacacacacacacacacagctattatgccttggtgttgtatataatttggtgatgctatgggactgaaggaatagctgacctcatcagagaggcctaaaaaaagggagaaaaaagtagatttgttagaagcactgatgctctcaaaagaggcatacaattaaaagttaaggcacatagtacaagccataataaagaaggtgatgggagtgcattggcagatattaaacaaaggaagtgcacttttctccttgttcttaggagttatttatgatgaaggaaatgtaaaaacatgaatagatttttttacatacaatttatttcagacagagtatttagccctagattcaagaaacagaaacactgggccaggcgcgatggctcacacccataatctcagcaccttgagaggctgaggtgggtagatcacctgaggtcaggagtttgagaccagcctggccaacatggtgaaaccctgtctctactaaaaatacaaaaactagccaggcgtggtgatgtgtgcctgtaatcccagctacttggaggctgaggcaggagaatcgactgaacctgggagatggaagttgcagtgagcaagatcgagccactgctctccagcctgagtgacagagcaagactccatctcaacaacaacaaaaaaaaaaaaaaaaaagaaagaaagaaagaaaaaagaaagaaaagaaaatagaaatgctggctaaaatcaggttgttctgtcaatttcagtggtctctaatggagcaaggatggcctcttgcttacaccaaaaatctgaggtagaaattgaccaaaatgcacaacagagcttctaccacggataagagttggtggggacatttccccttggtaactagagatgtgaaaggtatatgcctcatctgtactatcataaccacccccacaaaaaaattgtgatggtgggacacaggtctgagctatatcccagaggacttttaaacacttgaaaatgggctttatccactttcccaagtcacgagattatgcatatgcgctaaaggttgcctgtaaattctctggaggtgagctcttctcaagtagaaaagccactgcaataactaaacttaaaaaaaaaaaaagttagacaatggtttttcccacctgggaagccaatcatactcactaatattaaaggtactcatttactggagcagtcataaagggacttggtgaggtgttactacttcgtcaaaaatctaggccacacgcggtggctcacacctgtgatcccaacactttgggaggctgaggtgggtggatcacctgagatcaggagttcaagaccagcctggacaatatggtgaaaccccatgtctactaaaaatacaaaaattagccaggcgtggtggtacacacctatagtcccagctactcaggaggctgagacaggagaatcacttgaacctgggaggcggaggctgcagtgagccaagatcacgccattgcagtccagcctgggtaacagagtgagactccatctcaaaaaaaacaaaaaacaaaaaaaaaaaattcttgttacccttactcttcagtttccagaaaaggtagaggtacaaatgtaggtacacaacttaaattggtggtgatgtgcgcctatgatcccagctactcgggagcttttcatttttctttcttattgcttcttgctttctgtactgcttctgaggcaggaggattgcttgagaccaggagttcaagagcagcctgagcaacatagcaagaccctgtttccaaaaaaataaaatgaagtacaatacattagccagggatgatatgcacctgtagtcctaactacttgggaggctcaggtgggaggattgcttgagcccaggagtttgagactgcagtcagctatgattgcactactgcatgccagcctgggcaacagatagagacctctgtctctaaaacataaaaataataaaactggttaagttatctgaagctcttaaacatccatggctgagaattttacctctagtggccatcaggtcagcctgttctggaacttacagattgtaaccttatgaattaacaactagaagacccatgcactggtaagttttaccactcgtaattgattggagcttgcttcaggcagacctagctaaatactgtcaaagagaaattcaataatcattcttatcttccatgattgcaaactagattttcaaaaacttcaccttcaaaacctctacactccttcaacctagatattaggtattctggaaaagacaccaattggaaatattctctagagacattctggaaaggatcctaggaaggtgatagcagaagcggcccatctagaatggcagctgccaagatgccagctgcagcagacaggcaggcctgggcctcccattctcagagtgggctgaagccccgccctccctgggtacctctgcagctgccctcccaggcgcaagacccgggcatctctgcagtctgcacccttgggggcctgggaaggccccccatctccacaggctcaggagtctctgctctgctgcctggcctcttcccagctcagcaccctctctgatcttgaagcatggttggggccaagcccaggcactgtcacagcccagctgggtgtatacacactcggggcagcaccgacacaccagctccctaccgcctcagccccctacaggctttgggcacccacgagcatgggaggggaagccaaggaggggctgagggcagcttggtgctggcctgcaggtgccccttagttcaagcagcctgggcaccatggacagcagcaggacgcagacgggttcctgggtggcagggggtgggtccccagtgaagccccaccttctggctggagaagatctgaagcctgggggccaggccgccagtcctgtggattggagggggaactcatggtgctttttcctgggcccgcccatggctgtccatggaacaatcagcatgcacttccccaccctgaggcccataaaagccccaggctcagccagagcaggagagacaatgggacaaccagctgcagagagagccttcccactccagcaatgaactacctgcagagaggagaaacacactccaggtcctcctttctgcaaagagctgtggaaatgacaggacaacctgccagcagagaggggccacccaccccagggccttctcctctctgctgagggctgaacactcgtcaggacaccctggttgcaaaaaggagctacccacagtgggtccctgagctgttctactgctcagtaaagctcctcttcatcttgctcaccctccacttgtctgcatgcctcagtcttcctggttgcagggtaagaactcaaggtgccaaatggcaagtctagaagtgctgtaacacaaacagggctgaaacacgccgcttgctctccacattgcaggtgaagagtgggaaagaagagctgaggccctttagggagcccagacctgggggctccccaagccagggctgtgactccctctttgaggccctgcggttcttggagtctctgagcttccaggcactactgcattccccccagggccagccaaagctgcttgtggtgtgcctcctccagctgcagccttgcagagagctgctgcctgtgctggtacctggaaactgctcctgctacttcaggagccggcccacttgactgtgtgcagcggccggactccacactcacttgctcatgcaccttgccactccacgcctggctcaaccttggcagccgtggatccaggccggtagcatgagccaagtacagcctgccaggctgagtgggaggaataagctgaatagactggatcaaaagtcagacaaaggcaccaccaaccacagaggtttctggccagaaaaataacacccaaaagatcccataagaaaggttcttaataacagacatcagtaaaactgcaagaagtgtatccttggatccatgtatcccctgtgcaaaaagatggacaaagaaattgatttggttgcaagggccaactgggagtccatatcactgggaatctcaaactgcaccttaacacaaaacaaaacaaaacaaaaaactccagatgaagaaaactgtctgaaggttgacagcagctacccaagtactttgcaccacactgattaatacttgaagcagcttccactcaagatcatcagagtaagacccaatgaccaaaaccacaaattttcttttctttcttttttcttcttgtttcttgcttctgtctctaacccttatatcgatttggattcctttttgttgatttaaactggctgacagtacactgatacagtttggctgtgtcccacccaaaatttcattttgagttgtaatccccataatccccacacatcaagggagagaccaggtggaggtaactgaatcatggggcagtttccccaatgctgttctcatcatagtgagtgagatgtcatgagatccgatggtttgataagtgtttggtagttcctcctgcattccttctccttcctgccactttgtgaagaaggtgccttgcttcccctttgccttccgccatgactgtaagtttcctgaggcctccccagccatgctgaactgtgagtcaattaaacctctttcctttataagttacccagccttgggcagttctttacagcagtgtgaaaatggactaatacacacaccaacaatgccttattcatgttttttattcttgtccttaatacacgtggtccagagagagcttacgcttaccagggcattttccatctaagagtgtaaagctccagaaatcggaaagaatctggatttttaaatgcatctctgacttctaatgtgtcccttattactggatatcaagcattccacatttctgctcaagatttccaagcttatgatgctaacatgttctgttcaatcatgtggattgaacatatttcatttatacagatcagtatagctatacttatcttaaataatttataatattgctataattatacttatcttaaatattagacccatccaaggcctaaaatcttgtccaaagtttgaactgagaaactgatcaggttttctctaattgtttttgatgtttctacttaaatttttgtaattgtacactaaattctgtgactaacggtaaaattgttttctcaaactttcgcattcatatcatggaaaatttcatcagacccaaatcaaaactggaaactaaaatttggaccaattaccaaattttgtgccaatactacattgaggaaggcaaacatgtttgtgcggttggagaattcatatatattaaacaattaacattcattgtatactgaaagtagaacatacgctttgacagaaagatttcatataaaagctgtactgaatctggtcagtttttaacttgcagaaagacatgcattaataagaacttacatgaatttttaaattccccatttctatcaagcatgttttacacccatcctacgctctcaatggaatgcaaatctacttggaggaattagagatggtgagatccatatctctatgtaaggtatctttccttatcttgcagtatacaaaattcctattgccatggtaatcatttcaaataaaactatatttgcactctaggctaaaaaaaattagcctgaactttcttgataaagtgttactagacaacagaattgcctttgattatacactagcagagcaaggtgatatttgtgtcctgactaatacctcctgttgcagctggatcaatgagagttccttacataaaattcaaggacaagccaacaggttgtccaagtgggataatgcatacagttgaaatctagtctcatggcttgagtttgacaaaaggaggggtactttgtatctattagttatgctgtttctatctctgtttctattcactgctgttgtcaaatgatttgtaaacagcttctgaaatgctgctgcaccatctcaacaaacatcaaatgatcctgaattgaaaggattctaaagtgatctgaaaaaacacaactgaaaaattagcacctttggtagagcgtgatgatggccccaattcttcatccctccagtagcctcagctttttccatgtgccctttctctttgagacacaggaccacaggactacagctgagagtgtaacaagaaaaactctctggtagcacaaccctaatctatgcacaaggtaaaactagagaattttgaatcttgtggttcacttagagtcaccatagcaacaacagaacccaagcccaactcaaatatcacctatattgactcagctccccacactagcagaagaggatgtgctcccatctctatgtaaaacgccgttcattttagcctttactgtgtaacacaacatgttttgctttcaactaaaaattacaagacacacaagaaagcaacaaaaagcaatccccagtcaaagagagcaatcaagagagccagacttagatatcactggatgttggaactgtcagacaggaaatttaagataactattattaatatgtgaaaggcttgtggaaaaattcacaacatacatgagccaatcatgaatttcaactaaaaaataaaaactatgagaaagaatcaaatggaaatgctagaattaaaaaacaaaaaaacaaaaaacaaaccgggcacagtggcccacacctgtaatcccagcacttgaggaggccaaggggggtggatcacttgaggccaggagtttgacaccacctggccaacatggcaaaactctgtctctagtaaaagtgcaaaaattagctgggtgcagcggtgcatgcctgtaatcccagctactcaggatgctgaggcatgagaatcacttgaatctgggaagcggaggttgcagtgagcgagatcacgccaccgcactccagcccgggtgacaaagcaacactccgtttaaaaaaaaaaaaaaaaaaaaacaactatgtaggccacaggcataacacttttaaagagcagaaagaacaaagctcccacctttgaattctatacccagtgaaaatatcttacaaaaataaagaataaagaatttttcatataaacaaaaattgagagaatgcattaccagaaaatctgtgctatcaatataagaaatgttaacggaattttttttttttttgagacagagtctcactctgtcacccaagctggagtgcagtagcacgatttcagctcactgcaacctccacctcgcagctttaagcaattctcatgtgtcagcctcccgagtagctgggactacagacatccatcaccacagccgggtagtttttcgtatttttaatagacacgaagtttcactaggttgcccaagctggtcttgaactcctgagtgcaggcaatctgcctgcctcagcctcccaaagtgctacaattacaggcgtgggccactgtgcctggccagtaaatttttaaagtagaagaattctgatagcagacagaaacttgggccaacacagcaaatggaaagatgctcaacataatttaccattatttgccagggaagtgcaaattaaaaccacagtgagagtccagtacacacgtattaaaatggctaaaaacctgacaccaccaaatgctcgcaaggacgtggtgcaacagactctctcatatcttatcttgcttgaaagaaagcaaaatggtaaagccactctgaaaaacagttcgtttcttctaaagttaagcatgtacttaccctatgaccctctaatctcactgctaggtattacccaagtgaactgaaaactcatcttcacacaaaaacctgtacacaaacgtttaaagcagctttttatgaccacaaaactccataaatagcccaaatttccctcaccttgtgattatgtgtctgcagttgctgccggccagggtgttcgtggtctcgctgccttcaagaacgaagccgggccttcgtggtgagtgttacagctcttttctttttgagaccgagtctcccgctgttcctcacgccagagggcagtggcgcggtcttggctcactgcaagctccgcctcccccgttccggccattctcctgcctcctcctcctgagcagctgggactacacgcgcccaccaccacgccgcgccagctttttttttttctttttgcatttttagtggctacagggtttcaccgtattagccaggatggtcgcaaatctctcgacctcctgatccacctacctcagcctcccaaagcgcccaccagtgttacagctctcaaagacggcagtgttacagttcttacaaatggcacggacccaaaaagtgagcagtagcagctataaagaagcaaaggacaaagcttccaccacacagaagtggacccctgcgagttgccgctgtcggctgggggggcggggggggggggtggccagcttttattcccttattgtccccacccatattctgtttctgtcctatcagagtgcccttttttcaatcctccccacgattggctacttttagaatcctgctgattggtgcattttacagaacgctgattggtgagttttacagagtgctgattggtgcgttttacagagcgccgattggtgcattttacaatcctcttgtgagacagaaaagttcctgattggtgcattttacaatcctcttgtaagacagaaaagttccccaagtctccactagacccaggaagtccaactggcctcacctctcaattagataaccaaattgtgacatatatgtatgaaatactatctatagtgtgtgtatgtatatatacatatatataatgaaatattactcagcagtaaaaaaggaatgaactacagatacacataacagcatcaatgaatctcaaatgtgctattgtgctattaatacgtgaaagaagtcagattctaaaggccatatgatatggtagaatgggaaaaacgttaaaacaaatcaggagttgccaatgctgatgatatggtttggctgtgttctcacccaaatcttatcttgaattataatttccataatccccacatgtcttgggggggaccaggtggagataattgaatcatggagcagtttcccccatcctgttcttgtgatagtgagtgagttctcatgagatctgatggttttataaggggtttcccccttcactgggcactcatttttttctctcctgccaccttgtgaagaaagacatgtttacttttccttccaccatgattgtaaatttcctgaggccttagcctccctagccttgcagaactgtgagtcaattaaacctctttcctttataaattacccagtctcgagtatgtccttatagcagagggataattgacgaatacaactgggaatttaggaggaggtggttatcaaaaagcggaatgggggaaggtagaatttttaggggtgatagaatcatcgtgtatcttgattgtgtgggtggtgggtgtagtggttacacaactgtataagattcaaatctcatagaattctatactaacaagaattttactgtatataaatcacacttcattaaatataaaacaaatcaataaaaaaaaacaatctactcaatacaacacccaagactgatctgaatgtgatctgaatctgaaagcctgataattctctcatcctttcaggtcaacctttcatctctgaatgaggtaaggacattataaaggactataaaaaaaactttataattatagcaatacttgcctggggtttgatcaaacatgaatattattttgaccagccaaagctgttaaatgactataaactttgagcaatacactagcaaaggtgataaacaaccaagaggtgatcctcacccaacctaacgaaaattctttcccaactaaagagcaatgagactcacttcacacaacatacagatggatgcattctgcccagtccaggctgtgcgctgcaattgttaactggcaaaatcacaatgaacctgtcctttctagcacataaaattcctgatttttttttccctgtggggatccactcaattgaaataaatatagtgcttacattttcagtcagtaggtggtccttatcattcctttaataatacacccagaggctgggcacagtggctcatgcctgtaatcccagcactttggaaggctgaggctggcagatcacgaggtcaggagatcgaggccatcctggctaacacggtgaaaccccgtctctactgaaaatacaaaaaaattagccaggtgtggtggcatgcacctgtaatcccagctactcaggaggctgaggcggaagagttgcttgaatccgggaagcggaggttgcagtgagccgagatcacgccattgccctccagcctaggagacagtgcgagactccatctcaaaaaaataaaaaataataataataataatacacccagaaaaccactatcaccactgtctaggtcatgaaacagaacagactggaaccacagtaataatgcattttcccaaaatattacattcctgcctccctaaaggtaactactatcatacttttaacaccatagactagttttgcctattttgtagcattgtgtaaattgaaccatatagtataaataattttatgcctcaaccttatgcttatgggagttgtccatattacagcatgtgtaagtagctgttcatttttattaccgtatgatattccattgcacgaatatgccactatattttttttttttgagacagagtcttgctctttcacccaggctggagtgcagtggtgctatatgtcagctcactgcaacctccgcctcccaggttcaagcaattcttgtgcctcggcctcccgagtagctgggattacaggtgtgcaccaccacacctggctaattttttttgtatttttagtagagacaaggtttcaccatgttgcccaggctggtctcgaactactgagctcaagcaatccgcctgccttggcttcccaaagtgctaggatttcaggcgtgagccaccacacccagccaccactatgtttatgtacctgctatcagtgaacatttaaattgtttttggcttgagctattataaataatatgcaaggataaataaatgcaaggatctttccattacactatggttcaaatgtgccccctccaaaattcaagtattgccaatgtgatagtattaagagatgggacttttaaaatgtgattcaaccatgagggctcctttttctaactgaaattaggtgcccttctagagggacttgatggagggctttgctctctcttgcccttctgctgtccatcctgtgaggacacacacacaaatgccctcagcagatgccagtgacttgatctttgacttcgcagcctccagaactgagagaataatttttttttctttataaattactgagtctcaggtattctctcacagcagcacaaaattgactaagacatgtacctttcagatgtgtatcttttgggtttcgaaccatgtgactatattacctcttcaaaattgaatcaaattaaaattgtaaagtaatgaacaaatccagtgagcatttctttggatttctttctgacaagtagtagtgcaaatacactctgtgtgaaaagtagttttaaagtagcactttattgttatcattggcaattagaatccaataattacagttgacccttgaacaacacaggtttgaactgcgtgggtccacttctatgaggacttttttcaacccaacgaggattgaaaatacagtattcatgggatgtgaaacctgcatacacaaagggccaacttttcttataggtgggttccagaaggccaactgcaagatttaaagatgcacagatttgggtatcctctggcagtcctggaaccaatccccctcagataccaagggacaactctataattattgtaaagcattaatgatatttacatgaattaagagtgtggttgtaattacagcatttttttgctgatttgtaaagaattctccatttaatgaaaattagtaaacaaggccaaagatgttttaactgaaaaaggaaattaaaggttcatttgaaagaatcagacaattgcatcctctgagaagatttttttgtttgtttgttttgttttcttttgagacggactctcactctgttgcccaggttggagtgcaatggcgagatctctgctcactgcaacctctgcctcctgggttcaagtgattgtcctgcctcagcctcccaagtagctgggattacaggtgcacaccaccatgcctggctaatttttgtatttttagtagagatggggtttcagcatgttggccaggctggtcacgaactcctgacctcgtgatctgcccgcctcggcctcccaaagtgctggcattacaggtgtgagccaccacacccggccgagaagatgtaattttatcacataaaattcagataccctcactgtgttttaattcagctggctaatttatctgagattatactttaaaacctgagtataaacaaaaaagaggtatgtaacattaggttgactgttacaattcagtagaatatttaatgagctacacacatacacacacatttacaagcatccaaggctataatacacagaaatcataaaaccaatggctgacagtctccacttcattattactgtttactgtaaggtcattattaaagtagtgtgaaaactgttgcccaatggaataactgttgttttccatttcaatacaaacgtagtcagtgacacacacattaacctttaaaacacccatgttttccatgtccatgtctacctaagacatcagaaaactatttacttaaagaaaatgcgccaggcatggtgtattacgcctgtaatcccaacactttgggaggccgaggcaggcagatcacttgaggccaggagttcgagactagcctgggcaacatggggaaaccccatctctactaaaaatacaaaaattaactgggagtggtggtgggtgcctaaaatccctgctactggggaggctgaagccagaggattgcttgagcccaggaggtggaggttgtggtgagccaatatcgtgcaaccgcattccagcctgggtgatgggagtgaaaccctgtcgcaaaaaaaaaaaaaaaaaaaaaagaaagaaaaaagaaaatgaaataaaatacagctgcataactgaggctcacaaagctactctgccatgggttactacaggaaaatggagattctgggagaagaaatagtatatacatccaaaagttttggttttgctgcagtcttattgtgcctgcttttaaaaaatccgatgtgaagattttccccaaataaaaatattttttataataggataaagttatatcccagcatagtgatattcatgaccatcctcgcccctcctttgtatggtctttgtgtcattcttgacaggtccaccattttagtgcattacaccctgcaacctggctccagacagaagactccctcttcttctcagaagcctgcctgggctgcacagggccacctcgcccagcagtgttcacaactctgtctgctggctctctgctgcccctctccatccatgccacgcacacgagcccataaggactgcctcccgattctttttcttttttttctttttttgagatggagtttctctcgtgttgcccaggctggagtgcaatggcgcaatctctgctcactgcaacctctgcctcctggattcaagcaattctcctgcctccgcctcctgagtagctgggattacaggcatgcaccaccacgcctggctaatttttgtatttttcttagtagagacatgttggtcaggctggtctcaaactcccaacctcaggtgatccgcccgcctcggcctcccaaagtgctgggattgcaggtgtgagccaccgcgcctggccaggactggctcctgattctaacggttgcccggaatcccgtgcccagcccagctgagctctgtacccactagggtacttgatctgctgtaattgctctgggcctcagcctctccatgcagcacacacacacatgcttggtgtgcttcacaaggatatagggagagctttaggagaggcagacttgtcttctaagaatcatttttagtaataaatagcatggtggggtggcgggtgcagtggctcatgcctgtaatcccagcactttgggaggccaaggcgggcggatcacctgaggtcaggagttcgagaccagcctgaccaacatggagaaaccccatctctactaaaaatacaaaactagctggattataaatcatgctgttataaagacacatgcacatgtatgtttattgcagcactattcacaatagcaaagacttggaaccaaccaaaatgcccatcaatgatagactggattaagaaaatgtggcacatatacaccatgaaatactgtgcagccataaaaaagaatgatttcatgtcctttgtagggacatggatgaagctggaaaccatcattctcagcaaaccatcgcaaggacaaaaaaccaaacaccgcatgttctcactcataggtgggaattgaacaatgagaacacttggacacaggaaggggaacatcacaccccgcggcctgttgtgggggagggggaggggggagagatagcattaggagatatacccaatgtaaatgccaagttaatgggtgcagcacaccaacatggcacatgtatacatatgtaacaaacctgcacgttgtgcacatgtaccctaaaacttaaagtataattaaaaaaaatacaaaattagctgcgcatgatggtgtgcgactgtaatcccagctacctgagaggctgaggcaggagaatcacttgaacccaggaggcagaggttgcagtgagccgagatcgcgccattgcactccagcctgggcaacaagagtgaaactccatctcaaaaaaaaaaaaaaaatagcatgggggtatgaagcctcatattttgataataaattgctcccagcatatattacaatctgatgcattcttaaatgtgaattcctttgtgctataaacgttaagtgcctcattttctcaatgctgtgagcttttaattctgcagcatggctctgtgactgtgattgtgagtagggacggctgtgttgatgtgcatgtggtcattccacaccttaaacgtgagaggtgcactctggtctgtggtcaacagctaaattcctctatctctttaaacttcactgcaccaaactggagaacccacagctgctgtttcccaatgggtctgggcagtatttgaggctggtttgcaagccaactataattttctgtagtggaaagagactctttatttttctctctctctttttttttttttttagcgctcctgcgcactgcctgatgttccctccctgggctggatgccgacgctgggagactcggaagccgcgtgtggaagatggcagtgtgggtatggcctgggtgcttgcgtgatggggtggagggagtcattatccccaacacaaacgcgcccactgactcggacccgcattggactgtgggacctgggcagactccctaaaatgtgggttttgtgatagttataacagcctgcattgactggtcctcggccagtctcagggtctttggcaatatttggaactctcttggccctttgtcttttgatacttatctggccaaatttggcctgaatggaccaaacttctgccttttctgtttctgggcaggcactgttgggcactgccagagagaaatctcaaagtcagatgttacactgtctgggatgcagctgcgcccagcaatcctggtgtgtccccaatccaactttctctgccaccttctggagtggctatttcaagtctccggttttctgaagtccttaagtctctctttccacttcaaagagaacattgcagtcatcggttgggaacttgctccaagtgaggagcaactgtgcccaccctcccatcctctcccacacctggggagttcatggctagccctgccctttgggcactggctcccagccagagacctctgcaggggcagtgccccatctcatgccctctctttcctgcaccttcctctctgctagtgcccttcttctgcgtatctggctgtgtaggagaagttctctatcagcagagcctagttcaacagttaaaaaaaaaattcaccataggtttcatgccctgaataccacttacagagcagctgctgggtacttgcaatataggcaaaatgcagatcttgctcaactcttctggtgtctgttaactagccattgcgctcccctagataaaatggctctctctagaggggtgacacagatcattcatggtgggtagcagacatcaatcgctaccacttgttttcttgctggtggtaatggagaccctccagggaacccttacacccctctgaatctcctcgtgggaggaaaactgggttgtgctctgaaatgtcgttaaagtcatatttggagagctgcgctgactctgaggagctggctgagatctctttcttcctgaacagcatgccagctgccatgcaaccattcctcacgcaggcagcacaggggaaagcagggaggccacatcttggactctaacgtaatgattttttttcctgcttctgtggttaaacacatttagaggacctgttttgaaggttcctatgttcctgtctgcgttatgcaaattataggcacgtgtatgttaggaatgcaaggaacttgtttacatcatctttttttttttttttttttgagccagagtctcgctctgtctcccaggccggagtgcagtggtgcgatcttggctcactacaaccttcgcctcccgggttcaaacaattcttgtgcctcagcctcctgagtagctgggattgcaggcacacaccaccacacccagctaattttttgtgtatttttagtagagatggggtttcaccatgttggccaggctggtctcgaactcctgacttcaggtgatcctccagcctctgaacccaaagtgctgggattacaggtgtgagtcaccgcacctggcctacatcgtcttttgtgaaaaaaaaaattatttatacacttgaatgtctaatcagcgtttcaaaggtaacatgcccaaaactaaattctcagtatccctcctccccagccaccttcatcccagcaggggtgtcaccagcagctcaggccaatgatccagcagtcagacttgactccgctcatgctctctcacccatctaacccatcagcaatattactgggtctgctttccaaatccaccctcattacacctccccccactcacccccaccctcgcccagactgccaccatggacagttacagtggccttctaaaggtcatgtctcccccattgtcttctctcccaaattctattttccatagacaagctagactattttgatcatgaaaatctcactgtgctgctccctgcttacaataacctcctctcccttatggaatcaaatctgaagtcctcaccgtgcctgcaccagccctccagcatccctgtttcttgggcctgccaggccagtccccacctcaggacttttgcacttgttatgtcctctgccaagaaagctcttccctgagttatcagttcctggagtggccttccttgacactgtagtttcccagggctgctgtaaccatagactggagggcataaacaatagaaatgtagtctctcacagttccagagccagaaatccaaaatcaaggtgtctgcagggccacgctctctcgctctgaaagctctgagaaagaatctatcttacttatctttctcagcttctggtggttcccataaacctgtgatgctccttagtttatagacgcgtcattccaatctctgcctccattgtcacctagcactcccactatgcctgtgaaccttcccttcttataaagacaccagtcacactggattagggcccactctaattcaccatgacctcatgttaacttgattacttctgtgaagaccctatttccaaataaagtcacattcacaggtgccaggttagggcttcaacatatattttcttttcttttctttcctttttttttttttgaggcagagtctcactccgtctcccaggctggagtgcagtggcgggatcttggctcactgcaagctctgcctcccgggttcatgccattctcctgcctcagcctcccgagtagctgggactacaggcgcccaccaccatgcccggctaatttttttgtatttttaatagagacggggtttcaccatgttagccaggatggtctcaatctcctgacctcatgatctgcccatcttggcctcccaaagttctgggattacaggcgtgagccactgcgcctggcctttttttttttttttttttttgagatagagtttcgttcttgtcacctaggctagagtgcaatggcgtgtggtctcagctcactgcaacctctgcctccaaggttcaagcgattctcctgcctcagcctcccaagtagctgggattacaggcgcctgccaccacgcccagctaatttttgtattttttaagtagagacaaggtttcaccatgttggccaggctggtctcgaactcctgacctcaggtgatccacccacctcggcctcccaaagtgctgggattataggcgggatccactatgcccggctgtcttcaacatatgtttttgggagacacacttcaatgcatgaaaacatcctatatcctatagatgtagagtcgctatttgctctacatcttggcctgttttcttcaccccatgtcattttccactatctgaaactatgccccagaggatagtggcagctgtctaaattagaatctccctacccattctccttaaaactgtacaggtgagcaaggagagaagacacccattgctcctgtctacaccacatctagaaggcagagaaaggaaaaagtgtcttaaaaaagtaataataaggacccagcaagagagcaccctagccaatcaatcgtggaagaaaagggtgtcgttgattaaagaaactgcccttcactctagcaacagaagagggagcagttgatctgcacaaccaacaggccgctcgggcctctaggcctccactgcattgtctgctattgccagtccggggaaacgcaacagaaataaccaccaccaatcacaaagcagaaaaggagaaccatactttccagcagatggcgccacttcggaaaacagtttggtgcgtcctcaaaaaattaaacatataattaccgtgacccggcaattccactcctaggtatacccaaggcaaatgaaaacatgtccacatagacacttgtacatcaatgttcctagcaatattactccttaagagccaaaagatggaaaccactcaaacgcccgtcaactgatgaattggtgaacatgttgtggtatatatcgatacaagagactatttgcggtaaatagggatgcaatactgattgatactacaacatggattaactttgaaaacattgctggggctcggaagctgatgccccgaatttgatgctttgtacatgctgaactgaaaaaggagcttcaaggtctctctcctccctcctgccccaaagcataggcttctctgacattcccttatctgtctaaagtctgggtctatgaaagaaaaacaatcacctccagtcacttccctgagttttcattaactgcacccatatctcagaaaggaaaactaaagtcggtcaacacacctggacagacttttgtcacaaaccattgtctgctctgcaggcccagcagactttaccgcagaccgtggtgtgttcttcaagccctttgaatcttccctagtcatcatttattgcccctccccagaattcctcttctcccgctcccataactacgaccagggaagattcaaagggctaaaaatacaaaaattagctgagcgtggtggcacatgcctgtaatctcagctacttgggaggctgaggcatgagatttgattgaacccgtgagatggagaggttgcagtaagccaagattgcgccgctgaactccagcctgggcaacagagcgagactccatctcaaaaaacaaatcaaaacaaaaacaaaaaacaggtgattgtgtcatgggggctctgcctttgtgaatagattaacccattcatgaactgatggactggtgggttaatggattaatgtgttatcacagagtggaattggtggctttataagaagagaaagagacatgggccagcatgttcagccccctcgccatgtgatgcccggcaccaccttgggactctacagagtccccaccagcaagaagccctcaccagatgcagccattcaaccttggacttcccagcctccagaagtgtaagaaataaatttcatttcttagcaattactcagtttcaaatattctattatatgcaacagaaaatggacagagagagttcttaaggaattccccatcacatccgaggcttatccagaggtgatccttgtctggttccccaggaggctcctggaggaaaggaatggacactgtccaccaccccattcattggatgcagggcccgaagggaggacctgtggagggttttccagcggctcccttaaaaggaacctggagagaggtgattgaattacttcctcagtgcatcttatttgttaatgacatgctcatttcaatgatccatgtcatcccggtccctattaccataaataacgaagcattagctgtacgtggcagtggctgtctggagcagcaaagagccgatcccacggtgtgtctgccctgtcaaaatcatgttggctgtgcttaaaaatgacactccagcctgtccctgcaatccccatgcgttttcatcatgagtcagaacttcaagatgctattcattccgaagccatgtcagctcagctgtcaagcaagtttatcgcatcttgtatttatgataaacttgagtgacatgcagattttgaatatcatattctaaagccattttaatctaggctaaatgcagcctgtcaaattcccctgtaaggcaggatccatggtgggggctggggactgaagggaggtgacagcagtgcggttggcagacaggggagagggaaggtaagcaacagagaaaggtgcctgggttcccaaacagggttccagaggcaagtccactctgcctagaagtaagatggctctggggcaggacgcatgaagggtctcgcccagaacagtggttccagcggtgattcccagggacctatagaaaccctgaagggtggggaagcttgagtcacaagatgtttcaggcctttcgaggactaggtatttgtgaacacaggccagccttggaaattgaatatgctctcgacttacaatgccaccacttaagaggttgttgggctgggggttactcattcagggcactgttgtcccttctgggatgagaaaagccaaattattacacgctgaagcagatgtgtggggcccgaggtttatgccacccgggaactctctttaaagaaaatgaaaacaaaaattgtggtagagaattgctcgggtccctccaaggagcctacacaaagggcctgcagtgaggggtcccagtaccctaggcacagaggaccatgagctgcccagggcctcatgcctggggaaggctaagatgtgaagcatggtgatacaataagaaacatagatttggtccttgtctctgttcctggcacagagggcctaagacctttggaatctctgcagtgagaataatgaatgttttttgtgtactaatgagatgactggtggctgggagcccctgaacagcttcaggatgagggctggtcccagaaagaccaaggcaggattaggaggttggaactttcagccccactccccgcaaacctcctctggggagaggagacaggctggagattgggttaatcaccagtggtcaatgattaatgaatcatacccatgtcatgaaaactccctaaacattcctgaacaacgaagtctggagaacttccaggttggcaaacacagccatgtgctgacagggtggcacaccccgactccatgcggacagaacctcctgggctccggacccttccagacctagccctggctgttcgtctgtgtccatggtaataaactggtaatagtaaataagtgttttcttggtttctatgagctgttctagccaattattgacctgagggaggtggggattgtaagaacctcctgactttgtagccaagtcggacagaagtgtaggttctctgagtacctaagacttgggactggcgtctgcggtgtaggtgatcttgtgggactgagcccttgaacctgttcaatctgacattagttagtgtcagaattgaattgaatcataggacactcagttggtactgagaactggctggtgcgggaaaaaatcccacatttggtgtgagaagtgtttgagtaaaaacagctcaagcccattcttcatttctcagcagggtggcttttgtttgctttgctgttccaacatttcattactcatctgggtcccaatgggcctttattaagaaaagaaaccttttaacataaaaattggctccagatctgagccactcatttcccctgaacctctctggggtccttgtgggctttctgtttggacaggtgatcccagcgattctcccagcttcagaggctgagaggctgtgatccccatcaaaggcagcacatgccacagtgtcccccaaggagcccccgtctgccttgaattccacctacagtggcacagaattggcagtgggcacagctggctgccatggcttccaggggctggaaggagacggtttactgcagggattctttttttgtttgtttgtttgaaacagcatctcactctgtcgcccaggctggagtgcagtggcgccatcttggctcactgcaacctctgcctcctgggttcaaatgattttcatgcctcagcctcccgagtagctgggattacaggcacacaccaccatacccggctaattttttttatttttagtagagaggaggttttgccatgttggccaggctgatctcaaactactggcctcaagtgattcacccgccttggcctcccaaagtgctaggattacaggcatgagccaccgcgcccggtttactacagggattcttatccaagggcctatggatcccacaatggcatgtacaatttttatttttaaggtcttcttttctgaggaaatcagttgtccaattttcaaatgggtccttgactaccctcaaaggttaaaaatgatttccaggtgaaaaataaagaaaaacactgttgcattctctattttttttttctaaaagtcaaatcaagtatgggaaattccagttatccagggtgcctcaaccagggagcttctggctgcttgaacatggagtcaccacacacggtccatgtgtaattgcccaatgggctctccatacccactgcctagacagagccgatttatcaagacaggggaattgcagtcgagagtttaattcacgcagagccggctgcacaggagactggagttttattactactcaaaccagtctccctgaaaacttggggatctgggtttttaaggataatttggtgggttgggggggttggaaaatggggaatgctgattggttgggtagaagataaaattgttgctggaaaggggtcccaatccagacaccaggaaagggttcttggatctcacgcaagaaagaattcagggcaagtccatcaagttggtgactccataggcagggcagtggcatgagctgctcgagggagtatacttagttacttcttgattatatgctaaacaagcggtggattatacacgagttttccaggaaaggggaaggcaattccaggaactgaaggttactccctcttttagaccatagggggtaacttctggacgttgccatggcatttgtgaaccgtaatggtgctggtaggagtgtcttttagcatgctaaacattataattagagtataataagcagtgaggatgaccacagctcattatactctaattattaaaagacgtcgccatcttggttttggtgggttttggccagcttctttaccacatcctgttttatcagcaaggtctttatgacctgtatcttgtactgacctcttacctcatcctgtgactaagaatgcctaacctcctggggatgcagcccagcaggtctcagccttatttcacccagcccctactcaagatggagtcgctgtggttcaaacacctctgacaaaatcacggaaagtcgaagctgtcctcttttgctgaatcagttcctgggtagaggccacaggatcccatgtggtgccagctgatcatcgatcatcatgtgcagggtctacaaatcatctcaagcactgatcttaggccttaccatagtgagtttattctcaggagcaatttgggatggctcagaatcttggagtctccagatgcatgactcctaaaccctaatttctaaccttacagctaatttgttagtcctgcaaaggcagtgtagtccccaggcaagaagggagtttgttttgggaaagggctgttattgtttttgtttcaaagcaaaacaataaaccaagttcctcccaaagttagttcatgcccaggaatgacaaggacagcttgggggttggaagcaagatggagtcagttaggtgagatctctttcactgtcatagttgtctgttataattttgcaaaggcagatctaccatttctctgaaggttgagtttgggatgtggtagcctttgagtacccgtcctgttgctgtgtgtgtgttcagggcaatccaggaaatctggagaaaccagagtgtgtggtcccccttccccatttctctagtggatcaggtaggagggtgactgaggaaatgtgtcctgggatacttcctgcctcccagggtgtgtgggactcagcccttccccagcctgcagaggatgggggggggggggggctttgccagcagtcaagtcctgtgccccaggggaccaggaagcctgtatcaactcctcgctaccccagccagaagcagcaaacgctccaccctgtcctgctgcctgatgggcagagttgttttttttgtttttgtttttgttttcagacacagtctcattctgtcgcccaggctggagtgcagtggcgcaatctcagctcactgcaacatctgccttccaggctcaagcgattctcctgcctcagcctcccgagtagctgggactacaggtgcccgccaccatgcccagctaatttttgtatttttagttgagacggggtttcaccatgttggccaggatgttctcgaacccctgacctcgtgatccgcccgcctcggcctcccaaagtgccgggattacaggcgtgagccaccgcgcccggcttgagcacagacttttaatcagattttttctttctttaaattcctgtgagaccagccgcctgagggattaagaatatcgagggatggaagggagagtaaaagaacgggcacttttccctagggaaaaggaggcatgccgggggggcggagggaaggagggggtgtggaggagggaaggagggaaaagggggagggaggagagggaggagggggcgcggaggaaggggcgggcttccccctgccggcctcccttccttccccgctgcctccgcctctcgcactagcgccccgcacctgtggcgcccctgctccgcccagtcccgcggcctcctcgcccctagtccccggcgctccccgccccttcccgtgggatccgcccctccgccagccccgctggcttcccctctccgccaccccggactcagaacctcccctcccccgccggggcctgggcgcgcctgcccttcgctccccgacctcctgctgcagctctgggcccctcggccgctccctcccctcctcccttgctcaccccacggttggccgcggatctccagcacgccgccccagtcctcggcgtcccgcagcgcctgccagggtcgccgagcctcccctgcctcctggccgcctctgcagtgccgtcctcccggggctggctctctccccaggcccccgctttggccacccaggcactttccgccctgagcgtggcagctgctgccgggggtcctgggaccgcgggatgggaactcccacgcagcgtcccacaggctcctggccgccgcgagcccgcgcgactcgcacgagcatgtccacccgcagcgaggggccggtcactgctacggagcccgccagaaggcaaagccccagacagcaaatagggaggcggctggcacccagggaggccgaggcgggaggatcgctggagcccaggagttcgagacctgccttggcaacatagtaagacgcccccccaccccccgcccaccatctctacaataaatttaagaattagcctggcatagtggcgcgcgcctgtggtcccagcacttcggggaggctgaggtgggaagatcacctgcgcccaggacggtcgaggctgcagtaagccgagatcgcgccactgcactccagcctgggcgacagagcccagaccccgtaacaaagcaaaaatgaaggaggcggcggtttacttctggaataactgcagaagatcatcaagtgcagggagctgtggaactcccgggcgcccagccctcggcgcccctgcaccctcagccgtagagctggggtgttccggcccggagggataggggtttgcagggtgcgtgagcgccgaggctgcccgcgaggcgagagaattgcggggggaggcagggaggccgacggggagggcctgggaggctgcacgcgcagcggggacccggctttgtcccgagcagtttccaggtaagagctgagaggaggggagggagggagaggaggagaaccaggcccggattttcccgcctggggtcaaaccaaagcaaacaaaccaaagtggtgtgtccaaagtgatgcgcctcacaggtgccttgcttctgcccctgccggagttgaggtttggaggaagggcactgtgctgagtcccagcgggggttttgtaaatgctgcggtattggtctctcacggttcacggagcaatcaccacacttgcttgacctcctggaaagccttactctctttttataattaaaaacaattttttttggccgggtgcggtggctcatgcctgtaatcccagcactttgggaggcccaggccggcggatcacctgaggtcgggagtcggagaccagcctgaccgacgtggagaaaccccatctctactaaaaatacaaaattagccgggcgtggtggtgcatgcctgtaatcctagctactcaggaggctgaggcagaagaattgcttgaacccaggaggcggaggttgcaagtgagccaagattgcgccattgcactccagcctgggcaacaagagcgaaactcttgtctcaaaaaaaaaaaagaaaaaatttttttttagcgacaggggtctcactatgtaggccaggctagtctcaaactcctgggctcaagtgttcctccagccttggcctcccaaaatgttgggattacagacatgagtcaccgagcccagccagccttactgttcagaatgatgtcacatctttgtggactgttgaaaataaggttgtcttcctcagtctcctagaagccccaaaatagccatgcagatgtccaagcagttctggtttgattatcaaggagcatgtgtaaaatagctacgtgtgaatggggtctctgcaaatggaaactggcgggggaggctcaggactcttaagaggtctgcaggagaaagtgcataatgaacacacacccatggcctctccccatgtgccagggcatcctcccacacaggccgaaagtgctctgcagaacaaagtgcttttggtccacaaaacgcctcccagctcttgcctgcaaagggaagaaaggatagctgagaatcatgaagcagaatgccgggagatttatggaaaccccctctgatagctcaatctaattgcagctccctccagcgtgccaaatgctgctaatggacagccgctcctgccgctctgatgttgctagacctcctcagcactcagcccaaggcagccaggaagaatgaacgaatggtgattcagagggaaaggaggaagctgcgtggcatttcagagatacttattttaaaactgctggtggccatgtcttcttttcatatcagagctaatgagttttgatatgtgaacatttcttctccttcataggtaatgtgttgatttggcactttaatcttagaataatcatttctaaaaccaacccaactgcttttctttacaattttggccttagcaaacagatgagtccgttgacttgagcattgcttgggcactgtctgtgtgcaggtcaggcaggggatgctggtggctgggaaacatagaggatggaggtgtcttgggtgtacatgaaggggtggggtcaagtccacagggggtcggcccctggcagcagtcctggagggcttcgtggaggaagggagaattgagtgagaaagtggtccccaggtaagagggaagagcatccagggagaggagactgcttctgggaagaccagaggcatcacctcgcaggggctggtatggtggtggctcaggtgggaggaagagagacctcagggaaaataacaggttccattgacaggaggcctgctctggtggggaggcaggctggtggtggagtcatggctgcaggccagggagatgcctgaccaacaggtgtgttggccagggtccctgtagcaaaaacacggagctgaggacctcatggcagggaccccatgcagagggagccgcgggtggcatggggatagtcacctggctctcctgctctcggcctcctgcagctcccctcactccctgccctgccacacaaggtcaaacccaccaggaggcagaaggcgaagggcgaggtcccagggtgaggagcagggaggagatggtggcagcagggaaggtgatgcctgctgcagagtgagacctgggactgccaaacacacagtgacgggagctgaggaggcctgccgggggaggaagacagtggctggcagtgacaggaagggagggtcagcatggggcggcagtcccagagctcagggctccctgccaggccagcctttgtggcctgtggggtggaggtggcaattgctgtcatgtcataaacacgtcaagcttacaatgaaatctccagtgtggcttgggagcaaatacatgtgcaggtgtttgagtatctgtgctcttacctaacctcagggagcaggaaaacgaaagcttatcatgtaaacacatcagcagcagggcttatgtgtgtctccacactggaacccccaagacaagagactggaggcagagttgatttccaagcccagagtgctgggcagcctttgggttttatgtctgcttgcttggagctcagtgatagaaatctaggccccagaagaggaaaggactgtcctgcataaccagcacacccggggaatgcttcaggtgcagctggatccaggcatcctcaaatagtgtgattaggactccactttcctttgtcaccttggcttggctcttccctgctctgtgttgttttcagacgaggtggggccccagcagctctggtcctcctgacatcctagagaagagccagcccttccctcctggggtctacaccgtcccctaagggacctcagactgggctgatggaaggtctcaagcaggccatgtgaagggcactgcacaggaaacacagaaacgggaatcctataaggtcagcagagctctgagccctttgttcttgggcctgtttttatgatcctccctctacatgtagctcacacttccctgcttctgtgcaggcaccaggtgagggggttgtcatggcctcctgccactcttgaggctgtcagatattacctgtgctgtccctgcattctcaagctccaaattgtcaactaagaaatggtcacttaaaaagagaaaagtgaggccgggcacgctggctcatgcctgtaatcccagcactttgggaggccaaggcaggcggatcacctgaggtcaggagttggagaccagcctggccaacatggtgaaaccgtgtctccactaaaaatacaaaaatcatccaggagtggtggcgggcacgtgtaatcccaacttacttgggaggctgaggcaggagaattgcttgaacctaggaggcagaggttgcagtgagtcaagatcataccactgtactccagccatggcgacagagcaagactccgtctcaaaaaaaaaaaaggatttctgaaatggacgaagtttttttccactggcggtgccatcagtgatcgtgtctgttccactgtgaagtcggtcgtgagctctgtgacgtttccctctcaactcaaggcttttttcttccgcttatgggtgtagtccaaatggttgggatgaaaatcgtttcacagataaagaaatctacaagcccaatcgtggtgtaagaaaaaaactttaaaactctgtcgttcagaaggaaatcaggaataagaatttctcctttgagactaaaagaaagtcagctttagccagtgcattggggtgctggctcgatgtggtaaacaaagcaaaacattgtttttaaatatccaaaacattatttttaaatataaagaaatacatttttctcctctcaacaatgaagtcatagtttttttggggggcggggggtgggtgggtgggtgcacaggatttactgttttgtttgtttttttaacccaaagagaaggaaaatactttccttactcctgaaaatggtgagtttgtacattgtccttttatatggatcaatgtcatttaagcaactacagacagataagtgaagatgaatctcatccatcagaggctgggctatcaggcaccaggaccaggggcttttcttttaataagggaaacctctgctatctttggattcctcaaagcctggaatctagagctggatgacaggcttgctttggagagaatttcttgagacaacttcaaagtggcaggttttgttgaagaaaaagctcttcatggggtagttgggaacatggttagtccctctgtggggaccaggaggagcggagaggggaaagggagggagagggagagaacaaactctctgctgtcactctaagagcgccaatcccatcatgggccagaccctcatcgccttatgaagcctgatcacttcccaaaggccccgcctcctggtactatcactcagcagtccccaaccttttttggcaccaggaactggttttgtggaagacaatttttccatggactgggttgcagggatggtttcgggatgattcaagcgcattacatttattgtgcactttattattattacactctaacgtataatgaaataattatacagctcaccataatgtagaatcagtgggagccctgaacttgttttcctgcaactagacggtcccatctggtggtgatggaagacgatgacacccgaagtgtgttgctaatgtccagtctgctctgtaatctcgttttggtcgatgatattgcagaaaactctgcttcacaaacacaggatattggaaatggaagtgggcttttcagtgctttgggaacaatcacaggagattctgccttggctgtaatccagaacgtatggagatttgaagttgtcgcaaacatactttgaaggccaccagatgcagctgtacaattgaagtccatcagctcacttgcctcaataaagcctgccactgcatgcagcttgtcacttgccactcacagatagggttttgatatgactctgcaagcaattgatttatgatggtctctgtgctgtcaaacctctctgctaatgttcatctgtatttgcagccactcccaagtgctagcatcgccgcctcagctccacttcaggtcatcaggcattagttagattctcataaggagtgtgcaacccagattcctcacatgcgcagttcacaatagagtgcgctgctatgagaactaatgccactgctgatctgacaggaggcagagctcaggcggtcatgctcacccacccacctgctgctcccctcctgctgtgcggcccagttactaacagtccatggacaggtactggtccgtggcccagggactgggggccccttctgtcacccaaccaaactgggtccacttgccctcaaggaacggaagccaaacaccgaagcaccaagtttttgcaataggaaggctttattgccagttgagtgacatggagaccggaggaaatgttcctatctgtcttcccactggccttgccaccatagatgtaagagacagattttgagggtggggtttcggggcgggacgaagattggctggaaggaaggggctttgttgagtccctcggtcactcactgtcgccctacctgctgcttcatgggttgcatgtttaaaaacaatgttggcattagcatgacctggaagtggggttttgggccctctgacatcaaaaggtggctcgtgggtgagtcagtgcactctgcagactctagtcagccatgttggctccaactggtccctcctggcagcccacttagttgcaaatagaggggattgtagcaaattgtcgtcttctccactgtcctgcaaaatgagctcaagaaattttgctggttaacaaatcctgtctaatcctagggcaggtttcagtaccatcctgttagggattggggcttcaacatatgaatttggggggtacacttcagcccatggcaagctggatacttgtgctcccttcatcaagatgagaatgtgaacacacagaggcaaagcggcccatacgaggtcacagtgagagagggtgccgtggagtcagaacgcacagcagggacccagcccctaggttccgtctctgagccccaggtcccatgctgagctgcaggagtcactgtgtgcctctgctttgtgctttgtgaccacacgtcatggccaggctggggttttccaccctttgtgcgttattcccatcttagtttgaggtcagaggcctgcaggacttatttcctggtccccacgggatgaaggaggaaacccgtgggaactagcacatggccctaaaagcaacctctccttgccctcattgtccattagcacaagacactcccatcagcaccatgacagtttacaaatgctgtggaagttgctgccttttccttagagatttccaaataacctgcccctaatgtgcatgtcattagaagtcagtataagtggctgtgagtgcagctgcctcagcccatatgctgctgactccgggtgcactgctgaggagtcagccctggcccagttcaggaaaagtggctgcataatgccaccagctggcccttgcattctttcctgggtgaagccaagaaccctcaggggctaagccccactgtgagagctcacctgccacctgcatccagtgaatagggcgccatttccaggtttccccccagtgctgcagcaaacatccctgtaggccgcaactcacacgcttgcttgcatttttttttttttctgtgagataaatcttcagcagcaggattgctgagctgggtctaaaggctttcaaagttttattttcaattttttttttctcaattgtctgtaagagggcagaaccactttactctcttccagtggcagatgagaatgtgcttcttaacacctgcccagccccagggattatccctcattttagtcttggccaatctgagacaatccatgaagggaactgatgactcgctgtcttccagacatttcttcggtggtggtgaagttgagtatgtctttatgcttattggccattgttcttccaggaactgtcagttactgagctctgaccttagatttgtcatcttctaaaaactgatctgcaagagctctttgtatcttaagagaactacttttactattaatgcgtgacaaaatattctccccattgacttgatgtgctatccataagtatagtcatgaaccacataaccacattttggtcaacaacagatcgtatataacagtggtcccataaaattataatatcacatttttactgtaccttttctatgtttacatgcacaaatactcatggctgtgttacagctgcctactgtatccagcacagtgccatgctgtacacgtatgtagcctaggagctgcaggctacaccatatagcctaggtgtgtcggaggctggaccatctaggcttgtgtaagtgccctctgtgatgttctcataacaatgaaatcatctaacaacgcatttcttcgactgtgtccctgttgttaagtgaaacatgactattgctttttgtttaaagtcagtaaagaggcacagtttacactttacttacccatatatatgtatgggtgtatatatgtatgtattttttgcgacagggtcttgctctgtcacccaggctggagtacagtggcatgatcttgggtcactccagcatccacctccctggctcaagcgatccttccacctcagcctcctgagtggatggaaccacaggcgtgcactgccgtgcctactttttaaaaaattttttgtagagacagggtcttgccatgttgcccaggctggtctccaacttctagactcaagcaatctgctcacctcagcttaccaatgtgctgagattacaggcatgagccactgcacctggcctatgtgtatttatttttattgtcatatttatctgtttttttttcatgacttgtgattttgtggcatgtttagaaaggcttttcttgtttcaggattataaaaatagtcacctatactctcctctagcatttttattatttcacttttcagatttaaatttttgtttcatccagaattaattttggtcaaagagttcaatagggctacaatttatttttccctgaagaggcgggacagctgtcccaatataattcactaaagagcccatctttcctctgccaatctgcaatgccaactttactacaatgtctgcaacttaatctcaaatggtagagcaacaaacatatttagagtgtgtgtgtgttgaaattaaatcaaatgtggagaaatgttagcatagcaattattgaatcaagatagtacatttggccttcattacccacgggttctgtatctatctgcccattcaaccaactgcagattgaaaatactctggaaaaaaattttttaaatacaataataaaaaataatgcaaataaaaaccaatataacaactatttcatagcatttacatggtattagatattacaagaaaactagaaatgatttaaagtatataggatggtgcgtggaggttacatgcaaatactgtaccattttatcaaggatttgagtcttttcagattttgttatctttgggggtcccggagccaatcccctacaaatactgcgggacgattgtatgtagaagatcattacaccatccagtttccagttttgttttcacagtaaaattgtgtttaggccaggcgcggtggctgacgcctgtaatcccagcactctgggaggccgaatcacctgaggtcaggagttcgacaacagcctggccaacatggtgaaactccgtctctactaaaaatacaaaaaaaaaaaaaaaattagccggatgtggtggcacatgcctgtagtcccagctacttgggaggctgagacaagagaatcacttgaatccgggaggcggggggttggcagtgagccaagatcgcactgttgcactccagcctgggcaacagagcgagactctgtctctattaaaaaaaaaaatgtgtttaaaagtctaaaagaaaaggagcgttagaatggagatagagtctccactttcaaaatggatggttgagcaaaagttcctttcctgcagaaaaggcctggacgggtgtggccaggacgagctgagacccgatgagaaaggcagaagggcgtcaggcagggcttgcactgcaggaagctgctctggctgtccctgagtagagaagagagttgtgatgtgtggacaacaacaagacaacaagagctgttgggggcctccagctccagcttgaatgactgtttctattgatgtggagcagaaacctgtgggagccgctggcccctgtggacaagggcggtgaatgggccggcgggagcgggcagctgacttatggcgaggtggtgggtctggggtaggctgcggccttagggttggtggtgaccgtgtaccaaggcacacggctggcttccctctcacctgcaatagctgggccacggctcactgcccttcttcctcctgtcacaccagtcacactgagagagggccctgcacgtggtgacagcatgggctgaaccggttccatttgcccaagcaccagggacactcctttacctcctcaggaaggctcagctgtagaggaacagaaggaagatccgaagataataagaaggaggaaaagttggaagaagggcaggagtgcagagtgggccctccagggagggagggggcgagcgagcagccagccctgcccgaatcccccacccacaccctggccccgtcccagcagaactggtgacacttttcttcccagtgcctttcaaatttccagagcagctcagaattgctcagtagataacaggtttggggtttttatccttttcttcctaatgaccaggctcctgagaacaggagcagctgccatctgtagggtattcatcatcctcctgcaacggggaaatgagtcattttagcataaaatgtagaactgccatgaaattcaaattgcagtactttgacaagaattataatgtttgcagaaagtctcatctaggaggctgaagtggtcctgcgggaagcccccccagtcacctgagagaaacagctgcagtcgccagcaggatctgaccacctcgcccagggtggacaggactgaggccacctcttaatttttccaccctttttgttcctggacattaaataagacagagaaagcaggaaggtggggagagagcacccctgcaaataagagtcatcatccaagagagtatcaaccaagtaggcagaattcttgccaatttagttgactatgcatgggaagggaagtttctagggccttctggaaacagaatattttcttaaaggggccaccaatgataccctttggtcattccaaaatgacctctctgggcctgacgcccctgtgagacgtgaagccagctggacttcctgggtcgagtggggacttggagaacttttctgtcttataagaggattgtaagactcaccaatcagcactctgtagctaggattgtaaaacacaccaatcacctctctgtagctagcaagaggattacaaaatgcaccaatcagtgctctgtaaaatgcaccaatcagcactctgtaaaatgcagcaatcagtgctctgtaaaatgcaccaatcagcaggatcccaaaagtagccaatcgcagggaggattgaaaaaagggcactctgataggacagaaacagaacatgggaggggacaaataagggaataaaagctggcccggtcttcagcacttagccagccagcagcagcaacctgtagggttcttttctatactttggaagcttatttttttgctcttcacaataaatctttctactggtccctgtttgggtctgtgccacctttaagagctgtaatactcaccgggaaggtccacggcttcatttttggtcagcgaaacgaagaacccaatggcagcaatcaactccagacacatctggtcagtcttgttctagatccagggaaagcaatgccctaacggcaggagggaataacccttccagctgatagcagttgttcaaatagtagcaaaggcacataggaagtgtgttgccaagctgcagtctgacaattgctccaaacacgaattttgcttctaagaccctgtaagctgtgggttgtactcaaaagctgtaagttctttgtgcaaaggctggagaaggcagcgagcgggccacgtacctgtcttttcgcagagtgtgagaaacgagactgttctctttacgtggcaggacagttcagagtctctatacccagagcaaccagaacgagctccccttggagtcatggacccagtatctcagttgagcaaatggtaattttcaccaaggctggctggcattgggtgactttagtggcctgtgcacacgagcgccccaggcccttgggcagctgccagtgtgggctggggcttccttgtcgggagggagccaccctgcacctgtgggtgagttttgtctcctggcagcctggcaggcaggtgtggctcatggcagggtgagccactggcacggatctgctgctttccccaggtgagagtttctatgtgcccaaaggtcaccagaaactgacagccagccctgagcaaaccccagcccagggttcatgttgcccgagcagaacctgctggtgtggtctgcaggcgggggcgtttttcttggttggctaacactccttggaaggaggcatgggccaggccagtgtgcttagcagtaccccagagcagtgttgggggcgggagctcaagtgtggggtcagtgtgctcgcaccagagccaaacccaacacttcctgtctcttcctttcctgctgtcaggtggggctgttgttggggaaagaaaagcagggaggacagcgtgggaggctttctcagggccagccctgggaatggggcacagtgagggggtggcatgggtcacctggccccactaagggccagaggcgaggagagatgtccggctgggacttcctgggaggaaggggcgcgctgccacgcagtgcccgaggcccttgggtatctgcgagcatgggctggggcttccctgttgggagggagccacgctgcacctatgggtgagtcctgtcccctcgcagcctggcaggtaggtgtgccttgggaggaaggcacgccctgccacgcggtgtcgctactggctggcaactgttggagaatttattgaagcacgtgaaagagccccaccctgccatagcaatcacctgcctttggtgaggctgagcctggccgcgggaccccattgaccgctcctggcctcacactaaatggagttgcattgctcctccaaattccaaccaagaggaccgagaagttggcctgaagcaggcgcacacgtggaaaagaggagctgaagccacgcgggggctgctcctgcagaggaggtggcttggtctaacttttcaaagcaatggccactcggctgcatcaacctgcatgccacgttcctggctttgatcattgacatgtgcctggctctgctgctctcagctcctggcctcaaacttccttttgaagaaaatcgctgaagcttgtggcctcacttcttccaagaggcagctacagacactctccgggcctggctgcctgtttgttgggacggggcctctggcttgggtttgctgtgcttcaacgccatgtgactccgaagggcctcactcacgccagggcccagcaccggctcggggacaggccaggctggcatgactctgattctgcagatagcatttttagtgactctgctgggaattggttcctgagataacaaagccactgacacagggatgacagatggttaacagcacctcccgagagtaggtctgttctaaacacttgacctgtgacagagcatccatgccacgcggctgctccatgaagtagacgccatcatcgtggtctctgcaggtctacgatggggacactggggagagaggagtgactgtgctggagcatgcgtggatgaggggagggggaagggagggcgtgagcccggtggtccagcaccgtattgtcctgctccactttcctccgaggcttgggtgtgcacgcgctggagccctccctctctgggttggtcatggccctgtcctgtgagaggtggtgtgtggatacctcctgctcctgagtgagcccggcgctccgtaaggagtcagggaatggatccgccatgccagcccagccctgtgctgccaggagcctgtctttctagaaggtgggagtgcgggcacaggctgcctgcccagctgcagagttccctcctcaagtgcaccctggagtggggacggaggagcctagggcactcatgggctccaggttccctggctccctgccaccctcatggtgatctgtccttgcatctactggggtactcaagtaccccgggaggccttggagtatttccacctatttttccttcatggcctcccagtgtatgcttggggaaactgaggctggtaaggctgtagaacacatcacccacagcaagggccagaggggtacatgaccaggggaagaccaggcccttcagggctcatggccccagcccatggccacagagacagagagttttcacttgggtggacactgatgggtcctgctcccactgtgagaccgcgtccccctgccagctccacctggggcctaccctgggactgggaagttgtgttttaagtcttgccctgcctcagtgttccctaaggaatcctgcctggttatgacatgaagcacacgtgtggtgtcccttttgtgcttctggagctgttgccctgattggcatcttgagaagagtactggcagtcaggggatcctggtgcctgccctggctctgcccacctctgtgtgtgtgtcagccaatgggactctctgtgtctcagtttctcgtctttatttatttattttttgagacagggtctcactctgttgcccaggctggagtgcagtggcacgatcacggctcactacagcctcgacctgctgggctcaatcgatcatcctgcctcagcctcctgagtagctgggactacgggtatgtgccaccacacctggctaattaaaaattttttgggggagagccaggcatggtggctcacacctgtaatcctagcgctttgggaggctgaggcagttggatcacttgaggtcaggagttcaaaagcagcctggccaacatggtgaaacctcgcctctactaaaaatatttaaaaaattagctgggcgtggtggtgggtgcctgtaatcccagctacttgggaggctgaggcaggagaatcgcttgaaccttggaggcagaggttgcagtgaaccgagatggtgccattgcacttcagcctgggcaacaagatcgaaacttcatctaaaaaaaaatttttttttttttgagacagggtctatgttgtgcaagctggtcttgaacccctgggctcaagcaatcctcctgccttggcctcccagaagtttctcatttttaaatggaccctgacactggactgagatctcaagctggtatcccaagaactgaaccccataggaacctgcctttctgaaggaagttagagaaaggtgcttccccaggacatttggccctacctcttcctgtggtttgcagcccctggcacccacacacagcctggaaagaccccacattccctgctgagggtcgtactgtgtgctgactgtgcagaccattggaacttgtccttccctaggtaggtcagggtcctgtcaccacgttgtctggaggatagcaggtgctcctgaagtgtttctgaattggaccatatgcaaaatgtacatcaaacgagtcttaataacctattgctcctagagtaattgaattcaccactgttgaaaccccgactggcctgagaaattggctcaggtgaaggagactgaagacatgtggcacgtgcaggcaacatgggccctgcgctgggtctcactgaggggaagtgctctacagggtgtcagtgggtcaaatgtctaactggaatatgggtaggagaccagatgcatgcatgcatgttacatctcctaaggctggagttggaacggcagagtaaagagtttggcaaatcctctccctaaaaggtaacagcaaaactggataaaatggtcaaaaccatcattccaggactggaaaacagccaaaagcagacagcatgttgagacatgtttacttaaggaaaaaacccctgcatgagaaatggcatttttgcctgggcttctcatagccccacttcccacctcagttgtgtaaatctgctaggcagggcatgccatggagcccagcagctttactgccctgtggggctggctggatttgaagcaggaatagtggcaatcttgggaaaggtcaatattgtagctagcctgatgtggtaatctgagttgggcaaacatcggaccagtagactagccagaaatctgggagatttggagaatgagaaccatagtgggccttgataagtgcccacatgtccatggcagtctggaagaccaggtgcatgtgcagggctgtgcacaatacccaggagagactgcacagtccccgctatccattgagtcagccttgcatttgcagattcaaccaaccatggattgaaaatattaaaaaatggccaggggaggtggctcacacctgtagtctctgcactttgggaggtcaagatgagcagatcacttgagcccaggagttcaaaaccaggctggccaacatggtgaaaccctgtttctacatgaaatataaaaatcagctgggcgtgatggcaggcgcctgtagtcccagctgctagggaggctgaggcaggagaatcgcttgagcctgggatggggaggttgcagtgagccgagatggtgccactgcactccagcctgggtgacagagtgagactctgcctcaaaaatcaatgaaaaataataatacatggggtagtgggggagcatggaaaatgggaaagattaatgggtacaaaaatatagttagatacaacgaataagatctagtatttgatagcacaacagggtgactatagccagcaataattagttgtacattttagaataactgagggagcataattggaatgtttacaacatgaggaaacaatgaatgcttgaggtgatggatatcccatttaccctgatgtgattattagattgcatgcctgtatcaaaatatctcatgtactccataaatatgtacacctcagtacccataaaaatgaaaatacaaatacacaatacagtgtaacaactatttatatagcatttacattgtattaggtatgataagtaacacagtgatgatttaaagtctgtgagaggactgcacaagttatatacaaatactattctattttatgtaaggaaattgagcatctgtgagttttaatatctgtgggatcaaattctgggtcctggaacaaatcccctgttgatgccgggggttgactatatatctctggctgaacatgaggccttgtgcctgtgcagaggagatgtgaaacctgacagactgtgaaagctggggcacatttgtaacactgcctcaactccaaatgcattccctaaaccacacacaaatccactggcgaagcgtggaagccttagtggttaaaggtgtttaagtacatttgaccaatcattggctgaccacatatgctaacccacaggcaaccactagaggaagctagagttgaaaataacaacaacaacaacaataataaaaaccccaaactgaacagatacatcagtggctgcacactgaggttgagactgattctacaggatttgttcagtgaagtcactaaaacaaaaatacagcaacagtcccttgggggtaaggggaaggagcagaatccagagttgctacaatattacataaagtgtccagttttaaaaattatgagacatgcaaagaaacaggaaagtgtgatccctatttgggtggtaagtcgggaggaagctgggaggaagctatcaatagacactgtctgatggggcccagatgtttgaatttagtagacaaagatttcaaagcagctatgataaaatgtttaaagacctaaaagaaaccgtttcttttaatttgatgtgacttttttttttttcttggagtgacacagtctcactctgtcacccaggctagagtgcagtggcacgatctcggctcactgcaacctctgcctcctggattcaagcgattctcgtgcctcagcctccggagtagatgggactacaggcacatgccaccacatcaggctatttttttgtatttgtactagatacagggtttcaccatgttggtcaggctgatctcgaacaagtgagaggtgattcgcccgcctcagcctcccaaagtcctgggattacaggcatgagccactgcgcccagcccatttttaagagcaatgactcatcaaatacagactatcaataaaaagataggtattgtaaaaaaaaaaaaaaatcaaatggaaattctggggttgaaaagtacaataactgaaatatttagggtttaatagcagatttgatttggcaggagaaagaatcagtgaacttgaaaggagattaataaaacccatccaaattgaagaatagaaagaaaagaaaatgaagaaaaataaactgaaaaacagacctaaatttgggactcatcacgcataccaaatacatgtcatagaagtcccagaaggaaaagagagaaaagggaagaaatatttgaacaaataatagcaagaaagtcccaaatttgatgaaaaatacaccagtgaagcacaacaaacttcaaataggattaacagaaagagatctatagctagatgcatacagagttgaaggacaaagataaaatttcaaaacagcaaagaaaaaaaaaaaaaacccacaaccttatcacatacaagggaagaactacgtttaacagctgtctcaagtgaagaagacattaaaatgacatattcaaagtgctgtaggaaaaatatttattaaccaagaattctttagctagcaaaactatccttcaaaagtgaagacaaaataaacaaaaattgaagaaattcaatacaagcagatctgtcttataaaacatactaaaggaattccttcaggctgaaaagaaatgacaccagaagataacctgcatttaaccccagcatagtagaaaatacctatatttcttatatgctgtatatagatattttctagtatgcttttaattccttttttattgcttcattcttacttttttgttggaattggttgctctaggaataaagagagcaataaaggagaaagaagaacaaaaaagcctaagtcatataatctttaaataaatagagaagtggcaggaagaaattaaaccataacaatagttagattaaatgtaaatgggattaaacactccaatcaaaaggcagaaattgatagtaataaaacaagatccaactacatgttttgtataaagagacaccatttagattaaaagacacaaataccttaaaactaagtaagaatgaaaaaagatataccatacaaacagggaccataagaaaatttaactgatattctaatatcagttaaaatagactttaagacagataatattgctagaaacaaagagggatatttcataatggtcaaaaggaagatatagcaaatataaacatacatgtttctaacaacagagctccaaaatatgtaaaacccaactgacagaattgaagggagaaaaaggcaatgcaataatagttggagccttcaataccccactctcagtaactgagataactagacagaaaacaagcaaggatacagaagacctgaagaacagcagcaaccaacttgacttctcctctatctataaaaaaccccacccaacaacagaatacacattctcttcaagagcacatgcagcattctccagatagaccttgtactcgaccacaaaaaaggcctcaatgaagaggattcaaataacacaaagtatgttttcacatcagaataaaattaattaaaaacaacagaaagatatttgggaaagccccaaatatttgaaaattttaaaaattacttctaaataactcaggggttaaatcacaaggaaaatagaaaatattttgaactaaatgaaaatgtaaaaatatcaacatttatgaagtacagctaaacagtatctagagggaatttatagctttaaaatgcctattttaaaaatatctgaaatcactaaacccagcttcctccttcaaaaattagaaaaagaactgaacccaaagcaagtagaaggaaagaaataataaagactagcgcaaactccacgcaatgaaaaacagagagccaatagaagaaaatagatgaagccaaagtcaattcttgtaatgctttctgaggttaagtgtagtgtagttatataagagaagactcttgttcttaggtaatatgcatcatgtcttcaaccttatgctcgaatgattcagaagaatattgttatgggcagaaatgtttatatcccttaaaattcgtaacccccactgtggatgcatttggacatggggtctctaaggaagtaactgaggttgaatgaggtcctaagggtgggcactgatctgacaggattaggatcctcatgagacaccagagggcgtgtctgctctctccatgtgcatgtatcaaggacagcccactgaggacacagagatggtggctgtttacaagtcaggaagagaacccttaatagaaactgaccatgctggcaccttctagcctccaaaacgatgagaaaataaataaatgacagcacaaactgcaaattttccaaggaagcatcttggacctgatctaagccactcagtttaagccactcagtctgtggtattttgttaccgtagccccagctgactacatacctacctacctagagtgcactgcacaggtggaaaattggcaacactcagggagtctaggtcaagggcagaagggaagttctctgtattattctcgcaaatgctgtgttgttgcaactgagcgtgaaaatatgctaaaaaaaaataaaaactaacctttcccctgcctgggtggtggacacttaagttgctgggctgtgatgggctggaggctgtgctctcctggttccctgactgaggtgagggccttcggtttagtcctgccctccctgcacagggttctttttgcctctatcccactaagtcgtcaagacggtggacgcagatccactttctgcttcctcctggtgcctgccctgtgtttcccgtggtcctccttggaaaggccacaaaagtgtttcaagaggactcaggtccaagatgcttccttggaaaatttgcagtttgtgctgtcataaatgtggcacattaatggttgctaaaactggggagcaactcctcaaggcttggtgggagcatttcaactgagtttaaatattcaaaaacataagaaccaaatcctgtcccccaggggcagcagcactggatcctactgaccaagcttccaccctcctccctgggcctatcaagaagaaaccaatgggccggacacagtggctcatgcctgtaattaatccaggcactttgggaggccaaggtgggcggatcacttgaggccaggagtttgagaccagcctggccaacatggtgaaaccatctctactaaaaatacaaaaattagccgagcgtggtggggcagtgagccgagattgccccactgccctccagcctgggtgacagagcgagactccgtctccaggaaaaaaaaaccaatgaagccctgggactgtttggtgcatgtgtcctctactgaagagcaggctgcaaagaaactcaattttgctttaaagcactcggtttcaaatgtttctgaaagccctcagcttcccactacaacggcaaccgctgcttggtaggtatcaagactggggctgctccctgggtctcaaccttcatgctttccacttggttcctgctcatcttcaagctgtccttatccaacatggaagacactcattctcagaagtgctctgggaaaccccatgtcctcaaagtcctctctaggaaccccactgccgtcgttccagccggtttctgccacacccccactgacaagaaatgaagagttgctagggtgaatacttggcacgcccctcaacactaaacagcagcagcatactgaccacatgtcagtttccacattttctttccttctctgtttttaagggggtatgaaatgatttatacctgcatgttttcaaatccacttaagaccaggaggtgctatgtggacaaatagatcaaactacctcaaaactttacggtgacaatcaagccaaggtaaaacacgctaaaatcaccacctgtgcacccacctcttcctatttttccgcgggtgagtgccagaggagggcgttccacatgggggctctagtgcgtctcacgaggtgcacttctctcatgcaccaagtgaaaaccttacacatcttccctgcctggcattgcgccagtaggcagaaaacttggtgcaacaaaactcaatttttgtctttattggcacgtggtttcctagacaactatggacacaattccctcagaacagcctatggtgcaaagggagggaagggagagtgtcagaatgtggaaggcttgtcgtagttggttacagacctctcttctgagcaccttgtttgtgtcaacttctggctaacctgaatgaacacccatcagctgggagaaacaagcactagggggcaccttcatggtcactggtaaagaaagccctaattatctacaaaatggaaatggaaaacaaacatttaaagttttatgcattttagttttgaactagaaatcttccaagtttaatatataccttcctagtgaattcccctgccaaaaacaaacaaaaaacccctcccctaaaccaaatggtattcctgcatcttgggcaacagctccttcactgtcaagtagttccaaaggaaagcacgagtaggtaagagtcaaaaatgccactgagtttttgctgtgatcaaattgatcaggagacaacaatgtggttctgtaaaaatcagcacatcaacaatgtgtcttcccacactccatctggggaaacccggctaagcagcctggaaacagagtgccaggtcactctctacatgtagggctgctgggcagccgcagtaacgtgtgcccggatgcatctgtgtacacagctctctggtttgctttctgcaaattggacggaaaacagagcctggcttcccatccagtaaatggttttcaaactgcgagtcaagaaaaccgaaaacttactccccatctgcctgctaggtggccttcctgcatttactgccacatcccttcctagccaactgctccctgtctagacggaagccacccagtgtcaacgtctgtgtctcctcacctgagtcatctccatctgctcagtgccttgtgtactgcattaagtacttgctcagaggtcaagaggaggaactgactcacgcagcattagtggatgttcactaagccttctgttgattgtaacgttagtataggggaagggcaaaagcagaattctgaccctaaagcttggccatctgaatgaactcactgcaccatgctcagtgctgtgggaagatggttaggcaacagaaatgtccttaggaaggagctctaggtatctacacctgaccaggtgttcatgccacatactaaaaggtagggggacaaaaaacagacttactgagttgtgtccctttcacaataaattgtttccctaatttatctaaatgaaaactgtcttatttaggccttatatatgtgtgtctgtgtttacaataaggacacatttaaaacagaaaactcaacacctatatcatactacacataaagttaactcaaagtggatcacagacataaatataaaacaaaaaattctgaaacttgagaagtctttacactttgggctaagtgaagatttctcttaggatagaacatcttagtgaagatatgacaaaagcataatctatgaaagaacaaactgattaaactagacttcatcaaactgaagtcaagcgaaatgaagtaacgtttacacaaaaacctgtacgcaaatgtttatagcagtttactaataatctcccaaacctggaaacaacccagaagttccttaactggggaatggataaacaagctctggtacagccacacaatggaataccacctggcaataaaaaagaacctgcaacatcatacatgaatctcaaatgcatcatgctaagtgaaataagccagactcaaaggcaacatattgtatgattccatttatatgacactgtcaaaaaggcaactatagaaacagaagagatcatcctgccaggggctggaagaagggttgagtataaaggggtacaaatgattagagaagataaagaaactgttgtatgtattaaccgtggtaaataaacagtatgtgtttgtcaaaatttgaactatacattttaaaaacagtaacttactctatgtaaattataccttaacaaagatgaaaaaaataaaatccacatagatggattcagtccacaaaggtgtttactgaaacactatagcaataatccaaatgtcaacaggggtggcagttaagtaagtaggatgtccacaatggaatatttatgctcactaaacccattttcttcccccaaatgtgggtgacattaaacaatgcccgtgctatttatctggggaataaaaccatatacaaatggttacacgcacacacacaaacgcacgtgtgtccccatgcaggggtgtttctccacgcaggggtgtgtgtttacccacagggggaagtcggcctgctgccttctcccactctgtctccaggtccttctgccccacttcagtctgagcccttcagatgagcactgcccacccatctgtacatgctggccaaggggagaaattctgcatgcaacaccagacgacgaggtggtaggtgacgctgggtgatagggatttgtgtgcaggattttaaaacaggattataaagctgcatgaaactagaaaacagtgggcaaacagaccaagccagcactttattttaaaaagttttattttggagatttagaaatttgagatttttaataacggcaaaagaaattcagtcacacctaatgattaacagaatgtagtggtgtattatctaaacagaaatcgtgctgatgtgccataataaattgtctattagtaaaaaaatacactttagggcacagcattgtatcacaaattacagtagggatactttgcaagaatttaatcaaactagagaattctgagtaactgtatcttttaaatgcagcacttaaaaatgtaacaactctgtgcatcctttttcttaaaaaaaatgaccttgcatgtgtcatagaaacgctgctttattgctgcagaggtcaaagttcaaggctcaagaggtacaggagagaatacaaaggtagcctttagaaacgtggtcttgtttatgtataaaaaaggtaaagtttataaaagttaatttacaaaccaagaacaaaagtggtatgcacgcattatgtacaagcatccttaaaacatcaaaattttcaaatgcatagccagaaagaacagaaaaccaccactgccccttgtcaaaaaaaaaaaaaaagaaaagaaaagaaaagaaaaaaatatccccaaatcacaccactattttcttctgggtgataacacatttctgaaaccaccaaatgcacaacgtactcagtctttgtcatgatacagtatctagataatgcacaaaagccataaaaacttagtaacacaaggagaatgagctaagaattaagaacatgagggtaaggcatttctgctggttagtatgtctgtggtaatatggtgaagttagagatctgaagaggccatggaaccagtctcacatgcttttgtatccttccctaagaaaaatgtgttttcatgtacagtaagtcattgtcttcacttcaccctcccccagttgtaaatctccttgctgtacatttctgttaaatccacaacactggttatatattccaggtgcatttaaaaaatgtgtgcatattacttcatgcataataaaataaaatgtgtacgtatgctaggccagggccatagtaaagtttgaaacagtgtactttggaaagaacagacctcaaatgcacccccatttactggctggtattttaacggaaatcaatatgtgaagttaagcagtgacgataaaaaaattacaaaaatcacaaagcaaaatatctttgaacctctagccaataccaacagtcccgtcaatcacaaacatgcagtgtgtagcatgttttccgaccatggttcaggggcatgctcactcatctttatcagttcaaacaaatgcctcatactaacaaactgtagtatcaactctaaaaaaggtataatacttgatagagtggttccatttagattaagtttaatccagtttcacattatttaagttcctatatttcaagagttaaaagtggtcaataaggacagaaacacagtttgctccaacgagataatttggatctccgggaagacacttgttttgccaggttttaggatcacctatgagagaaaagaagttgatgtcatttacagttcagtaaactgctatccgtaatgctttgcaattatagggcaaatacgtatatttagacataattttcttctgtttcttcagcatattgaatttgtatcaaaacacattgctgtatttcaaagcagatctgctggcatctaacaattccaaaggtgtttcacacttctaaaaaaattttttttaaaacgttctttctaactcacaccattaagaacagttttttgttttttgtttttaattttcagacttctcctttattacattatcaagtgcattggccttttcaaaaaatgaatacaagtgagtgatggcaatcttatgcctgggacagtcccagtttgccagagcccacataattatcagtagcactttttttttttttccagtttcgaaagtctggaggataattatgtgatcacctatttgagctgagaatgaggacacatttctcacactcaactataaaccaacaaatgaagcccagttctgcagaatctagttcttgaagactgtcttcccccttacaaaaaacaagcaaaaaaacgagactgcaccagagctgctcagctctgattccagctggacaacaaaattaatcatgcagcttcaaaaactcattgactgggtgttagttaggtctcaggatttaagtttttaataagctcttggtgatttctattagatgtgaaggcagggacgactatatgtctctgtggtgtccaagcaagctgagagtcacagctgtggacgtttgcttcccttacagaagtagctctcaaacaggaatgaccctgcccctgatgggacatctggagacagttttgcttgttaccactggcatctaggggtagaggcccagggaagctgctaaatattccacgacgaacaggagggccctacaacaatcatttggccaaaatgtcaacagtgccagctgagaactttgcttacagtacgttagacattacctaagcaatatctggagccaaaagcatttcatttttccagaaaatggggtacttgtaaatatgaggaaatatgtatttacatgtaattttttcctctgataacattaaaatatgctcttgctataatctttagaccacaaacttttatttcatactgtaccaaactaaaactaaataatgctcatctgatttatcaaagatttggaagctagactttaaatcaggttcgcttaaagtgatctacacccaaaataaaattctaattattaactgacttaagtcactcaaggaagtgagaaatgtgaaaatgcagtggaagctttgaaattatctcaggagaaaaagtcatttacaaatagtgtataaaagaagtaatttagagtattacactgaaaaaccatggccaagtatgatcacaacggaagatcttgttaagtttctctggtatacatacgttgtagattaagaaattaaacaggccaggcacggtggctcacacctgtaatcccagcactctgggaggccgaggcgggtggatcactttaagtcaggagttcgaaccagcctggccaacatggtgaaaccccgtctctactaaaagtacaaaaattagccaggcatggtggtgggcacctgtaatcgaggctgaggcaggagaatcgcttgaagctgggaggcgaaggttgcagtgagctgagatcgtgccaccgcattccagcctgggcgacagagcgagactccacctcaaaaaaccaaatcaaaacaaacaaacaaaaaataaattaaacaatagtaaccaaaaatagaaatagttatataaaggaacaaagtcattttaataaggtaaaaatgcctatttgtgcaggacaatatctcccactgcatcctgaaaaatttgacagaataaatcatttttctgaacaccaagaaatagtcaatatttggccatattatcaaaaaaaaatttttttgagacggtctcgctctgttgcccaggctggagtgcagtggcacgatcttggctcactgcaatctccgcctccctggctcaagcaattctcctgcctcagcctcccgagtagctgggattacaggtgtgtgccaccacgcctggctaatttttgtatttttagtagagatggggtttcaccatgttggtcaggctggtcttgaactcctgacctcaggtaatccacttgcctcagcctcccaaagtgctgcgattacaggcatgagccacggcgcccggcccaaattatcaatttttaaaaggcagaaagtcttctacctttccatatttatttacaatatatgcaccacaaataaatgtgaaaacactggtgatgcctacaaggccacaggaacagagatagagatttgctaacacacagcatgggcagcatcatcagcccaggtattaatcaacgacagtccccaaagctcccaaaggacagagtgaagacagcatacccgacgaggagtcggatgattttagagcaaaagaccaaccgtcaggagtcatggacgcacagtgtggtaagcgcagctccacaggcttcaggaacttgaggccatggggaccacacatcaccaaaggactcagcagtgtttcacctggagttggaaaaggggataggcagagaggatggatgtggtctttcttctagaatcccagttttcctcaccctgcttctaattatatgcttgaaagcctaatggagttagttctctacagtcgcactgaccacaaaaaaacgtaacagcagccacatatggaatcttaaatttcccagtagccacgttagaaagtaaaaagaaacaagtgatatcaaatcttacaatattttaatattttaactcaatataacgaaaacactgttatttcaacatgtaatcaatatatgaaatctttggaacttggtgtgtatttcacatttccagcatctttcaatcccaaattgtcacacttcaagtgctagctagccacgtgcaggcagtggctactgcattcaatcatatgggtctataataaaaaacatattcaaatgtgcttgttgcgaatgtgatatattttccattttcaaaatgttttgtttgctccataggtggttaaagagattcatgcagggccaacacagtcagtcctactggtttttaaaacaggatatccccaaaatcagagtacagaatcagatgtcagtattccggcaaaatacaaaaaagcgaactaaatttgtttaggaagtaaaagcactgctaaaagatgctaaatcacaacacacttcgttataatatcctggtagatccaggaggattatgaaaataagtttccttaagaagctcagaaacatgctgtcatctcctctgagactccttcatgcactctgctgagcatgtactagtgctaggttctggggtgatgaataagacagtacctgtcaagaggtttaggttctccaatcaggtgaaggcacagcaaagcctttctgagtgggtgttacctaacccatctccagagacgcaaaggctgactgattcaaagacaaatttggttaggtcagcctaggctgctcagcaggtgagacatcccgtggcctgtcctatgccatcattttttatttcacaccaaaagtaaaagcaggcagtgtggtcaccacagccttgcttcaggccacccactgcttgcttgcaacaccgtccccagggcacccctcgctacagcactcatctggagatagagaggtgctgcattattagccaagcactataagctctgaagtgcacacagggcaactcttaagttatcaaaactaaggagaaaaataaacacatttacctttctctttatctaaaggtggaaggatgctgttgtcccggcagaccttgaaatagatttcctgctcaactccttcgggaatggctccttgagggataattatactaacaccagtttctatggaactcagcacgcccccattgctgttaaatatgcctcgggctgtggccaccacagtatgaccatcttcatcttcatcctcttccacagctgaaggactgaaagttcagaaatggctagtgagtgaattcctaataatacacaggtgctttgcttttactactactgtattacgtgctttcacttttatttctccatataatcaagaagttactttaacaagataagtttctggcaacagattttactgacagggttatcgcagagaatattatttcttttttgtttgtttgtttggttttgagacagagtctcactctgtcgcccaggctggagtgcagtggcacaatcttggttcactgcaacctccatctcccaggttcaagtgatttttctgcctcagcctcccatgtagctgggactacaggcgcacgccaccaagcctggctaatttttgtatttttagtagagatggggtttcaccatattggccgggctggtctcaaactcctgatctcgtcgtgatccacctgccttggtctcccaaagtgctgaggttacaggcgtgagccaccgcgcctggcgagaatattatttctagagaaattccattctagaaaatttcaaaaattctagagaaatgtcaaaaattcaatttttgaaggcaattagtcaaacgaccttcattaatgaattgcaacctgaaagtgtaaaatctgatgccttgaacacccaactacaggtgaagcatccctaacctgaaaatctgaaatgctccaaaatcggaaacttttttttgagtgtcaaaatgaagctcaaaggaaatgctcattggagcattttggcaatattccaaaatccaaaaaaacccaagatatgagacacttcagaacccaagaagtttggacaagggatactaaacaggtacagagttttatgaagcacattttaaaatccatgaaattggaactttaaaactggtaagtcacaatttaattggtagccctgttcttcccttcctgttgttttttgaaatggagtgtcttgctgtcacccaggctagagtacagcggtgcaatcttggctcactgcaacctccacctcccaggttcaagcaattttcctgcctcagcttctgagtagctaggattacaggcgtctgccaccatgcccggctaatttttgtatttttagtagacatgggttttcaccgtgttggccaggatggaactcctgacttccagtgatccgcccgcctcaacctccgaaagtgctgggattagaggcatgagccaccgtgcctggctgttcttccatttttagtgacacaaaacaatggtgcatctcacggctgacagcatctcagacttgataaaatctccctaggattttaagtgtgcctgagtatggtcctgcctcagcattccctgaggaccaagcgcccgctctggctgtaggaggcaaggcttccaaggttccatgaggcgaagacccttgtatgggcatatcccaaacatccacgaaagagagacagtagattaacttagtaatcacagaacgccaaaggcaaaggggatgtggtatcaatgactgcttcaaaagtagaggctatcaacttcctgaaagtacagttttgagccagggctcaaaggtgagcagaaagaccaacgaaacagaattacatgaaggtagctgccgtttcactccagcatgaccggagtgccagggacgacatcctacgacacaacatcaagggagcagagcgcagcctgagctgcagagcagaggccagctctgtccgcccctgaccatctgtggatgtgcagagctaggaaggcagtgaccgccataaccatcctttctcttggaaagcagactcaggtggccatcctgacctttggttctccctgcctgcaagtgcttctgctttatggtggcgtgaaaatggaactggctgtaggaggctgagatgagcttttatgtatggccagaatccatctggtcaatcgccgtggaatgaaagacaggaaagaggagctgcagggaggctccaggtgggctcactttgtctcatttgctcagccatctcactaactgctgctctttaaacagtcagaggttattctatttttcttcttagcatcattgtggaacaaataatgaatgaggaacatagatacttaatgtttttagatgtcctccacatgcaccttaccagtaggtcaggaggttacaaaaggtcatggctggttaagagtatgggctcctggctgggtgcagtggctcacgcctgtaatcctaacactttgggaggtggaggcggatggatcacttgagatcagaagttcaaaaccagtctggccaacatggtgaaaacctctactaaaaatacaaaaaatttagccaggcgtggtggcacacacctgtagtcccagctacttaggaggctgaggcaggagaattgcctgaacccagggggtggaggttgcagtgaaccaagatcgcaccactgcactccagcctgggcgacagagggagactcttgtctcaaaaaaaaaaaaaaaaaaaagcatgggctcagaggtcggatgaccagcagctaaattgaggctcacctcactctagctgtgaccctgggcaaactgcttactgtcactcaacctcagttcttagtaaaacagggatgatgacaatacctaccaaccatacacgactgttagctttattattttaccaacatcttgtacctcctggaggaccttctatgtaacagcattcattgcaacaacactcttcagtttaaaggttgagttaaaaagatcactttaaagtcccaagtcaaataaactacaacaaactcacatgagaaaaatcacagggccaatgctttgagcaaaggcataagtcttacctcacaggaatagctttaggcactgtgctgatattatttatttgatatttaggcttctctgcatggatagagaaagtttcaactccactgtcaaactcaggaggctgtgccaaactgtgcgatttcacaagagtttttggagaagtgggagtttttgaagacaagtcaggtttatgtgcagtttcacttggcagaagattgtgattgaatttaggactttcaaacttgcgttcaaatggtcgggcagaacttgtatatggttttggtgtgaatcgattgtatgctggagtgactgttttctgagtctgttcagttccattaactggggctttatctggaaaacttttctggggatagaaagctgcctgagcagtatcttctcggtttggtggtctgaaagttgctggcttattctgagatggaggtgggtctggtttggacactaaggaattctgaaaatccaatgacactgaattacctgaaaaacaaacgtaagcatttaaataactttctgaaaaaagttataatagccctgtcccagcttaacttgtcctggtgctggagtcgaggcccaaatgtgggtcgcacagccagagcctgactcttgagccctggaggctaggtgtgatgctgagggatgagggcagcatggacaggtggtgccatgaatatatataccctgctgccctggagtcagggtccagctgctaagattcctggcctccaaagattggcactagtctttgtgaaaactagaatgcccaataatcatataataaggatactcactattaattagaaaaatgtaaaacaaaaccaacaaaaagcattaaatactatttcacacccactagaatggaaaaaccgaaaagtctgatgatgccaaacattggttaaaaagtggaaccacaggattttttatgcactgccagccacagtgtaacacagtaccaactgaactctgtgaaataattaaggacactacaagacaggagaattattaatccaaatacctcatgaatatagtaatataattttccacagtacgagaagaaaaatcatatggtcatcttaatacatgcaggaaaaacatctgactgctttcagcaaactctgaatatagggaatgtcttaaacatgataaaggacatctacgaaaatcctagagctaacattctaaaggataaaacatgaggtccttcctccttaaaatcaggaactagcaaaagaggtccaatttcaccacttacatttcagagtttattggaggtcctggccagtgcaatcagcaagaaaagaaagaaggctaggtgcggtggctcatgcctgtaatcccagcactcttgagaggccgaggtgggcggatcacctgaggtcaggagttcgtgaccagcctggctaacatgatgaaaccctgtctctacaaaaaatacaaaaattagccgggcgtggtggtgtgcgcctatagtcccagctactcaggaggctgaggcaggagaatcacctgaacccgagaggcagaggttgcagtgagctgagactgcgccactgcactgtagcctgggcgagagcaaggcttcgtctcaaaaagaggaaaaaaaaaaagagaaaaggcataaggactggaaagtaagaattaaaactgtctttatctgtaaacatgggcatgtgtgaaaaaaaatcttaataaaagatagcctcaatccagaactataacacatctgcttgaagactcacaagcccaaggaggtgcctcctaagggaataataagagaagtctgtgctaggaaaatgcctgtccacagcagaagagataaccactttgtgttatatgctgagggtaaaatgttacaaagctcttaagatgaataatctggagctatatgtgatctacctggtatgtaaatgcaaaagtcaaggtgtatgggatacattttatatgaaacattatggcttttctatttgggtgtgtgagataaaacatagtaggttttacaaaccatctttacatatactggcaaacactacttccagaagatttagagactagcataaaatagattaaaatctgtttagctaaaaggcttgtccaaaataatggtcttgtaaaaacaggagacatacttttaacaaaattcttagtttttactgttcccagcccaaaggtttcaagcatgtattttttaatgtaaaaaccattttgcctagaaaccaccagaattttacttcataagcattactgtgttaaaatgtctacttccgaacttcctaccttcaccatgtgctcccttagaatgtatgtggagagacgcgctggtgacaggctgagatggctgggcatactgcgagggcaatggaggaggagggggagtggcctggatgggttcatagcgtttctcgccaaatgatctatccacaccatcagcttcaggaggctttcccctgttaacaaatgaagaaaatgccaacacctgaaaatggactcacatttacaaaacaagttctcatttctccatgtatctctaagttaaaaaaaaaaactagaaatttcacaatttattctcatgagtatgggtagctactctaccaaaatataaaaacagattcgaccattcatcggcacaagaaatgtccagacacacaaaaactttaagaatattagtaaaacatccagaagatggcaaccaaaggcaggtgaaattttgggtatagtttaattgttatttacaaaagatagtaatgttgacagatttaagaaagtcttgcaaatattctgaaaacatatcatggcacaaattttcctgagacccactttttttgtttttgagacagggtctcattctgtcgcccagactggagtgcagtggcgcgatctcagtttaccacaacctctgcctcccaggctcaagtgattcttctgcctcagcctcccgagtagctgggattacagatgccagccaccacgcctggctaatttttgtacttttagtagagatggcgtttcaccacgttgtccaggctggtcttgaactcctgacctcaagtgagccgcctgcctctgcttcttaaaagtgctgggattacaggcatgagccaccgcacccggccctagacccacttctgattttgtatctggcatctggcatactcggagcaccataaaaacagatgtcacagactaggggttggcaaactttttcactgaaacaccagagagtaaatgtttgtggtcttttggcccatacagtctttgttagaactattcaaattatgcggttatagccttgaagcagccacagacaatgggcatatctgcgtttcagtaaaactaaaaaaactggagcttttactttaaaatttccccttgagttaccaggtccattttttggttaaatgactgctagagcagcagatcctgctttattttacaaggttcatttaagtcaaattgtgccatgtatgtttattttttcagattgccaattgttaatatgtaacacaaaattcacacaaatctttttaaaagacccataattgcaacattgccatctaaaccttactgctgaatgccaaagctgcactagctttatgtgcaccaacaataacatatacatttggaatactcctggtcattttcataaattttcattgaagaagtcttatgattggcttttttatcttgctttcatgaatttagactaagcccttgatgatgacattaaaatctgaaagtgcacataatgccagtgacacagtgagggacaccttatggaacagcctcacattaattgccagtcttaccacttgacgttccttttcaagtagtcatagctagtgtaagagccaagaaatctaggtgatggcaaagcaagcgcaatagaaaaatgaaagaaaatggtcaatctaactaagtaaatttgcagcaaatggaactcaaatgtcatttaaaaatatcaaccaacatccaccatttcaccataatttggtctataaaggaacatatcactaactctcatttggccaaggaaattgaagataaataaaacacaatcacttagttatgtcccgtctgctggcccatccttcatgtactttaactgttactgcagtgaaaagcaatgtgtttgaactttgctccttctccacctctgttgcagctgctaatagtgagcaaagaaatttatcaaatcaaagagtggtgatcaaggataattagcaggttctgaataagtgggagtgacatgtcccattaaaaaaaaaaaaaaaaaggctgggcaaagaaattctgcaagtgaagacacaggaaaaagtaacacaacagaagagctacattgagcccctgggaggggaatggtaaatggagagatagaaatatgcctggcttgaaacctggccaggcttcacatgttcctttctagcaagacctcctccatctccaatcgtaagctgggccctgtggtggtggagtcttactggtgaagctgcatgcttgatgctcaggctctctctcatctaatgatgtctcacaaacacaaaaacaactgaacatcagtctctcacatttagttctttaaaagctacaaaccaccatcatttattgagacctggaagtctcacatagtgagttgagtcctgaaaggtagatttgataacaaaaaatccctggttgtcctgaagaagttgactcaatctctggactgagacatgtgcacagccctggagggacactgctcttcttgcactgttttagaatcctggaaacttctaatttactttggaggtgaatgtctaagctactgtctcctaacctttccagttctaatccagctctatggaactgttagactgggtaatatctgcttgcttcctggggcatctgtcctgtgctaacaaagattattttccatatctaattctcaccatttctgaggtgtgtttttaagtgaagcataagcacacatcatctgaaggaagaaaattttgctactcctgtatttactgaaagaaagaaatgcctgaaggcagtcttatttagtgacaaacagtaaatggttttgaaatgcaggacagaatcctatattttaagctattttccagttgatgaagttgtactcattggacaagagtatgaaaaagcattacaagggaaacttacagaaacaactaccctcttagttatcttccatgacccttattctcctttccatttctctaaccattaaatacctatatgggaaaatgcagcacaattataaagagtttcaatttcacactacaaaggaaaaaaaagtatactggtatccagcccaaactatacttttctctctcacagcagcagggagtaaaatcaaactgagttctgagtaaattcacaaagacagatgtcatctgtttcacaatatatccctgtgaaaacaatgaccaggtaatacaggttccttccagagctgtgttaatgaaaagaagggtggtggatgcacctagtataccatgccctgttttgagcttcattcactcaacaattactgagcccctactgcatgcaaggcaatgttctacaccctaaagttatacatcacaaataagctaagtcttctttctagaaaaacaaattaacacagaaagcaaacatgcattttgattgattccctggcaaaacaacttactttttagacctaaatatactcctttttttttttgagatgagtctggctctgtcgcccagactggagtgcagtggcgcgatctcggctcattgcaagctccgcctcccgggttcatgccattctcctgcctcagcctccagagtagctgggactacaggcacctgccaccatgcccaggtaattttttgtatttttagtagagacagggtttcaccatattagccaggatggtctcgatctcctgacctcatgatccacccacctcggcctcccaaagtgctgggagtacaggcgtgagccactgcgcccagcctttttttttttttttttttttgagacagagtctcactctgttgcccaagctggagtccagtggcacgatctcggctcactgcaagctctgtctcccgggttcacgccattctcctgcctcagtctcccgagtagctgggactataggagcccgccaccacgccccgctgatttttttgtatttttagtagagatggggtttcatcgtgttagccaggatggtctcgatctcctgacctcatgatcagcctgccttggtctcccaaagtgctgggattacaggcacgagccactgcgcctggccatataatctttttaaggttgtattctatttaccaaatatgtaaaacgataaataagagatatctttaaactaaacacctgagccttcttctgacaggaatgaatgtgtttaacggtgtttagtaaaaataataactaaagggtacacccttctgccttaccaaaggtgagctcctatggctcagtgcctagctcactttaggctagtcaccatttagatgttactgtgataactgtgtaaatgaattcctgtaacactgtaaatgtaaatgaattcctaatgacaaatccacatctgtttttgttcttgtgggttttgttctgttgaggtatgaacccagctgtgcacctgtgtgggtttatattgtgctagctcacttcagtccagacaccatctagatgccacaacccctttctagtgttgtgctaaggggtggttcacaacactagtacaagacacgttttgcatttaatacaacccccactgcagcactctcagtttgcatttggattctcataaactgctttcttctgtaaacataaagccttaaatataggacagtgaaaaaagtcttcactacaaaggatgtcttagaaaaaagcagtggtaattaaaattaggttttaatgttagtggttttaaagtatgttctaaaacaatttacactcaatagtaaatgacaaataggtcatttcccaagataatcccaagcccacgcaactaagtaaggaaaaatctaggtgcttttaatatagacacaatactatgtgtgatgaattctaatatgtcaatctggctaggtactgccatgaagggatttttcaggtgtaatgtccccaagtcagttgaggggagatggtcttgggagggcctggcctaatcagcagagccctctgaatgagaatttaggccttccctgatctcacactccccagtagctcaaaatcttcccttcctgaccaactgccctctgaaataggacttgcttagccagcccctgtaactgtgtaaatgaatttcttttgacaaatccacatctgtttttgttcttgtgggttttgttctattgaggtatgaatctacctgtgtgcccgtgtgggcttagacacaactatcagtaccaaattctcttatcagtcagggttcaaccagagacacagaaccagtaggagacacaaacccacgcaggcacaagaaaggagaacaaaccaacacgaaacccagggatgagtaaacggaggggagcagcaagcacagggaaaagatgactgggagtcaagaaacttggggttcagtcccagctctgccctgtcattttccctcacctgtaaaactggatcagaaatcttacaaaaacaaaaaacaaaaaacctcttcagtatttccctcaaacaggatcctcctcacatctgtatttatatttaaaaaataaaaacagaaaagaaaaagaaccagcatgacatcattaggtgtgtgtacagaagtgaagactgatgattacctatcgatgagggtccttgtggttgacactgtcttccgtcaaaaccctgtgatgttagcatctttgtgaatgcaaaaactatgtacatctaatagcagactttaaaaacaaaacacacatcccagaactaaaaagtatgtacaatgctgaaccactagagcctacagaaatcatatattacacttaaattatttttcttcaaaatatattgaactgcacgggattaatatgctgcatcctatttttaaaagccaggtgaaatagcttactttgaagaataactagaaaaatttgattgattctgagaatgcgctggctttgcaggctcggagagatggctggcggcaatgtgtgcaggaggcttattctcaaaacttcttcggtcaaagtatgacagctgttttcgataatattcttcatcttcttcagggtcataatgattggaccgaacaatatcttcaggtggcttcagttgaggtttttgaggttctgggatcctaacagataatgaatgacaaacggaacacctttttaaatattaatgttatgaaggaagtagaatatgtaagtcttatcttgactaaaaggtcaataattactaactgctgtgattactgaggatctgagcagtcccaacagttaaaatggatatttcaaatcccatgtcctcacagagtatactcaaaaggcagcccccttctggctcatgagtcctttaacacaatataataagctaaacgattacatgattagggaacagcaggttagaagtagttaatcagaaagacaaagggcaatgtaaccgagacagtgaacatcttgagaagtacatataccaaggtcaagaacagtaaatgatagactttaagaactttcaaagggatttttaagaactcagtccaggatctcaatgattctcatatgaacaaataactctatatggtctaaagttctagaaggcatacaaagcagatgaggaagaaagcaagtcattaagtaaattcatattagacagttctcttctttatcctaagtgcaaacatatattcagtcaaaaaacaaaatcagaagagctgtattcaaatctaatctgtcacttattggcagtgcaatgaggccatgggaaaaagctcaggctgaggagcagcaggccaggtttctcttccagctctaagtcttgtaagctacttgcccctctcagcctcagtgtctctctctacaatgcagaacaacaacagtgtcacctcattatgctgatgtgcttagcacaagggcaagcaccttatgcatgctcactaaatgatttagttatcttaaccaatctgagtctgtttcctcaccactggaaactaagagttcacatgtcgaaaagcacttttaaaactaaaaaacataatacaaatgtcagagcttaaaaatgtttatttaatcatctgcttggagaatatctttccgaaagtctgctaaaggtataaagatttgtcagatttgtcagaaataaagttctactttttttccccctagaatcactgtttaggagagctgatagtttttatttaaggacaaactcctcctattcacacctctcctctactaacacagtaaaaggttttcttattgactaagagggttaaattcctggtcagttctatgccacaaagagcacaaagtgtactcacctgtacagagttttgtcatgttcactgaattgattctgagaagtgggtttgggaccaatgatgggagcacctgaaggtttagatgctacttctggaggctgtttaaaaaaaaaaaaaaaaaaaagacaaatatgcctaaggaacagataattaacagaatagatatcatgtaatggcggaggggagagccaagaagccttttaaacggtgtgcccatgcatccaaggcactaaagacatatttaccttaaaactgccagtgtcatttacatccttcttggtctctaaggatgcagatcttttgttttcaaacatcttaactctggtgagtacagactgtggcttcattgctggatcttcctcttcttcggtttgagttgggggtggaggcagtggtttggtgtttgaaggcagagcttctggcttatgctgagatgaaggtatcagcggagggacagctgcagcaccatggagaggctcaaaatgacctgctctagaggtaaatccttggggtggtacttgctcgtaactgcgtgaatattgctcaaaatactgcttggactctgcaggcttgggccctgctgaagggtggggctgggcttccggtctgagtctaccatgtgtgtcatacccaggagctggctgctcttcgtgccgcagggcggatgctctaggtgcctgttcgtaacgtggtctgctgtcgtaagacagaggggctggctcttcaaaacgtggaaagtaccctcgttctgaggactcttcgggatgctgtctggagtcaaggtcttgagagtgctgattatcaaaaggtggccgagatgggtagggctgtttgtcatcataatatgaccactgttcttcatacatggggacgcgatcttcgtatcgcagacgatgttcatagtttcgagaaaactggtccgtatagcttgaggactcgtatctgtatgtgggctgctcgaggtctctgctggcttgtttctctacgtatgggagttggggttcataggtcagattaggctctttgtctggcctgtgccctgggtgactaacggctggctgtttcaaaacatggttctgcctcatcatttcctcgggatatggatcctttctatacacctgtataaaaaattcacatttaaggacaaagtcttgtttctaattctagtctattttattagactgtgattaaatattaaactacgatttaatatgtgaaaatggtatgttttaccatttattatcaggatagacaagattagtggaaaaagctggtttaagtgaaagctcaaaatttataatgcaggtaggggcttttatgtttcagcatgtactaaataaacagtgagttaaagataaatattaaatttagtagaaaattaatgcactattgattacacttcattttgacactgaaaaatcctaaagaagatttatgggcatcataatttgtattaacataaatatgtttatgatgggtttcgattacatattaaggaattctggaagatactgaaagccaaaaataaaaataataagcacaaatctcaattaaaaggcctgttttcaaataatcagtataccaatggaagccatgcaaactacgaaactgaaatgatttgtattgatttgaaagcattacagtgtataagcctgcagtaaaaaagcaaaaggaacacttaaagggcaaagcaaaaatgatcatgtgccagattgatggacagcaacaaattagtgcaacaccgcagcacaggtacctttgttggatctacatgcgacgacaatgatggttcttgatctcttagcattatgtgagctgcctcagtacttggtgttcttaaagaatcagcttgtggtgagtaagaggtggaaggagctggggtgggctcctccagtctgacattagttaaatttacattatgattaacagcagaggttgatgatgctgggtttgtttcaggcgaaaggtaagggactggagatgaagcttctgctttctgtgaagtgtttaaaatattttaaatatagtgtttctgtttactgctaactttccacttcaatttatagtgattggtagacatacattttaagtgtgctgaataacaaaattatgacctcatgtcctaaactttttgggaaaaaaaaaaaatccagtacattgctgtgttaagacaaacacacaaaatttagaattaagcccttggtactctcaaattgaaattgaagattaattcttaatctggagaaaggacaacatatatatttttaactcaatcaccacattctaaaatttaataatgcacctctatctacaaaacgttgaatgcttgctgcttacctgttgagaggctggcttaaatccaggggagtctattctatgaattggttgtggctgcgcttgtggtgagtaaggaggatatgtttggttttcatgatgcattccagaggagtcctctcttacaggctcagaggaccgtgtaatggcagactccggtggagtcccaacctcatcattaagagtttcatctagttcttgatcagtgtaggccccgccttctgtgtctgtgtcttcatagtcagaagtgtgtctactgtccgtgctatacattgagtattcactacctggagctgacaggtaggacagacgatcatcatgcaaatcaaggtcatcacttgtagcaccatccgcctgggtcaaataaaagtaaattacaaattttattcagtagttctttaagagatggcctttatcgtacaaggcagattgaaaaggatatctttctctggagaagtcacatctacttcttgaaacttctggtaaggaaaagtcaagaagattgtacaagcacacacgcagacacatggagcaccccttgagatctgaagggcatggatgaaggaaacagtggccggtaagccaggacaaagttagactccagggcccagccctggaagacaacgaagaaactctgacactgctcagatttataaaacctactcactagctcttcagcccttttaagcaaggggaagagggagaatgttaccaaactaagctcacagaaacaaggacacactgacagaatagcacatggaagaatacctatgaaataaacccaacagttcaaaagttgaataagagctaatatatttatgtttaggaaacaactgatatggtttggatttgtgttcccacccaaatctcatgttgaattgtaatccccagtgttgggggaggggcctggtgggaggtgactggatcatgggggtggtttctaatggtttagcaccatctccctcacacagtcttgtgatagaattctcccaagatctgtttttttaagtgtgcagcacctccccaactctcttcctcctgctccagccatataagacatgcttccttccccttccgccacgattgtaagttgcctgaggcctccccagaagcagaagcctgtacagcctgcagaactgtgagccaatgaaaccttttctttataaattacccagtctcaggtggttctttatcacagtgtgagaatggactaatacagtaaattggtaccagagaagtagggcattgccaaaaagatacctgaaaatgtggaagcagctttggaactgggtaatgggcagaggttggaacagtttggagggctcaagagaagacagaaaaatgagggaaagtttggaatttcctagagacctgttgaatggttttgaccaaaatgctaatagtgatatggacaataaagtccaggctgtggaggtctcagacagagatgaagaacttactgggaactggagtaaaggtcattcattcttgctatgctttagcaaagacactggtggcactgtgcccctgctctagtgatctgtggaactttgaacttgagagagatgatttagggtatctggtggaagaaatttctgaatagcaaagcattcaagatgcgacctggctgcttctaacagcatgtgttcatatgtgtgcacaaacagattatctgaaactggaacttatatttaaaagtgaagcagagcataaaagtttggaaaatttgcagcctggctatgcagtaaaaaataaaaacccattttctggggaggaattcaagctggctgcagaaatttgttaagtaacgagggacagaatattaacagacaaaacaatgggggaaaatgtctccagggcattttggaggcctatgcggcagcccctcccatcacaagcctggaggcctaggagggaaaaaatggttttgtgggtgatccaggcccggccctgctgctctgtgcagcctcaggacatggtgccctgcatcatggctgttctagctccagacatggccaaaatgggccaagttacagctcaggctgttgcttcagagggtgcaagccctaagccttggcagcttccacatgatgctaagtctgcgggtgcacagagggagacagttgaggcttgggagcctctgcctagatttcagaggatgtatggaaatgcctggatgtccaggcagaagtctgctgcaggagcggagccctcatggagcacctccagggcagtgtggaggggaaatgtggggttggagccccccaccagacagtccccactggggcactgcctagtggagctgtgagaagaggcccattgtcctccagaccttagagaggtaggtccaccaacagcatgcaccatgcacctggaaaagccacaggcacacaatgccagtccatgaaaggagctgcaggggctgtgccctgcgtggctacaggggcagagctgtccaaggccttggtagctcaccccttgcatcattgtagcctgggtgtgagcagtggagtcaacggagattattttggagctttaagatttaatgactaatctacttacttttggaatttcatggggattggagctcctttgttttggcagacttctccattttgaaaagggagtatttacccaatgtttatgtcccctttgtatcttggaagtaactaacttgtttttgattttacaggctcctagacagaagagactagccttgtctcagatgagactttgaacttctgagttaatgctgaaatgagttaagactttggggcactgttgggaacgcaccatcatattttgcaatgtgagaaggacatgaaatttgggagggaccaggaacagaatgatatggtttggatttgtgtccccacccacatctcatgttgaattataatcctcagtgttggagtggggcctggtaggaggtgatcacgagggcggtttctaatggtttagcaccatccccctaatactattttgtgataagagttctcccaagctctgtctgtttaaaagtgtgtagtactccccccttctctctcttcctcctgctccaaccatgtaagacatgctttttccccttcactgtcttaagtttcctgaggcctccccagaagcaggagcctgtacagcccacagaactgtgagccaattaaatctcttttctttataagttacccggtctcaggtagttctttacagcagttcaagagcagactaaaacaacctgttaaacatttggcccttaaagctgttatgaaacacaatggaaaatcatcacctacatggtggttgctacattaagaagaaattatttattatttttcatagaaacagtatccaacagatggagaggaagaaatacagtaatgcttttcttttgttaagtaattaagaactcagtttctaatagtttatgttgattatcttctgagtagatcagaaagaaagtgagaagtatttgagggaaaggaagctacagagttgcaatcaacaggttatcactggacactaacgtgacactagtacctggatgaaaaagaacactccctgaagaccctgcctagacaccgtgctcagttactcatgagagctgaaggatctggaatccaggaatcagaaagtatttcttccacttcagtatggaatgaaggacaaacatgaaactcttgtcctccagaaagatgcactgctattaactagcaggtttggtgtggctctgcaggtctgctgtgccagaagcatggtcttgggagtcaagttgcctgaatggagctttccacgcagtccccatgcttggctcgttaagactctgaccttgagcactgccttcctgataagaaagactagggtgtgtcaggtctccccatgctccagttttcaagagagcatctgccaggctgggctggggagagtgggaatccagggatctatcctgttagagcacaatccctctgaacaagtctcaatggcttctcaactcggtaacagctgttgcagaagaaaagtcttcttgctatctactctaatctttaacttgccagggttctgaatactataatccagtagccagtcaaggaaatattgaaagtctgggcaagaataacttagaactaatcaatccacttaagtttttaaagctggtttgaaatgcagatgtaagcaagaacgatgggttgctttgaactaggaaatatgttaagaaagcctcaggatgacttttcctggtttagcagggaatatgtaagactgtgtcagatcttgtaaaaaggaactctttctagcaattaggtcaaagtagttggttcaggaaagtcaatgtgaaatgaagtagttttagtttaagaatctattctatgaaatatacttgaagagaagaggacaggaagataagctgtaagttgtaacaaccttttctggcttacaaaatgcatcagtctagcctgataataaataacctatttttcctcacataaaaagctagaaagttggacctttattttaaaaccaagcaaagaaagcacacaagactatcactaaaatactttatagaaaattaagatttgtggattttaaaaaagcctctcagatactacaaatgtatactttgtgcattttgggaaaacatttatagactactttcattttaagaattcactagtgaaagctattaacattggacctgccaaaggatgttaacagaattgtgttgctatagaaggttagtatgaagactacaatcctttcaagtgctgcaaaagtagaaattagtaatagtgtgttcatgtaaagtggtgtggtttgtttccaccttcattttcctatccagttccagctgacatgttattcagagtggtcttaggctctcgtatgcatggtccatcccccagactggttcataatgagaaaaaccatagttctgacacattactataggtgagaacaatagacactgcctctcagtgttaacagctctccttgcagaggctgtgtatgtctgggtagaggacatggggggtcctaagcatgcagcatgcactgtcagagcatctgtagccacagccaggcagaggaaggtagggaccatgcgggggcaaaacacaacaaaaaccaaaccaacaaggaagtacaaagaacaaaataaaaaccagagatactctcaatcttccctaataaccaaaacttactgcactgatctgaaaaaggtaaaagacatttaaaaaaaaaaagcttccctcaatggtgtattctgaggaaatgattaactctccagacaaaataaacagaccttcccatcaaagattgctataaaaccagaaagactgacaatagaaagtagttattttaaagctggccatttggacgtatagaaaaccaaaattcaaagccaggaaggatctattgctttgttcaatatctcccagtatgttgtgagaatgttaacaggtgttgagtgaaaaataaatgcaaggaaatgcatgaagtcggctttttaacttttaagatgtctcagagcctttaaatgccagtgggtacgaggatactcgtgaggggtctagggtttatttcccatccgctgcttgccttcatagtgccttctctcttagagcaagtcctgaattgagcatgctgaggacagcactttgggagatgctcatctaggccatccaaatcccctcattttcagaggaggaaactgaagccaggctcaaagtcatcattcatagccagacaggggcagcatcagaactcaacctgctcttcattataatttaagattctttaggagacaatcctactgcagtggtaattcaacaggtgagaaaatttaagaattctcttaccatcagaaacaactttcataacccctacacacaaattataaaaacctaaaagctaactttccccaaatttctccaatatgttgatctaattagaaagcactggtatctcaaaagcatctctgattagttacataatttactgaacaagtcaaaaaagtaataggaaatgtcttacctttccctcggaaacccataccagctggttttgctgttgttgaattgcttctttcagcgcaccataccaaccatcattcattgaatttaagttaattgtagctgaaaataaattaacgatgtagttttatggttagagcactgccaaaagtcagaattaattcaaccctgcttacagctaaatcgtcattactgaaagatggtatctgaggatgcaaacatttgaaatttctattttgctactgtatattttcttttaaccaaacagcaggtgttaacacaacaggaagctttccaagaaagtatcatgtaagttttagtatttgaacaccgtaacattttggcctacttaatgttgcccagacattgtaagctgaaagaaggcctttattaacatactcacttgtaaaaagatggtgattatttttacgaagtttatgagatcgctcgtataacttcctggcacttttccgagattctggacataacctcattctcattgtttttactccttgcttagaatcagggttaagaaatacaacaattggataccactgggcatagttaagacgatcaactgcatttggtgttacatctaataaagcatgtttgtcctagaaacagaaagaaaaatatatacaaagacacaagacatcattaattaagaatcaccaaattcagctgggtgcagtggctcacgctacgcctataatcctagcactttgggaggtcgaggtgggtgaatcacttgaggccaggagttccagaccagcctggccagtatggagaaactctatctctactaaaaatacaaaaactagccaggcatggtggtgcacgcctgtaatcccagctacttgggtggctgaggcacaagaatcacttgaacctgagaggtagaggctacagtgagccgagatcacgccactgcagtcccacctgggcaacacagcaagaccctacctcaaaaacaaaaacaaatacaaaccaaaacaaaacaaaacaccccatcacattcagaaaaagtcaaaagtctgtactatatttcagtggtaacagatctctttgtattctaatgtctcaggagcacatattaaaaaactaattgtaagttaactcaattccatttctagccaaatttctaaaaacctttctatgaagctcacttttaagacttagccctaacaccgcaatctgacagtattatccacgtacagttagaataaaaatgtttaagaatttaatgttcctgacattccttatgaatgtaaataacaaactacaacttgaattgtactgatataatatataagcagtctgttaattacatctaaaaatcatacacttgttttgtggtaatgaaaaatcatcttctgatgcctacagtaactattctcttgaaagtaatcattataatgcttttcagtaagggcttaattttcttatagtatgtcagtaatagtctcagaaaaactaccttctactttcaaattaaccaaatcccatcccactcaaaaccacaataacataatgaaatgggtcaagttttaataacttacttgatctatgatttgctttattgtatgcaggcgaataatgccagagctacgttggtcagttccagcgtctcgtggttcactctctattcattatgtcaggacaaaaataagacatcaaattttcactggttagacaggagtttctcaactactggccacaactgatatgccggactggatagtactttgtttgtggaaactgtcttatgcatgcagtacttaaagtgagttttaatatgcatacttccctttttttttttcactattttttcaactactttaatattctggaaaaaaacttagccattaaagaagaaaaaatatacaggaatgcacatttttttcttttgcctggggctctaatatggctcaacagggcactacttcccaccctttttcacactgtaacatccagagaaaatattatttgtatggcacactgagataaactgagggggctgctcctttgccaagctctaaccagccactactggcttaagaggtcaataccttggcatgtccatcaaccatcggtaatggtgctatagtggattgcctagggagttctgggttagagaccttagttacatcagtagaaggggaacctgggggcaggaagctgttcatctgtaactgtgagacagcctatggcttcatcctggcaacctgtcttcactggtgtatactgtgccaaatgcagcttgggctggtttccaaccaaccatctcagagcacagcaacgtttgtgactctggtcacaaggaaagtttgaaaggaaaggaagagctttggtgtttcagagatcagacaaaggcagagatctggaaagacaagtcacactgaggttcaagataaatgattttggagaatgagactaccataagacaaagcaccatgggcaagcagggcagaatttcaaatctagtgaacactggagaattaagaagaaagatcaactgggaattttggctggaaaaaaaatgctactaactcctcaactcaaaagactgtcattagactcaaagaagatataaaactaagctacctgaattccctgttgtggagtaaacctgattaaaccaatgtattaccctttaaggcagagctttgtaagtcatcatacttgcttttcccatatctaaaaatcctaagtttggttatgggtaagggttaccaccaacttccttcaggtgaaatgtcatctacagataacttagccaggtgcggtggcaggtgcctgtaatcccagccactaggggaggctgagacaggagaatcgcttgaacccaggaggcggaggttgcagtgagctgagattgcgtcagtgcactccaacctgggcaacacagtaagaccttgtctcaaacaaaagaaaacaaaacaaaacaaaacttcttctgaaaaaactaagaaataaacattttctaacttgctcagattttactcaaatcatttgtctgcaaatcttctgatgttcagaaaataaatatccttattcaacttcattggcaatgaaatgaaaagcaatatattaaaaaaaaaagatgatgttctgattctttaaattaacactatgcagtttaaagatgttactgagggtcggctgggtgcagtggctcacgcctgtaatcccagcactttgggaggccgaggtgggcagatcacgaggtcaggagatcgagaccatcctggctaacacggtgaaaccccgtctctactaaaaaaacaaaaaaattagccgggcgtggtggcgggtgcctgtagtcccagctactcgggaggctgaggcaggagaatggcatgaacccaggaggtgaaacttggagcctggatctgagatcgtgccactgcactccagcctgggcgacagagcgagactctgtttcaaaaaaaaaaaaaaaaggttactgagggtcatatagtgccagtgggaacaaaatccccagcacaactctctggaaagcagaaacttcatcataattatgggaacagctatattcttaaggatttaaatcctttgggaaacaaagcagggcataaacaagcaaacaaaatatggacagatttctgtatcttttgtaatagtaatataaattcgaaacaaacgatataaaaaaagcctaactgaaccaaaaattgcaggataaaatgaaaatatgccattacctatgaaaaagaaaaattggatataaacttttctaaacagtataaataaaactttgccaaaatatgcttaaaagagtggaagaaaatacaatggaataaaatttagggtggtgatatgtgtaaaaattaactttccaacttttccaaacacagaatggcacttttataattacaaaaacagtttaaaaataaaacaaaactgggtacagtggctcacacctgtaatcccagcactttgggaggccaaggccagagatcacttgagcccaggagctcaggttcagcctggacaacctagtgagaccctgtttctacaaaaataataataataataataataataaactagccaggcgtgttggcatgtgcctgtagtcctagctgcttggaaggccgaggtgtgtggactgcttgaacccatgagtttgggactacagtgagcaatgatctaaccactgcactcctgcctgggcaagagtgagactctgtctctgaaaaaaaaaaaagaggagcagtgtgaagaagaggcgagaacgacccccggaccgaccaaagcccgcgtgccgctgcatcccacgtccagcacctacgtcctgtcgccaccgccaccatgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtatttctggtgactgtacagtttgaaatacttttatcaagttttataaaaatgcagaattttgttttacttttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtttaatgactaaaagagctggaatggagcaagaaagggctgtggtcaaagccgagtcttgtcacttgttcactgagggccaccaggaagtttagactgaagaaactggaaaggatccacgcaatgaccatccaagtctcaggctactcaactgtaacatggatattatactccttacctcagagcatgactgggaggattcaatgacattgtatgttatgcaattttcatatgaagccaagagtttcctaaacggtgacttttctcattaaaagaattggtggaacaaggacatggtcactggggttttctcaccaaattaaaagaatgggataaactgctaatttttcactgacaaaaagtcttatttttattgaatgagtgaatcagaactcactcactttagaggtgtaactcccaacctcatttaagttagccttgaggctacttacttgcaatttgataaatatctggttcttctcttgccagcttttctctggcaacatcagctattggtccaaaaatggttacaggcctcagaaatccagctggagagaaattcacatgaaaaacagcatattttataccttttctttcttaaacatattgacgttaaagggtattaggttagtctgtagaaaataaactaccttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctacacaagaaaggagaaaattaaaataagggcatttaaaatgcaaaatggaaaaagacccacaatgaaatgaaatatacaatactggatggaagttcacatacagtttaaatcttaatggttataataaagaggagtttgtaaacctaagtcagttatagatacgttgaatacaatgaaaaagaattctttacattaccaaaatttcccagtgggattgaaatgatctatcatcatttacttgattcactctatgagaagtatccaagcattcatacctgttcttattagggatgatgcctcgttctacctccttatgatttttaccaattcgaatagcaagccaagagcccagttttccattgtacaaggtatccacaacacggaacacctctcctttgttaaaactaagtccatagggagattccttttcatattcaaaatgggttctaatatagaaagaatctcctacatctgattctacaatgcgacgataaactaaaaggaataaaaacaaacacattatcaatatttagtgggataacaatctgaaagacagtacattatgtaaagatgctatgataatatcaataataatatccaacaaattcttactatgtgccaggtactgtattatttcatgtattcatcactgtaagaattgaaactcttagtacttccattttgcagatgaggaaactgatgcagaaaatacatcaagtaacttgtcaaaagccacatgcttgttttctattatatcatctaacttatctgcaaacattatagacatttccatatctaaatcagcagttctcaaataaaggtaattttatccctcgccatccaacattggacatttgccaatatgcagttttgactgccccatctgtgtactgaaagggtaaggggtgtgtgctagtggcatctcatctagtgagcagaggctaggaatgcccctaaacatccacaatacacaggacagcccctaaaaccacattatttggtccaaaatgtcaacagtgccaaggctgagaaacctggctctaagtgaaaattgtatcacagaaaaaatggagttttctcttgaattaatgctaataaacatctgagtgtattgcttagaaacatcagtacaaaatctgaaagctgctcatatatacttttgtatggttctgatggctaataaatcaacactttctatcacttgtaaagggttggatggcattttatttaaattagaatactataaaggttagtcctattagcatgctctgctaatgagaatcatctgaaattctgtgctcctaaatgacttagaattacataactttctttgagattaacaaattcattcatcactcaactatgagtgacttattttttaaaaatggaataaatccctttgtaagtcctcaaactctacaggtttatctcctccattttctgacagcatctcaccatccttcttcttctgagccaatatggtcacttcttctcctttagggaggtcaagcaggaaaaggacggcttcttctcttatgatatttgtaaaatctacgttgtttacctaataaataagatttcataaatcattcttggctgtttaagaatatgaaaataacatacgcaggacacagatactctcagtctacctaatttgaaaatatcacatctttttttttttttgagacagagtctcgctctgtcgcccaggctggagtgcaatggcacgatctcagctcactgcaacctccacctcccaggttcaagtgattctcctgcctcagcctcccgagtagctgggattgcaggtgcccaccaccacacccagctaatttttttatatttttagtagagatggggtttcaccatgttgggcaggttggtctcaaactcctgacctcaggtgatccgcccgctttggtctcctaaagtgctgggactacaggcatgagtcaccacacccggccgaaaatatcacatcttttaagaccaaaaactttattttactttggagaaaagaatacactctaattttaaaaaaacagaaacaaataaagtgagttaaaggtataaatttatttaaatagtattcagtgtgtcctgacattaaagatctgtgtaaaatttaaccagtttagatgaaaaaaggtaactttttacaagttgctgagaaaaaaaatcaaaagaaaatgggactaaaaagacaatctgcactgtagcaaccctgtaagagcatctgtgtaatgcaggctcagtgtttgccaagttaatatttacttctattagaagcttctaaatgccaaaatgaacttattaaaatgtcaccagtgactgtgtgcaggattacaggcaggttttcttctttccaccttttggaaattttccagattaaaaaagaaaaaaaaaaaccctagaaacaaaaaaacctgacacgcaccacttacttttatgatacaaaacaaaagtgaactattaagaaacattttttagccaggcgcagtgactcatgtctgtaatcccagcactctgggaggccaaagtaggtggactgcttgaacccaggaatttgagaccagtctgggccacgtggtgaaaccctgcctctacaaaaaatacaaaaatttgccacgtgtggtggctaatgcctgtggtcccagctactcaggaggctgaggggaagaatgtttgagcctaggtgtttaaggctgcagtgagccgtgatcacaccactgcattccagcctgggtgacagtgaggcgctgtctcaaggaaaaaaaaaaaaaaaaaagaaagaaacgtttaaaaaaatgtatgccctgattacttcaaaacagggttaagagatgggtaagaaaataggtctctttactttccttggtatagtgaacgttattatacatgttgtatttaaatgtttttgacctaacttgattgacaacaatgtaaacatcatcagaaagaatgaccatatcagatcagatggaaataggtctgaagtcaccatgatgccttgactttttgacatgctaagtttgaagggaaaaggaggaggattcaatgagaaaatgacagagctcaggaaattgctaagtgaaaagactttgattacgagctgctcacttgagcaaccaaacccaagaaagaggcagtgtagcaagagaagcagagagttaccaacattctccaagttttaaaagtatcagtaaagaggcaggaaaagaataaaaaaatgtaccagaatggcagtattatggaatctaaggaaaaaagtacttcaaaaaagattaagacagtcaaaacgctgctaaaaaataaaggaaaatgaggcttgaggatgacattaactcagcaatggcttattgaaaactgagcttcagtgtggtgaaggtggaagccaggctgcaaaactgtatgaccacaatgattgaaaagaaaacaggcaagggcctcaaccacatccttcaacaagttaaacagcaaaaaaggacaaataagacagtggaagatagatgaagaaccagtggagagagaaagacaagaaagtgaacaaagctacaagattctggagcagacaggaggctgaatccaggacactggcaagaggcaggctgagtacagaaagagaccagaatagagaggccacggcaaagactttgtggtagagaagcagaataaatgtaggagctcacaatggacagataccttctgattaaaatgggacatagtttaatctagcaaatcaaatggaggtttggatattttaaaaagaaacaggagacagattaagatggtactatgtcactaggtgaaaccgtttatggggaaggaagggaggactctatagactctactgatactctgcatctaacctgggctttcctgatttgtgtaactaatcctgtctcttgtggagtatgaagtttcaaagccaggcagcttacacatttgcctttgatgtgaattccatctccctgtgtctgagccattatctggggttaaaaaggtcccagaggttgtgtggattgcttcaagatgactcatatgggagaggaacacttgatgttgcttgctgccaagttgtggcccatggcagagtcctgccagtctgaatgtttagttgaacttccaaagactacctggtagatattatcatcgggatataagacttattttcttttatttccatgaacacgagtggtagaaatgaaatgttacattctttactaacacaaaatatagcagtaaacaagagcaagatacaagaatgggaagtgagaagtccagcataaggtagacctgatggattttgactttcaaagtttaactggctcaatggagactgcttacagattacaatctaattacaatagtaagcttgttgtttgatacctttttctggtgatccaaatactttttaacccacataagttgcaatactgacataccctgagaatttgatcaccttcctctaagccttccttggctgcagggctatcttctagaacgccagctacaaatattccaacatcatttccaccagccagccgcaaacccacactatctccttttctgaattttaccaatttcatgctgggcctgttaaaacagatatttcatttgaaacagttaagaagagcttaaaacgttatagcaatcactacagtgaaaactatattcagaattaaataaagaaccatcatttctaaaacttctctcataccactattttactaaataaaatttagtgttagaattcaaatcagacttaataacactattttctgattaacagttttggaatattcaaatttaatatgcaagtactattttacataactaatttataaaattactttgtaaaacaatgttttctcaactctcaaagagttatggtacattccaaatggctaaaaacatcttccattttttccaccccaattcacacatcatttctattaataactgaaaagtcaaattttttaaaataaaggtagaaattgaagtataaattggctaattttcctaacacgatggactcaaaataaggctccaagcattgtgatttctacatgtaacagagagtgatttttaaaaaaactttgcagttggtggagtctttcagtagttcacagagtagttcacttactctgctgcccctctgagttttacaatacaaatcatatagtcattcagcctttctacattagccccatatccattctgtccctttctagttctctgaatggaaaaaaaaaataatgcatacacacccacctctagcatcagtgtagtgttgaaaccttgtgacattccttaaaacaaatactaaaggatgccttctaagaactgactggatagaaacagactgtaattaaaaattacccactatatttcccttctagggattcataagtactctcacattcctagcaagaaaatacactattttacctattctgacaagaagtgtagaaaaaaatccctatactctttattatgtaatactaaccaaattattagaaactaatagataacaataacaacaacaacaacaaaaagtcaaataaatgaatgaaatgtgttgaggaaggagagatttctagtctctttaagccaactaaagagatcgccttaactttcagaacttactatttattcatttctgattgggttacctgacctggaactaacatcagctagtcataaaagtaagagcctgagaaatcagatgaggtctctcactggctggtggcatccttgatccctccatgaaactatttaccagctttactacaaatggtccaagccccttggttgtagtggtatcctagccaggtcaaaagcattctcatagattcctctcctaaacccattgtactgaaacctctttaaatatttcctcaaagtccttaagactccaggtctcagttgggtgtggcagctcaagcctataatgccagcactttgggagactgaggcaggaggactgcttgagcctaggagtttgttcccagccctgatcaacacagcaagaccctgtcactactaaaaaaaaaaaaaaaaaaaaaaaaaaaattagctgggtttcgtggctcgttgcctatagtcctagctactccgaaggctgaggtgggaggattcctcgagcctaggagtttgaggttatggtgagcaatgatcacaccattatactctagcctgggtgacagagtgaggccctgtctctttaaaacaaagcaaaacaaaaacaaaaacaaaagataggactttggaaatcctcttctaaccctgacccatctaatgtgcttcaaaaagcaaaaacaactgagcacagtatccaccctttagtaaaacatggcttctgaaaaccactgttagaagacagctttaggccatatctcaccaacagtgtcatgtgccttagatgactgacattttatactttgtcctgcctgcattatattaactacttgcagtagcaaaacagactcactaacttctgcatcaaatccattcattggctttaaatgaaaaaccaaacctttcctggcacagctactaatcctgtccacgtcctcaaatcttccttggtatttgttctcccagggaaggaggtctctggaatttttcttttttcttttttgagatggagttttgctctgtcacccaggctggagtgcagtggcgcgatctcggctcactgcaagctccacctcctgggttcatgccattctcctgcctcagcctcccgagtagctgggactacaggcgcccgccaccacgcccggctaatttttttgtatttttagtagagacggggtttcgccgtgttcagccaggatggtctcaatctcctgacctggtgatctgcccacctcggactcccaaagtgctgggattacaggcatgagccactgcgcccggccagtctctggaatcttatcattacagtttcctaaacctcaaacacttacacaagttttcaagcaattcccaagaaaggaaaagaaggggactatctatgcctgcacaatttataaaaggttgaattatcaattacctaatattaaaattgtacagttttaaacttgtaaaaaccccatctctttcaggaactacttctatctacctagctgggtctaaatctaacccacttgaggaaatctgccaattttctttttttttttgagacggagtctcgctctgtcacccaggctagagtgcagtggtgtgacctcggctcactgcaagctccgcctcctgggttcacgccattctcctgcctcaacctcccgagtagctgggactataggcgcccagctaattttttgtatttttagtagagatgggttttcaccatgttagccaggatggtcttgatctcctgacctcgtgattcgcccgcctcggcctcccaaagtgctaggtttacaggcataagccactgcgcccggcccggaattctgtcaattttcaattattcacatcatgtcccctttaccagtgccaataaaaaactaatttgggctgggtacagtggctcacatctgtaatcctagcactttgggaggctgaggttggtggactgcttgagcccaggacttttagaccagcctgggcaatgcggcgaaacaaaaccccgtctctactaaaaatacaaaaattagctaggtgtggtggtgtgtgtcctttcatcccagctactcaggaggctgaggtgggaggattgtttgagcccaagaggcagaggttgcagttagccgagattgcaccacggcactccagcctgggcgacagagcaagaccctgtttaaaaaaaaaaactaaccaaacaaacaaaaaactaatttgataatcatgatggtttgaaatttgtttacaaatttacatctcaattctaccaagtatataatgtaaagtaatgaaaggtgttaagatagtaaaaacttacttttgggttgctaactaccctagaacaggttctcaaccaatctcaaccatgattttgcccccaaggaaacatctggcaatgtctagagataattctaattgtcacaactaggggactgctactggcatctagtggccaggattgctgctaaacatgccacaatgcacaggacagcccctcacaacaaatgcttacctggcccaaaatgccactagtgctgagattgagaaacactgatttttttttttttttaatgctccattggaaagctgtggaaattctgatgtctgaatagaatttttttttttttctaattcctaatttaaaagctaggcaggagacagcggtgagaaagaaagcatccaaaaagttcctttgttgtctaatttctaactcactatcatatataagtagcagaatgttaaatataaaaataatcatagtattaggtggtatgtactattttaaaaaatatatgcaatatggtttacaattaaattcctactctgaataatgttaataatgaacaaagaaaacaatacaactttaaaattgtattaccgaagaatcccatcttcatgagttgaattaggtaggacaccatcagatggactgacaggtaaatccacatctggttgcccaacttgggcatacacaggctttggttctaagaaaaaaaaaattgagtaggactcactttagaaaaacatggaataataatgcaagcaaccaagcaatatatgattcataagttcagagaacctgatgaggaacatatctaccatatgtattagagtacattttatagtaataaattctgaagtctttataacaagtaggtatgttacacagtcacctgtgttttccatagttccagcaatcagaatttgaaaaatctattctttaagaacgaataacaaaaaatagatatgagaagagagaattcctacacttcccagttaagactgccaaagtagctacctttcctcattatgataaaatgtttttaaataaccatatttctgccactcagcaagcagagcaagaaagatgatttgagaaaaggaagtgaaagacatcagaaacaaaatctccaggcctcccaggcaaccgatcttagcaccttgctgattctgttttgtcttcacagacagctttaaaaggatgcttgggtcagacacagtggcttgcacctgtaatcccaacacactaggaagctgaggtgggaggactgtttgaggccaggagttggagaccaacctggacaacaaagcaagattccatctctccaaaacaacaacaaaaaacaaagaaaacccacaaaaaaaccccagaaaacccaaaatagccaggtgcggtggtgcacacctgtaatagggaggatcaggtggaaagacagctggagcccaggagttttgaggttacagcgagctaatcacaccactgcactccagctgggtgacagagtgagactctgtctcaaaaaaaaaaacccaaagacaataaataaaggtatactccataaaatgtttatgaaaacactttcaaaaaagcaaaataacttttctttttaaatttttgaagccaatctcatgtttctctttaaggagcagtgttggaaaacaactttactaattgcaagaagttgttaatgataaatattttctatctagaaagtaaaggaaaacattcatgaaaggcaactgatttgtgccaacctgctacccataaggaaaacgctggaagtcatatgcagacaaattcacacatgagaagaataataattgcatctttaaaatcttctgtaaatcctaacaattacttcactctacttgcaaatgtttcttgaacttagtgtttcgttatgcttacctggaagagaaggtgtttgtttctcatttctttcaactgtaacttcttccactgttttaggtgtgtgatcatcagcatgctttacaggagttgagacagccccaggtttagaaattctctcttcatctctactccggagactgtgtgtcattaaaataaaaaatcaagagcataagaatgattctggaaagcatctgtaagagaacagtataagaagaggcaatgcaacttcaaaaacaatgacaacctgctctaacagataccaaaatattgtaaaaacctagtaattaaaaatagagcattaccacagaaaaaccaaatagattcatgtaataaaatcgaaaatgaagaaatatatctataatagcaaaatttatcatgaaagtagcattccaaacaaaactgttggagaaggaacataacatttaataaatggtgtcgggacaactgtccacaaatgtagaaaaattagatccgtatgtttaacaatgacaaaaataaactgatttcagatgaaatcaagtcctaaaaaaagagtttaaacattcacataatcaacaggagtcttctaaagtaagactcaatgaagccacagtatatcaacaaaagtgattacataaaaataaagtacgtgcaaataattgggaaacatatataatactgggctgaactaaatgaaatgggaattctttagttcaaacagctcgatgttaactatttcatacagtttaactaaatacaaatgttgactatgtactgacctaagtaacatatataagaatttggtacttaaaaaaagaaaagacaggcatgatggctcacgtctgtaattccagcactttgggaggccaaggcaagaggactgcttgagcccaggagtttgagaccagctgggcaacatagcaaattccatactctgtaaaaaaaatttaaaatttagccaggcactgtcacttgttcctacagtcctagctatttaagtggctgaggtgggagaattgcttgagccgaggagttggaggctgaagtgagctatgatagagccactacactccagcctaggcaacagaacaagactccgtctctttgaaaaagaaaaaaagaactataaatcaatcaagacaactcaagagagaaatgcaaaaatacaaagaagcttttcagcaaaaaggatgtacaaatacgtaataaatatgcaaacacatttaacctcactaggaactagggaaatacaaattaattagaaactgtattatcggccgggcacagtagctcatgcctgtattcccagcattttgggaggcagaggcaggcggatcacgaggtcaagaaatcaagaccatcctggccagtaaggtgaaaccctgtctctactaaaaatacaaaaattagcccggcgtggtggcatgcgcctatagtcccagctactcgtgaggctgaggcaggagaatcaattgaacccaggaggcagaggttgcagtgagccaagatcgtgccactgcactccagcttggtgacagagcaagactctgtctcaaaaaaaagaaatcatattatcatccatgagaactttcacatgataacatcactggtagggaaagatatggagaaacagacatattcacaaaatgatggtaaaagtgtatgactatttgaaggcaaaatggaaattatcaaaacaaaaaatgtaactaggtcatacactataattccacttctatatttattctagagaaatacaaatgtactcaagaaaacatttataagaacattcattctagtatcagttttagtggcaagaaacaaaataaaactaaatgttcattaataatttccccagataaacagaaatcataaagtgtaccaagacaatatatattttaaaagaagccaataaatatatcttgaataaaaagataaatcaagatctataattttacaaagtatcacgtatatatggttttacagctgcattctcccaacctcggaaaaacaaaataatttgtttaattatcctggaccacagaaaaatataaaaagctctctaattcacttaaaaaaaaactttatttccaaacatatacagccatacagagaacagtatcataaaaccccatgtactcatcgtcgacaattatcaatactctagtcatcagcattccaatctgaggctaccagaacctttaacatccaaatcttgatgacaagagtacaaagagagaaaataatatatttttcattatgaatggaggaaaaaattctaaataaataaaatactagctaggagaatacagtagtgtattagaagactatcatcagggttatttcaagggtgcaagattagttcgacattaggaatttactgacacaattcattattatgcacaaatatttacagaaaaaagtgttaatatcaaactggcatgagaaaatttgcagtcattcctaaacaaaaactgaaataagcaatataattatgaaagaaactattttctaaaaccaagagcaaacatcctatcaaatagtgaaatgctgaatgtatttacactatttacaccaaactcagtaacaggacagtgatacctgtgaacactactgttattcactctgattttgaagacccaggtagtataatcacgagctaatggtcccaaaatattgaaaaaaaaaaaaaaacttaatgaatattaaagactactgaaaaatttcctgaattaagataattttaattacataaaaaaatcttttgtcaatatcgtcaacaatcagatggaaatgaaagggaaaaaataacaccagtaacaagaacattaaacattctaaaactttagactgggggaagcctttgcaagtaggatagaaattcggaagccataaaggcaagataaaaatatctgacaagattaaaaacttttacttgcacaggaaaagatattataaagacttacatttgaaacacagctatatcagtaatctggtactagccattaaaaattttgaacaacacaaacacactctttaaggactttagaaataaaatgcaccagcacagtacatgaaatcaggtacgaaggtgcttactgccatgttttcgcaggcaaatacctagaaacaagatgtccataatacggaaagtttcttatcaaaagaataaactggatgttcaccttgtattgttcaactgaaataatttagctgagtaataattcaaatcctgatctcttaattattaaaagaaaaacccaaaccctatatatgataccaaatgtcagtacgagtctggagaatggcttaattcaagaagagtgagaactgggggtgaactgggggtgaagtggagttggtggatttgatctatttcacttgttctaataagcatgcattgtttgtaaaagactattaaaattaggtgtaatgaaatagaatgatatgtacagacatgaaaactttaaaacggctgggcgcagtggctcacgcctgtaatcccagcactttgggaggctgaggcgggcggatcacaaggtcagaagatcgagaccatcctggctacgggtgaaaccctgtctctactaaaaatacaaaaaaaattggctgggcgtggtggcgggagcctgcagtcccagctactctggaggctgaggcaggagaatggcgtgaacccgggaggcggagcttgcagtgagcccagatggagccactgcactccagcctggacgacagagtgagactccgtctcaaaaaaaaaaaaagaaagaaaataacttcaaaacaaaatgccaaataagacacacagattacagaatacatatagcaggataccatatagctatttaaaaacttttctctaaaatataaacagacatgtttgcacatgcccatgtacagacaagcaacagataccaaataagcaacagtggttcaccttggagggaaaaatagccaaaatagtagccaagaggaattttacagttatctctactatttcaacttttacaaaaatttacttattataataaagattgaaaaaatatatttaaaattatttttaaagactaactttaaacataaaatttggttttattaacgtatattattagtagtctcttttcaggaaaaggtttctttctatgttgtcttcctgaaggaataaaaaataagtactttgcatagtttctatttttgtattcttttaaccattctgtggaggtgtattctacttttaagttggtatattcttaatgagctgcactgaagtagaacaatcttttaggaaaaaaaaaaaagccaagatattttctagctcaaacaaggatgagctacttttaaattggaaaagattggccggttaaatatgcaaatgatgtttaacatgaaacatcactcctgtaatcccagcactttgggaggccgaggtcggtggatcacctgaggtcaggagttcgagatcagcctgaccaacatggtgaaaacccctctctactaaaaaaacaaaaattagttgggtgtggtggcacgcacctgtaatcccagatacttcggaggttgaggcacaagaatcgcttaaacctgggaggcagaggttgcagtgagccgatattgcgccactgcactccagcctgggcaagacagcgagactttgtctcaataaataaataaataaatacaataaattgtaaaagatcaaaatttttagccattacttgtgtaataaaatatcacaattagctaagtataaatcaacaaaattaagctctatccccaaattgtgctgtgctcctcagattaaaagggaagtgcaaaatagtaaattatcctgcattgtttgcattaaaaaatatgattaatatattataaatacaaaattatttttaaaaagagaaaagtgaaaaaataagttaaaatgagtatttttaaagagaatgagttacccacaaaattttaatagttctacagatttctattgctctgtacaaagcagaatttgtttagaaaaggtaagaattccaattaattttcttctttcttgtaactgatcaaaacttctaaaaattaaaatgtgattaacagacattaccatcttggtattttaacttacaatattttaactcaaatgctctcctcaatgataaacgataggtcgtcattggctatacatgtagggctcttgctccatatatcacacaaaacttctgggagtatttttatctttggccaatttgcataccccattgctaattacctttttgtcctgtgatacaatcattataacattaaatgcaattagccttccaaaacaacatttcacataaatgggactcacaccattctattcaatttttcatacaattaatatttgaaatattagcttttgttagtgcatttccattatctaccaaaagatggaggcatttttcaataatacataaagatctagaacagtactgtttaagagaattataaaatgagctgcttacgtaattaaaaattttctagaatccatgttaaataaaataaggcgaaatcaatttataaattttattactcaatgtatctaaagtagtatttcatcatctaagttattaatgaggtattttacattttttgcatactgtgttttcaaaatccaatgtgcatttcacactaacaatacacctcgatttggactggccacatttcaaatgttgaacagtgacatgtggctactggctatggtgttggactatgcagatctagagttacagcacaaaataaaataatcaacttttccaaacattaaaatgttctttcacaagcaaatgtgactatgaagtcaagataaaatctgaatttacacatgaaattagtcaacaatcagtggcaattattgaaagaaattgtgaggttgtgataatgaatcacatttttcccaaaccttcctaattcttttttttttttttttttttttttttttgagtcagggtctcaatgttgccctggctggagtgcagtggcacaatcatacttcactgcagcctcaacctcccaggctcaagcaatcctcccacctcagcctgcaagagtagctggactacagatgcgtgccaccataccctgctaactttttctacttgttgtagagatggggtttcgctatgttgcccaggcgagtctcgaacttctgggttcaagttatcctcctacttcggcttccaaaagtgctggattacaggtgcaagccaccatgcccagcccttcctcacataattctatcctaatggctctccatatttaagcttaaaaatgtgtgtgtgtgtgtgtgtgtgtgtgtgtgtgcgcgtgtgtgcgcgcgcgcgtttgctattatgaggaaagctttctataaaaattatgtgttcggagtcaggttcatgtttacgtattccagctcctggtagcctagaaggaaactttgggcattttaaggtacctcaagatcctcttatgggcacttttgcttttccccagaagggtaagacgagtttctgttgtttttttttttttgtattaacttgcacgtattaatctaaaggtaatgaccttgttatctggaggctatgagctagttgaaagctctagacaagacagctgacaaagatggactggaaaggagtctctgagagagattttataggtcacatgaacggactcactgttaagcagagcctactttaggtcttacccaatcaaatgtgtgaccagtgtagccgattaatacacactcaattagattagcaaggagtaacatgctgtttcaagtaaaaaactttggttgtgaaattgcagctgtttggagccatttagtagaggcagagggcatgcagcatggtcagtacagggtcctggggagacgctgtaggagagaaggtgcatcccctcagcatgctcctgcagtgcccagcatcctaaagtactcggtggccagcagcctgctccagagactctctcaaacggttctgttgtgtgaagtctcccatgagatacctccccagcacatgggagtacaaataccatgcaagttcgtctggtgacataccacagcaaattctcggccactcagtgagcaccgttgttccctttccaagaaggccagatctcagccctgaggatgagtgagtgggagcctcttcctttggcactctatctcagcaccaaggagagtagctgctccttctatctgtggttcttttgtgctttgtttttgagacggagtcacgctctgtcacccaggctggagtgcagtgacgcaatctcggctcactgcaacctccgcctcctgggttcaagttattctcctgtctcagcctcctgagtagctgggattacaggagcatgccactgtgtccggctaatttttttttttttttgagactgagtctcggtctgtcacccaggctggaagtgcagtggtgcgatcctggctcactgcaagctccgcctcccgggttcacgccattctcctgcctcagtctcccgagcagctggactacaggcacgtgccaccacgcccagctaattttttgtatttttagtagagacagggtttcaccgtgttagccaggatggtcttgatctgccctcatgatcagcccgcctcagcctcccaaagtgctgggattacaggcgtgagccaccacgcccggcctaattttttgtattttagtagagacagggtttcaccgtgttgcccaggctggtcttgaactcctgagttcaggcaatctgctcgcctcggcctcccaaagtgctgagattacaggtgtgagccactgcgcccagccctatccgtggttcttaatcttcagagctctctttagttcttaccagtcaatccctcattactcctgttatgtttaatttctttacattcaactttctctgttcatggaaactgtgctttctgtctcctgattgataagatatgcctggtcgccatttcatagccctttccctcttacttctagctctatgaacacctttccaatcaacttgatgtgccttattttaaaaataaccttaatacaggaaataaatgaagcgctgaacattcactctagtagaatatccttttataaagccaactccccattacaaattaaagacttatactacaaaaacggatttatacatacttttcacaagttcattaattgcataaggtaggcaagaacaccacagtttaggttgaaaacaaaagctagctactaatccctttaaaaggcattggattatctcaaccacaattaacaataaaaatatgctaagaatttaagttaactgtattccaaagttttttccactgacaggaaaatttcagcctggaaggctctattgcaaaaagacagaaaagtgaaggcacactccagtttcatacttagaatgttgcaatcactgctaatcctctgattttatatggaaacaaatatatacacattgaagttcccccttcacaacgattaaaaaatggtctctctctgcactggtacccaaagaattctggggatgagaaagcaagagatacagggctggtacttgggaacaaaaggtaaaaaagttgcccaggaagtatgctgagaaggcaagaaaataattaccttaattccactttgtcattttgtaagctaatttctcacaatgtaaatctgtcctttacatgtaatctgctttctaaaacatacatgtgttcatgagcatgcttctgaaaaaatctgagtctatttcactgtgatattgtttttaggcaataatttagatgtatgtgtttgtggagcttattcttctgtacaagtgcttctcatcttaaacattcatctattaatctagtccatccgcattagaagaaaaacaggtctgtggttcaaaagtaattttcatggatatggacaacttttagtaagaaacaactgaggaaagcccaagaggacttttgtctcacttaaagaattgtgttgttacaccttcattggtggtataatgattattctgtactttgactaatacttatgactaacatagcactttgtgcagtttatttggtagattttatagtgggagaccaatgtcacaaatcttattaggattctctcagagaaaacagaaaattgtctcacatttaaaaaatctgcaaataagtttttttgtatatttactattttagacaagtggagcagtttgtttttaaatttgccatttttaaatattgtacttgtagaagaaaacaaatctcagctgatggagtaaataaactttatacttttactttttatttttgtactacttatttttgagacagggccttgttctattgcccaggctacagttcagtggcgtgatcatggcacactgcagcctcaacctcttgggctcaagcaggcgatccttccacctcagcctcctgagtacccaggatcacagatgtgcaccaccacgcccggctaaatacacttttttttttttttccccccagacggagtctcgctctgtcacccaggctggagtgcagtggcatgatctcggctcactgcaacctctgcctcccaggttcaagcgattctcctgcctcagccttccgagtagctgggattataggcacacgccaccacgcctagctaattttggtatttttagtagagactgggtttcaccatgttggccaggctggtcttgaactcctgacctcaagtgatcttgcccaccttggcctcccaaagtgctgagattacaggtgtaagccatcgtgcctggcctactttcactttttaaacgggatatatgataaatattgaagcctgcctttctgctatttgatccatgatctcctcttaagggttaaaatctaacagcaatcactgaataccccatgactatacttgggtttccattaactagagaaacttaatcaactaaaatcttccctcttttggcccctcacaaaagcacactgaaaataaaacctcacattggaatttcaatgaagtaacctgaaatcccctcaaactgaaaataacagttcgttcacaaaagttcaggatgtcatcgatattccactcactttgaaatgttagataaaacatattagcaaaaaagcatttaataacatttcaagtaataaacaacattaaaaaaactttcatgttctaaccaaattttttaaaacagaaaaaattcacttcttggatctccaaatcactttctcccttgctcttatgatgtagccacatgggctatattgctgcccttccagtaggtcgagtttccatctcaggagcagtacacgctttgccttattccagaatgaccttcacctgccagggtctttcttacccagttcaaaatgatgtgacctcagagaagctttcttccctgagcctgttatttaatattgtcccctcctgcttcactattacactaccctgattctctttatagcatttaaccactaacgaaaatttactttttgtattttcaaatttatgtatttgctttggatatagagcttacatccaaatgatagcagggatcttgcctaagattgctcaggatatggccaggcgcagtggctcacgcctgtaatcccagcactttgggaggctgaggcaggcagatcacgaggtcaggagatcgagaccatcctggctaacacagtgaaaccccgtctctactaaaaaacacaaaaaattagccaggcgtggtggcgggtgcctgtagtcccagctactcaggaggctgaggcaggagaatagcgtgaacctgggaggcggagctcgcagtgagccgagatcgtgccactgcactccagcctgggagacagagcaagactctgtgtcaaaaaaaaaaaaaaaaaaaaaaaaaagattgctcaggatatttatcgccatacactgataacatatatgtgacattagtaagtatttggcaaaggacgaatgagcaggataacatccacattactggtaaaatctttcaaccttcactacagaaggaacattcactgtggtgccgcctgttgatcactcagaactatgcacattggtcacggtgtaaggtacaggagccatgggaaagaagtcactgattcgactcgctgattaaccattgaaatacttaatgaatcatatctttctaactggcaccctttctatctttctcagatgaaagggaaacagaaaaaaaaaaaaaaaacaaaggtaaaggacctcatggtgagcctaaaaaagaacacgtagtactaccaacaccatgttcactaccaacaatatatgtaattcttgtttagaataaagcacttatcaaattggagttatgaaatttatttagacaaaagactaacaccaatgatcagtaaataaaatctgaaactcaccaatcagggtatatacccaaggaatataaatcattctaccataaagacatatgcaaacaaatgttcactgcagcactattcacaatagcaaagacatggagtcaacctatatgcccaccaatgacagagtggataaagaaaatgtggtacatatacaccatggaatactatgcagccataaaaaagaacatgtcttttgccagaacatgagtggagctggaggccattacccttagcaaacgaatgcaggaacagaaaaccaaacactgcatgttctcacttgtaagtgggagctaaatggtaagaacttacgaacacaaagaaaacaacaggcactggggtctacttgaggggggagggtaggaggagggagaacaagagaaaactattggatactgggtttaacatctgggtgatgaaatagtacgtacaaaacacgatgacacatgtttacctacgtaacaaacctgcatatgtacccctaaacctaaaagtcaaaaaaattaaaaagaaattcactagtcagaagatcgttacctctccacatttgaaatagaaaaaaaaatgctcatcaatattaggatgtttcaacaataatttttagcctattggcaaagttgcacaggttaagcatcccttgcctaaaatgcttgggaccagaactgttttggatttcggattttggaatatgtgcatcatactggttacccattgagcagccctaatctgaaaatgcaaagtctgaaatgcatttcccttgagcgtcatgttggcactcaagttttggattttggagcattttggattttgcactttcagattacctacgctcaacctgtatgtaagtttcagagaaaattaagcaatatgtgacagaaactatatacagtaagatgaaataatatttatagttctcaaatgctgacgaaaacaattatggaaggtagaggaaaaggtgtgtaaataaaaaactagatctttaatttaaaagctaagaccacataaggatattttaatcaacaatggaccccacagacaatagtggtccctgaagattaaaatactgtagttgtactgtcctttcctacgtttaagatacacaaatgctaactgctgtttcaactgcctacagtatttggtacagtaacctgctgtacaggtttgtagcctaggagcaataggctacaccatatagcctgggtgtgtggcaggctctaccacctaggtttgtgtaagtacactctatgatgttcacacaaggatgcatttctcagaaggtatccccatcaagtgacacgtgactgcacattatatgctctacctgcatgtttatttggacttactcagcactcttggaaaactcctaatatggagtggattgtatagataagaggttttgatcccaaatatatgatcttaacttggccaaacgtgaatttaggctaaaaatttctgattcagaaaattcaattttactgtcatgtatttgctgtatcataagctgtatcaatgctgacacaccttttactttagaattcagtagaggcatttctcaggaggaacaatgaatgaagagattaaataactgttacaaagtttcaatcttctgaaaacactgcttttaagtttctcagaactaaccattttcgtaaaatggatttgctaaatataaactggactgtttttctatttgtgaaaacacattccccaaacactttagaaaacagtttaggccttagatgaactctgttggtttcagggaatgagtgtaacaaatgtaaatgggtagaatgccaaatgtaaatcttgacaatccaaatttcccacatttcaatttcatcctgttagtctgaacttttactgtaatagaattttttcaatattgtacctgcttatgactaatcatgctcacttttataaaaatttatagaataaaaaaggtaaacacctgttgttccctctaacatacaatgttagagggaaacataaaatgggtctgttaaaatagctgtaaatatgaggaagaatacaatctaaccaagcagaggcctagatcataccctgcaaatcaaatactctctacttatgcagggactacaggaagatcagtgaaatctcttttcaatgatacccactcagtaatcaccaagaagcaaagtgtcaccatcaactgtgggctctctcagtattcccagctcctacagcccaagtcttggcccagactgggctctgcaacaatactaagtgaaatacaaaacaaagcaaacaagcccagcaacaagcatcaagttataagaaaaccactgtaattattttccctatgtatatgtattttttgaatttaaaaacaaaactattttaacattccagacaaagcatttggaaactttttctgtaattgactcccttggccatatagtctctcttataacttcttgattatgccattgtggaatgggtttccaataaaactttacaaaaggaggaggctggatttagcccacacagtgcagtctgccaactccagttctagacaacagtgaggatactttgttcatctaattataatgaagaacaagcttgtgtgtttttctcagaattctctccatatgtttgctctctaagaaaagaatatcacacagaggaacataagtaggtcatgacaacaatggaacgctggtagattttagtttcctgaagattaagtagtaattaagctatgaaatttctttctctacaccagtaaggtcaaagatttgggtcaaagagccaacagttttaatcctggccccaatcccaggtcaacaacataaccctggactttattgcaacctctcaattttagtttgcttaactatatagaatgaggaaatctcagaaaatggttaaatacaagcagataagaaagcacatttggaaattctaacttatgatactattattactactatgaatcaccataataattacagtagcgaacacatgtgccaggtattgtaataactaatttctcaccattctgtaacgtatgacctgcctgcttcactgcatatggggatgctgaaacacagaggtttcaaggttatgcaagtaaccaaaggcaggctgggacatgaacccaggaagtccggctccaaagccctaagaattcactatattctatcacttctcacaaaatgaagatgaagaggttattattctcagcagataatcgcacatcctaaaaatatacaaaagtattcagaaatctaggaagagaacagggcagggctgatgtttgccaagacagacttccttttacactcaagtgaaacctttctcacagagaccaggtcatttttttatcacttctttaaagataatttacatacaatttgtaaaacaaaaagacacttatacagccaaaattaaataaaaaaaacaaaagactatatatggaagtcctttagtgtttttttacactagcattttactcttataatgtatctaagttgtttctcaaaatgcagggaatgctctaaattaaaactccacagttacaggatttgaagattcaactttggggtggaaatgaaacctttaagcaactggtactatttatatcttgtctgtaggcagattactaaattttcaggaattaaattctcaccacaaaaaatatgaaaagaacctgaagagatttttccttctgtagttgaagttaccttttcttttatacactatactttctaaccattagttcccacatctagcagtgcacataagagaaagatgccaggagcttaaaaacaaaaaaatacagttgacccttgaagagcatgagatttaactgtgtgggtccacttacactcgaattttcttccacctctgccacccatgatacagaaagaccaacctctcctattcctcagacgactaaatgtgaaaacaaggatgaaggaaatgagcagtgaaggaaaacgaggatgaagacctttatgatgatccactttcacctaatgaacagtaaatgtattttctcttatgattttcttattaacactttcttttctttagcttactttaagaatactgaatataatacatctaacctacaaactttgtactgtttatgttatcagtaagcttccactcaacagtaggctattaatagttaagtttttgggaagttaaaaatcacaggtggatttttgactgtgtgtcgggggtgagagggaggttttggtcccccctaaaccccaggttgttcgagggtcaaatgtattgcctgcttccgtctcagatcagctgaaagcaagccccagaagtttgtatttttaaaagctcccatattactggtgctacccatgaaaatacttaagatacctaggagaaaaaaaaatcacaatataacacaaaaatagtaattttaggggggaaaaaccctccacttttaagttaaggttacagattctaagtgctgaggaactctaaatgaagaaagtggacatcaaaaagaattttctaagattgaaaattttttacaatctaaactaatggcccaacatttgagattttgattcagattgcgttatttaaaaggggaaatcatgtccaaattacttaagcatggtttctagctgagaaatagatgttaaaattacagctgctcccgtgaatcatcaaaggtgctatatcactgtgtgtgtgtatgtgttgcggcagtaatccttttcctgataacaatctatgctgtgccaggaagatttttagaatatattaactgcagcaattaaaaatcatcatcagttataagataagccaactttacacgtaacatgccataatattcctttaaaaaatcattacatccttaaaataaacaccagggttctcataatttataaatctaggtttgaaatttagaaataatcagcttcacaaatacataaaaactacagtagatacgaattagcaaccacattcatagctcttacaagttatcctcttctcttactagttcccattttagtagaatgcgaaacactttacagttttaactaccactgtcactgcggttttttacaaactttaaaaaagctctctcctggctaggtacgcctcccttttcttacttctccctcgcctcttcaccttcctaaaagaacgtgctccctgttatccagttctctgccttctttccaaactgtttctcttagcaattttagtgacttctatggcttcagctaacacctctatgcaagttaagtctcaattcaacatctctaatcctaaatcatctcttcagatctagacccaaatttactttttctttccagctttactgaggtccaattgacaaataaacattgtatctattaaaggtgtacaacagtgatgttttgatatacatattcaaatgatgaccgagaccaagttaattaacatatccatacctcatagttacttttcttagtgtgtgtcaaaagaatgccttaagatctactctcttagcaaatttcaagtatacgttattaactcttgtcactacactgtaaattaggtctccagaacttactcatcttataattgaaactgtgtaccctttaacaaacatctccccattcctccccacccctaacccctggtaaccaccattctactgtctgtttctatgagttcaacttgcttaggttccacagtaagtgaggtcatgcagtgtttgtctttctgtgtctggtttatttcacttagcacaatgccctccaggttcatccatgttgttccaaatggcaggatttccttctttttaaaggctaaatcacatttcattgtgtgtgtgaacattttctttatccattcatgtgttcgacattcaggttgactccataccttggctattgtgaataatgctgcaacaaacatgagagtgcagatatctcttcgagacagtgatttcatttcctttggatatgtacccagaagtggaattgctggatcatgtgctagttcgttctggttttaattttttgaggaacctccatactgttttccagaatggccgtatcaattacattctcatcaacaacgtataagggttcccttttcttctaaactgtctcttcagccctggactcatgtttcaagtgatcttcatgtggactgcagttaaccatgggtcaggtggtggcctatagagccttgggagtctccagaaattgtatgcaattgctgcgtgtatgtgcacatgcacatttttctggagagaaggatcataattttcttcagattctcaaatgtacgtgtgactctaaagaaagataaactcaggtaggtcatatactaccagtataccagaacctttggcataaatactagtgttttgttttgtttttgagaaagagttccgctctgtcaccaaggctggagtgcagtggtgcgatctcggctcactgcaacctccgcttcccaggttcaagcaattctcatgtctcagcctcccgagtagctgggattacaagcatgtgccaacactacctggctaatttttgtatttttagtagagacagagtttcaccatgtcggccaggctggtcttgatctcctggcctcaagtgatccgcctgcctcggcctcccaaagtgctgggattacaggtgtgagccaccgcgcccggccaacactagtgtatttttaaaagagaaaacaaagtccaggttaatgtgtttattaaaggacttctgtagttaactttcccaagcagtagatttctgaagcttgctagcatcttctaatgcaatagtatgacaaactgcagctgcggatcaaccgcttttgtaaataaagttttatgggaacatagtcatgcccattcatttacacattgtctatggttgcttttgcagttgagcagtgaaaagaactatatggcctgcatgattgaaatatgtttactatctggccctttaagggaaagtttgcggttattttagatttaaaaaatgtctaagttgagaaaaacagatctaatcttgaataatcaaaagaaatacatcttttaattttatttgtaagcaatttcagatactggtatcaagcaaacaaaacccctgtattttttaaaaaaatagggtgtcttacctgccattgcttggctgctgcggcgagtgcctggaatgatcagaaggctctgaccgctggtcaggagatcgtgaccggctgcggcggggaggcctatcgtgtgatcgaccagaatgatctgatgccagtgactgaatttctgaaatgtctgttaataaaagggtgctacttattttcccacaaaaataattacagtcaagtataaggtactccagtaataatgaagataagctagtaagtaaaattatatataaaatggaagatttatgcattaatttcacctgccagcaatcatatcaatagtggtgagttgtctacaggaaaaaatgtatataaaacttatagattttgaaggtgtttggctggtagaaaattatcatttcattcaaagatgttcaatctccctagtattttaagaaaataggtcacttagagggaacgttcaaacagaatcacactcaccgtctctctcagaggcattagcagagtggatgctgtcagaaagatcagggacattcaatagcgtagcccgttcatctctttgaactaccatttttaatttgcctttagacctttctatcaatgtctttgcatctgtcaatgacatattttctgtcacagtaccatttatctgcaacagaaaataaattacagcttgaaagtaaataataaaatacaaatgttaacttagtttgttataaacagaaatatccaaaccactccttgctatgaaaaccaaaatattctctctacacttttccaaactgtcaaagtattccaccttcttgagatgataaaatctttactgtactgttgctgtcagaaaaacccatagtagcatcccctaactccttctttgaggctgtcactttctattacttataaacaaacgaataaataagcatttcaatagtatctggaagcaattatcagaactttttaatgtgtaagaacagacatatctatctacaaagtagtaccggcctgtgaataattatctcaggatgaccctgtgatacctaaagcattggtgtcgacatgtaataatgcataaagggaatttatatccctctcccccaaacactgatttttaattctctttggcaaaactgcttcaaacaagagcacagactacatggtaactctagaacttgttttctatttcagttcattaaaaagtaagaatatgattataccttcaatacaacatcaccttcttgaatattgccatctcttgctgccaaactatcttgtgaaatttccttaacaaatatatggcttgccaatcgaagaccatattctgaaataatgtaagtaagtgtttttagtataacatcctaagacacctaaatagattttacaagtatacaactaaactaattaactactgcatagagttttcaagtacaatcaataacaagaaatatttcttggccatcctgcaaataagacattccctctaattagcaagtctgcaatgtctccgtgaaagccaagggaaagtgtatggttcaaacgaaggactgatagaccgtgttcccatattactgaaaaggagaaaatccccaagaggacaccatttctttttgaccaagcattgatacactagctcttcagaatgattaaggaatacaattttctttaagagacagggtctcactatgttgcccaggctggacttgaattcctggggccaaaaaaccctcctgcctcaggctccagagtagctgggactaacagacatgtgtcacactatgcctggctagagatataattctaaagagtaaactgcttgaggtttgaaaaactttgaaaagattgaccattttattgatgactattatcatgcatatactacttctatttttcccagctcctagaccaaaaatatttctgatcctatacaccccatgacactggatagacatactcagagtactagcatgtactaagcatgagtgcaaaggcttacaaccagccaggcagatgtgggcaggagttataatgccaatcctttcctttaaacaaccaacaaagtatccaagagtgagaacatcactccgtctgtgggtaaggaatgttggaagttgaggaaattactagcagagtccagagaactgcccaggttcctgcaacagctgcagaaaaacatattttaagaaaaataagaacaatgactacaactatcaatataatgtcaatagtaaaaggattgcccctggttctgtgaggagagtcttactgcattaaaaacaaaatcaaaaaccaagatggaaaacagaaaactgttttaacatgggataaattaacagacctattacctaagtgtttaaaaattacataagagtaggctgggcatggtggctcatgcctgtaattccagcactttgggaggccaaggcgggcggaccacaaggtcaggagttcgagaccagcctggctagcatggtaaaaccgtctctattaaaaatacaaaaaattagctgggcatggtggtgcacacctataatcccagctacttgggaggctgagggaggagaactgcttgaacctgggaggcagaggttgcagtgaactgagattgtgccactgcactccaagcctgagagagagagtgagactccgtctcaaaaaaaaaaaaaaaaattacatcagaattacagtttaacttaagacaaatatacaaagagtactcacagccagaaatagaatcagggtgaagaaaacggccttttaggatatctgggcaaggaatgaggcagtcatccatatggtcattacatcacagaaggatagggtattggttaaaagactgttcttcaagattaaacacttataaatgaccattacacagatgaccccaaaatatttcttgtatattagtttgttcgttcattctaaatatttcttggggtatatatgaactaggtaccaggcattagggagaaagcagcaaatgagatagttcctgcactctggcaatttgcagtcagtgaaaaaaaggatgttagcatggtaatcccaaatgcggtgagttcagagggcagaaacacaagggttcttcacttactagggggaaggagaaggccgccctgaggaagatatactaaagttaaaactttacctaagaaagacctaaacctgaagggtatgtttgtgggggaggggatgcatggggtgagtgacggctgaaaagttcaaaacaaatgcatcaaagtaatgaagaaaaaaacctggtggacctaatgaagtcataagtctagtgtagctgagactgagaactaataaagaaaggggcaaaagagtaagacagaagtgtcacagaggatctatgaagaaatctgcagaatcaacttaaagggatccaagagacaacctatgagaccaaatgagtctatgtaagagatgacagtggcttggaaaagggtggaggcagtggagaaagagtgggatggataagagtggtattcaggagtgaggacattcatcatgcatgggaaaaaaagagaaggcaagggtaactaccatgtcatctgggaatggcctgagaaactggatcaatagaaacacattcaactgaatacttcatgagaaatacaaagaaaaattttaagagggagatgagtttcatttgagatgtgctgtgtttcagggacctacaggaacatctaagtgaatatgcctaacagttggaacacaagagtgtaaagatttgggctggagaaagaggttctgccatcatcagcagtgactggaagcaggggagcagatgagattgcctaaattaattgttattcaacctgaggaaaagaaaaaaaaagttaccttaagtggaaaaaaagattctaggagagaaactgacagaacgttataaagggcagggtgaggagaatgagcttgcaaaagatacagaaaggtgggggaaaaaaacagaaagatacagtactaccaaagaagacattatttttgaaaataaggagtggttaaccatgtgaaatgatactgaaaaggcaagcaagctagagactgaaaaacttccactagatttagtgtgaacatttttgggggcagagcggaaaagataccagaccagagaggattgaggggtaagtagtgaagtaaaaacagcaaatgttgacaacttcactgagacttcactgaatgggggtatggaataccacctaggagatatgccaagtggtaaagcagatcaaagtaagtcttgataatattccaactgtaacaccctttatatcaaaatgatcagtcatgcatgcccacagaaggagcaagccacagtcagatccattttttatcaaatttaatgaggcatgagggaaagcagctgagtttcagtttcaaaaacttcaaagaagtactgcattatggagaaatgctctataaggggttcctttccttaaattcctccatttaaaaaaaacagtctggagtgagggggaagaagtcccagcagggcacagtggcttcccgcctataatcccagcactgtgggaggccgaggcaggtgaattgcctgagcttaccaatttgagaacagcttgggcaacacggcaaaaaccctgtctctacccaaaataaaaaaattagctggacatggtggcatgtacttgtacttccagctaccagggaggctgaagtgggaggactgcttgagcctgggaagcagaggttgcagggagctgagattgtgccactgcactccagcctgggtgacagagccagaccttgtaacaacaacaaaaacaacaacaacaacaacactcccaagatttctctccatgattacactactaacagttaagaaaaacactgaatttccatttggtgatggtgtgacatttcttgttagcataatttgtacctggctattctcatcacaacaaatccaaaagccaagccctggacaattcacttgaagtgttatctgttccaacggaaaaaatgaacagtccctgaagcctgccataacaggatttgacttacagtgatagaacacaaacacaaagacaacaaagcaaagacatgaagagacagcaactgtacttctcattaaaattagttttaaattttcatgtgaaaaaaacagcaagagttggcagagaataccttcatttttccgggatttcaccagtgtgactttagtaggtttagcaggctggctggaagccactgaccgcctgtctgaccgcggggacaagctcctctctctacttgcacttctatccctcggccaaatcttctcactccttctgttaaccacaccactccggccacttcttggatcatgtatttcctcatcataactatcttcttcattatcagatactggttcaggatcaggacgacttactggtatttgaactttcttcttccttctaattgtctgcaagttaaaaaggttaaaaaataagttgactgattttcatatatgtacgttcagttccaaagagaaaggaatattacacttctcatcccatattaactatgaaccagcaagaaacaatacacaaacaactacaacaaatttctaaggaatacatttccataaaggctgtgttttctgttctcctgataaacagatctggttaagcacaaataagaacgagtgggcctaaaaacctctttatttacttcacacagaaagatcttcctggtgtaataatcacaagcttacagggaaactaacaactgttggtggtttgaataaaaaggacagcactgtactctaatgccatcaaatatactctaggtgctaccaaaaccacagcaaacttccatgcccaacttgcttccttaaaaattttagaatgcatcaatatcaaagcccacaattgccccagacctctaagagataatttattctatagccgcactaacattcaataatatgttggagctaattaactcagccgtacttcaccaacacaaactgctttcagtctctggatctcttcaatttgtactcccagtctaggtgcaaattcttccctctggcgttcttttctcaatgattctggtaactggctctgtattgcctgtccacttatttccttcattctctgcaagctgacgatctacatgtattacacctgctgactgaatggccctgtaatctgtggactacactttgccttctcacaatagtatacacttgacctcactgtagttctacaggatctccttgtgtatcactccttgtcttctatgtcggacaccttgagctactgaaacttttcactatcttatttccaattccttcatcttagttcatcagttccatcctggtttcactcgcattccccctaagtttgcatgagacatcctgttgccatatttaaatgactttttcttgacccctcaatcatctgccctgacaaactccagtcctattattaccttcacttccacactttgctgatgaggccctctgtaaattcattttacagaagtcttgctcttgttcagcaatcctttcatctacatattgttgcctctctgtggaattcgctaatgtaggtattctacaaccattcttcaagatcccagccactcagcctgctttaagatcagtgccattttactccccctcccctcctaaattttttcagtatttcccctcctaaattttttcagtgtctcatttatttggtcctctttccttctggtctcaaagaccaaggcaatcttctccctggatgaacaaaacccttgtatttgagctctcattctcatccctacctacctctaagacttttttcttcatcaattaccatactccaggttacctgaaacttcaatctctttatttacctaaaatctgtcctctacctactaagctcccccaattaatcttctatttctctgtcttgctattcacctgcatgttatcatcttttctctcttctctatgtgcctaaacttcttcaaagggctgctctacacttaatactactgcttcctatgactactactattattatcagatactggttcaggatcaggatgagggcctgagcagagggccattctgaggaaacaacgctgaagctcaaggatgagaaacagcagaggccagcatgtgaaaaggaggacagccaatgccctgttatgaactgaaagagaaaggctgcccttctcctattggagcaacccacagctgaagtccttatagggtaatattttctgtaaagcattcctaatgctagctgcctgcttttacatctcacttctatttaatttccaacatattatattggaagcaatacctggtattagtattttaatcttcagttcctccctagtaataaacaaaaacaaagttgagcagatgagcactcaaggctttccctatcattcctgtaagagtgcgccacctctttgggatcctactgtacctgacctatcaacctgagatgacgtgcattatatggttatcagtatgtatacctatccagcccactaagatttgagttttttgagaagttccttaccatgcatttaactgtacatataatgcaatgcttgcatctagtaggtgcttaacttattgaaaggtaaccagtcctattgtgattctctacttatgaatcaacagttataaacatgaataataattagtaggtgtgacaactatgctcgattttaacactatgaaaaatttggaatcaaaatatttaggaaaaaaaatgcctacttcaaaatagtttagcttaactaagtctcaaaggtaaaataaaacaaaatgatgccatgtaagtactagaaaaaaatacaacagagaggcttttgcaattaaaaggcttttggaagcatgacaccaaggcagaaccaataaaatgaaagtctgacagacatgacaaaataaaaatgaaaacatttcaatgttgtaataaaatgatacaaaacaacaaacacaaacaacttacaagcattcacaaaagcaaagaggataacaacacatgaggtatgtatgacaaaaggctaataatctgactacagaaaacactctagtatgaccatcaccaccatataaatgcaaaggacatgaacaggtaaatgaaaaaacaaatgggtagtaaatacaccatgagaggatcaaatccacttgtgatttaaaatgtttcatttgaaacacttgtttagtttatcagtttggcaaagatttaagacctgttgaaaactgaactctcaatagcctattgattttctgaaggacaaactggcaatacatacatcaaaagtcattcaggccctttgactctgaaaagtcactcctagaaaattattctaaacattaactaaacaagtaggtagtaatatgatgatttttgcagctgaattttaaaaaaatacttgcggactggacactgaaatgcctgtgaatgagtgggttggataaatatatatgcatagtgaaatgctgcatggccatgtggatacctacacagtcatgcaccatgtaaaacaacggacagcacgtactgcaggggccccataatatcacaatggagctgaaaatctcctatcacctagggacgccacagggtcataatgtcgtgggtgcactgcagtacttatgttggtggtgatgctggtgtaaacaaagctactatgctgccagtggaatagaagtgtagcagatacaatatgtacagaatataatacttgataatgactatgttactggtttatgtatttactatgctaaactttttatcattactgcagagtgtactccctctacttatttttttttctacatgttaactgagaaaacagcctcaggtaggtccttcaggaggtgttccacaagaaggcattattgtcacaggagatgatggctccatgcgtgttactgcccctgaagacctcccactaggacaaactgtggaggtggaagacagtgacactgatgaccctgatcctgggtagccctaggctaatgtgtgtgcttgtgtcttagtttttactaaaaaagtttaaaaagtgaaaaataaaaaattttaggctaggtgcagtgcctcctacctgtaatcccagaactttgggaggcggaggcaggcagatcacttgaggcccggagttcaataccagcctggctaacatggcaaaaccccatctctactaaaaatacaaaatacgggcttggtagcggtcgcctgtaatcccaaggctgaagcacgagaatcacctggaccagggaggcggaggttgcggtgagccaagatcacgctactgcactctagcctgggtgacagagcgaaaccgtgtcttaaaaaaacacagcctgtaatccaagcactttgggaggccgaggcggggcggatcacgagacagcctccatcaggagatcgacaccatcctggctaacatggtgaaaccctgtctccactaaaaatacaaaaaaattagctctggtggcgggtgcctgtagtcccagctactcgggacgctgagcttgcagtgagccaagatcgcgccactgcactccagcctgggtgacagagtgagactctgtctcaaaaaaaaaaaagaaaaaaaccaaaaagaacccaaaaaattttaaatatttttgtacagctgtacaacgtgtttgttattacgagagtcaaaaagttagaaagtttataggttaaaaaagtttcagtaagctaaggtttattattgaagaaagaagacttaaataaattttataaatttataaaatattaaatacattaaaaatattaaaacgttaaaaatttagtgcagcctaaatgtacagtgtttacaaagtctacagtagtgtacagtaatgtcctaagatgtcacattcactcaccactcactcgctgactcactcagagcaacttccagtcctgcaagctccattcatagtaagtgcactaaacaggcatataatttttttatccactatatatttttactgtactttttccatgtttagacatacacatacttaccattgttttacagctgcctacagtatccagaacagtaacataatatatctattatgagaagtgaattatcaggcaattctgtctttgtgtgaacatcacagaacgttatcttcccaaacccagatggtatagcctactacacatctaggctacttggcatagcctattgctcctcggttacaagcctgtacagcatgttagtgaactgaatactgtaagcgactgtaacacaatggtaactatgtgtgtatctaaacacggtaaaggtaaatacagtactataatcttatggaaccactgtcagatatgtggtctgttgttgaccaaaacattgtcatgtagcatgtgactgtagaggaggaaaagaggaggaaacattaagccaaaaagaggtaactatttggccgggcgtggtggctcatgcttgtaatcccagcactttgggaggccgaggcaggcagatcacgaggtcaggagatcgagaccatcctggctaacacggtgaaaccctgtctctactaaaaatacaaataattagccgggcgtggtgtcaagcgcctgtagtcccagctactcaggaggctgaggcaggagaatggtgtgaacctaggaggcggagtttgcagtgagccgagaccgtaccactgcactccagcttgggcgacagagcgagactccgtctcaaaaaaaaaaaaaaaaggtaactatttaactgtcccctttcctttttcaattgaaaaaaatcctggtatctaaactgagaaaatacacgtaccagtgacataccacaccagtgttagaagaaacactcaagtgtaaacaaataactttggaactattgtttcagttttccttaaatgggaaggataaattcaaataccagaaatgtatcaacaataaagttggggtacctttactaaattacagagaaaagatacttacaatttttgcatttttcccacttttccttagttgctgaacagcaaaagcatgttcaacattatccattgaaactccgttaaccattgcaactcggtcattttccctaaggggaaaagggcacaaaataatatgttagagaaaaacattctggtaagtttatgatgatatttccaagataggtacttctaaaatgtaatctaattatgagccaattaattaatttctcttcagatcaatgataaaataatgtcaactgacttactttcagatttctctgcagaatgtttaacaagtaactaaccacaggtccttaatttttttaagtcattaacaaagtatttccccaaaagactgaacagatatcacatacacgaaatgattcttggtagtacagttacagggcattaaatgatactaagtcatacagctggaaaacttactcccttttaagtttttcatcttttaattctcttttaattcttctaattatagtgccactattttgctagtgtattttgtgtttctctttatcttactaatcttcatagggaataaaaagggtggcaagacttggggaggaggcttctgaaggctagattctacccaaaaggagttatacattttctttttcactatttttacagttacacattctatttaaagtgagtgatactagctttccaattttcatagggataaagcttcctttattttctttggagacagggtctcgctctgtcacttgggctggagtacagtggtgcaatcatggctcattgcagcctcagattcttaagttcaagggattctcctgcctcagcctcccaagtagctgggactgcaggcacaagccaccatgcccagctgatttttaaacttcttttgtagagatggggatctcactgcattgcccaggctggtctcaaactcctggtctcaagtgatccccctgcctcagcctcccaaagtgctaggattacaggagtgagccaccacacctagccagtttccctcttaatatatgttaatttaaggaaaaatatatgaagcatggcacaggtggagtgtgaatatgacaaaatcactaagacagtgtaagacagtacgccagtgcctgaggagaggaacactgcttgttgcacagtgcccacgataagcagcactcttactgtagctgtccttcagctggtcctcctttcagcacatctgaaatcactattgacgtttccccactctgaaaatgaggattatctcgtccaccagatattgcaattccaaatccaaatccaggagcctaaagtaaaaattacagtaaaatattgctattaaggacaaaaataattgttatatcatactctacaatctagagaagccaaaatataaaaattacaatcttaatatatctgtgatccataaacactcacctgcatggttacctattagaattatccttgtacaagaatgcatgctctaataactactggacataacagaatattaaaaatcgccaactatatacatgttctttaaaaaccaaaagacaattaaaaattattaacactgagatcctgactttatttttgatcagaagaggtcctgaggagactggcagagcccagtgtgatcatcagccatcctggcaactgatttagaagatgacagacttatccagcatacacaccctttgtcattttacataaatatcaattgctttgaaaatcaagtattagttatttcaacttctttcaacaacttctgccaactcctaaaaatctctgtagaatataatgccttgtgcacactatacaatagaaggtgtacattagccatattgaactaacattgtaaaattacctttttaaaaaactaaattataataagctacacacttctgaaagagccaagaatctttaccacaatgactcaggacaggccggtatagaaaaaattcaaaatattttccaggttgttaaaaaattacctaatctcaaagaaatcactattccctagaaaggatatgaagtacttaagagtagtttaaagagacaatatacattttcttaaggctacagaatcattaagccagaaatgtatgtttttgtataaaactgtacaattcaaactgcctgaggacaaaggtaacaacttcctccctcagctttccagtccgcaacagaggagactattttcaccatgaatagtgcatacatcacctttcctcccatcccaaagcctatagaagtagcaaaagaaaaaaaaaaatcttcttaaaaatgaataaataccaactattccaagtgtccatcaactgatgaatggataaaacgtgatatatatccatacaatgaaacattgtgtgtaaaaaggaatgaagtactcatacatagtataacatgaatcaaccttgaaaacatcatgctaaggtgaagaaaccagtcacaaaggttaatagattctattattccgtttatataaaatgctcagaaaggcaaatctataaagacaaaaacctgaatggtggttgtctagggctacagggattggagggggtgataattcaatgggaggtgttttttttttccccagtaatgaaaatgttttaaaatggactctggtgatggtcacacaactcggaacacgctaaaaaccaatgaactgcatactttaattgtttggcatgtgaattatatggcaataaagcgaacacaaaaaagttaatatgaaaaaagaaaataataaaacagggaaatttctgagtaactgaagataatggcaaccatctgaatctgtttctctatatattctcccaaaatttaatagaacaaaaatagaccaactacagtggttctcccttatcctcggtttcatgttctttgctttcagttacttcaggtcaactgcagtgtgaaaattttaaacggaaaacttcagaaataaacaattggtaagacttaaattgcacaccgttatgagcagtgtgatgaaatattttgccatcctgctacgtcccatctaagatgtgaatcatccctttgtccagtgtctccacgccataggggctccccacccattagttactcagtagctgtcagttatgagatcaactgtggagaggtaacacaatgcttgtgttcaagtcacccttattttacttaatcatgaccccaaagtacagtagtagtgatgctggcaattcggtataccaaagaaaatctgtagtgtttccttcaagagagaaggcgaaagtcctccatttaatacagaaaaaaaaaaaaaaatatgctgaggttactaagatctacagggagaaggaatcttctattagtgaaattgtgaaggaaaacaaaatttgtgctggttttgctgtcacacctaaaattgcaagggtttcgccacagtgcatggtaagtgcttatttaagatggaaaaggcattaaacttgtgagtggaagacaggcacagaaatgtgctccaattaacagcaaaactgggtttgatactatccaagaattcaggcatccactgggggaacatacaccccatggctcagaggggactactgtacacaaaaccatacactcatcataattcaaagacaatatccaaatttcaaattaaaagcaggactaaaacttcaaaaataaacaattagagacaaatgactattagaacagcattagaaaacataagacactacagaacaaattcaaataaatttgaaaacctaaaggaaacataattcctgaggaaatatagatggccaaaattgaccctattataaataaaaggcttaaacggcccaatttctggagaaaaaagcagcaaaatttatgagggaattatcccacaaaaaggcaccaggcgcaaatgatttcccagagaaattgtgccaaaacatgcaatatccagacagcctcagtacaatatattgtttcagaacactgatatcaaggaaagcttctaaattctttttatgaagcaagtataatactgacactgaaagctgatgactgtccatgataatgactaaccccccaatattacagctcaacataatttatttgtatcagtgcaaaatacaaaataaaaataagcaaacaaaggccaacactacataaatactccatgaaaaagggattaattccaggaatgcaggattagtaggaaatccactggcataatatatcctattaataaatctagagaaaaaaattatatgattatctccaagatcctgaaaaagcctttgacaaaatttgactttcaccgctgaagagaaaacaaagtttgtgaaaaggcactgtaacaaaccctgtaagtatgttgctttttgttaaagtacacaaagaaaatccagcttttcatacacagatacagtcattgaaaaagaagagttattttagtagcctttttaggtaattacgaaaattcatgtttgactttatgccaaaaacttaataaatgatagtttcctaaaggagagtaacaatgtacagtttgaaaccatatcattcaactgtctgtactgttgcatgaattatctattggcctattttacactctgaatgagtattttatccatgtataattttactatagcatgccttagtctttcggaaaatactggttccctgagttaggtaaatcttccaaatgatgccacatttcaccacacagtgtattttaaaatcatgtgttaatatcactatcaaggttatcaaaagagtctttaagtactgaaaagctactgagcttatggtggcagataaaaatttctcaaattttaaattttgttttaaaaatcagttttcattgttagcaacaaatactatcaagaattgttctccttgaagcaaggtactcattcattttggagaaatatgtttgtcaaatattcaagtttggataaccatacattccttcaagtaaacaattgttcaagtaaaagtgatgcctgccttccaccccccccactcaatacacggctgcaattcaaataatcacacaagtactttagtacaaggcagaagtactttaggcacacttcctgtttgcatacctagactactgaaaacgtgtgtattcaagggttggaaagtaacaagacacagttcttactgtttcaagtcattcttaaataaaactgaaattgttcttttaatctacgagtgtgtgacaatgactattatacggtttggtgcccctgccttgatttgggctacaaagcccacagttttaaccgccattgtttctgaaccttcagtcaaataattacacagcgaagaagataagaaataccttcatattgaataaaaagagttttgcccttgaacctaaaaaggtttcagggacctttaggagtccacagaccatactttgaaaatgtcgatattaagaactacttaaacatgaagggagaaaaataaataaataaataaaacaatgaaacaatttacaaaagatatatgagatgttaaaacccacagataaatgcaaattaaaaccaaagaacaccaagaacagaaacattaaagtataacatatttcagaaaagggaggctatagcaaacagtctactactgatgggcacacaaattgctacaactttcaggagaggaatttggcagtaacctaacaaaactacaaatgtactattcttttgacagagcaaactaacttctagaaagtaccctaaagatacacatacctctctcacaatacaaaagtaacaaacgcacaaggttattcattgcagactgtttgtaattgcaaaatgctgggaaaacacctaaacaccccagccttagtaaacgattatcctttccctttttttctccttcaaagaagttggggctaatctttgtaatttagtaatttgaaaaattactctatgtaattttacagtatgaacttacatcttgtttggtagttattttattttcctcttttatttaaaagttaaaaacataaaaagattaaaaaaaaccaaaaacattaggaactttcaataagcaaggcagggatgcgagcatacatttaaaaaaattacttgtgagcaagtaaatgcagttccggcacctagtagggcaggtaatcctgctacatcagtgcttaccacagttcacttaatgactatccaggagccctgcgacttcttacccaggctgcaggtaagaatcacttgggaacaatttcaaaactgcttgctgatgcatgatcctcaatctataccaattaagtaaaaatggagaagaggagttggtggacttaaaaaaaaaaaaatagcccccaggtgattctaatgagcagccaggaacgagagctgcagctttcaatgttttctgaatataagatcagttcattaaaaatttcaaaaggttcaacttttccccactttcccttccctctaccttcataattgtcttatttggccctttcaacagatttctcacctccactgcactacaagtgttggcagtgctgtccctctaacacaaagaccctaatccaatagatccttgccccaagtccaaattccttagcatgcagtgcctttgaatacaactccaaacttgcttcccagcaccccagtctttgctctaaacccacctaaatactgattcctgcttagggagatcatgcaatatcaaactatggcttaacatctcctctctccctaggatttccttactaccttatcaatcttgcaagcttcagctcatctttcaaaacccaggttccatgtcacctcattcataaaactacccttggctttcacagaagtggtccatcctgtacatgtgctggggcacatgtacacacttgtgctacttaacacacagcacaagtagcctcggttagcaaggccctatttgggaggaagtcacatatttaaaatcgaaggctaacctgattaagcccgccaaacttaacctgtctttttcatcgcttacttctagttgatctattttaaactccccactagcaagtcacatagcaaatctcccacgaacttccttacagataacttccgaatgtgggtcactacagtaacggttgcttaaagttatttccaggaaccagttggcagctcttgtccacttcaagctgattaagaccaccgaaccttcaactgggcctgcatgaatgcccaaagagaggtgactgtttgatgtcagagggccaaaacctccttcctcagatcatggtgatactgccatttttcaaacatgcattctatgaagagctgtgtaacttgactacatgtatgcagatcctaactaactcacttttccttacccccaatctttctcccccacaccttggagaaccttggtactctattccaaaaacatccttaaaatcccatctttggagaggtgggtttgagatttgttctcccatctcctcatttggcagtcttgtgagtaaaatcttttctctttgccaaaacaagtcatcgcagtgactggcttgctagttcaatatattcgtatacatctttcaactcaatgcaaccctgcagaagcctgacacaaagtggttcacgaagttagtgaacctcaacaagtatttgattgattattcaatttaactttaattctatttccctttatagagactctttttttaaactagccctaattagagcactaaaaacagaattctggaaaaattagcagcaatgagagtaggcatgaatgaatcttcctgaataaaaacaggcagtcgactacataacaaaccaagaatccaagtgcaacatttacaacaaaactagggggtcaatgtatcccccttgaagtgcaaaatgcaacgaggaggggataaacaaccagctatggagacttccttagcatgtgaacgaagccatattctaaaacaaacaaacaaacaaacaaacaaaatcctccccgccacctcccgaaggaaaaaaaaaaaaaccaccacaaattacaggcaaaaatgagaaaaaacgatcagaatcaaaccctctataccagcagtcctcaacctctttggcaccagggattggtttctttgaagacaatttttccacagaccggcaggtggaggggatggtttcgggacaatccaagtacattacatttattgtgtactttatttctattatgattacactgtaatatatgatgaaataatcacaaaactcaccatattgtagaatcagtgggagccctgagctagttttcctgcaactagatggtcccatctgggggtgatgggagacagtgacagatcatcaggcattagattctcataaggagtgtgcaacctagatcccttgcatgcatggctcacaacagggttcacactcctgtgagaatgtgatgccgccacaggaggcagcgctcaggcagtaatgagagcaatggggggtggctgcacatacaggtgaagctttgctcacttgcccgccactcacctcctgctgtgtggctcagttcctaacaggccaaagatccgtacatctctgtggcctgggggatggagacctccgctctacataaagttactatataatggatactgagtagcagaataacatctctgcagacaataaaagtatgcctgaaagaaggcttaaaagagggagaggattaaaactgttattagcacaagaagatacaagacatgaaagaattagaaaaaatgtagaaatgaagaggaagaattcgagaccaaatctgaaattttaaaaggtcattttagataggaatataagaccaaaaaacatcttaagagaaaaagtaaaaaagaaatcaacctaacatcctaacattaaatcaacaatacatacgacattaacaacattacatacattaacaacctaacatcacaacaaaaagaactataggaacaagagcaaaccaactccagagctagcagaagacaaaaaataacaaaaagagctgaactgaaggagccaggcacgaaacaccattcaaaagaccaacgaattcaggaattgtatttttgaaaaaaaatcagtaagataaactattagctagacaaagaagagagaagatccaaataaacacaattaggacaaaggggataccactgaccccacaggaatacaagtaaccatcagagaatactatgaacacagccatgcacacaaactagaaaatctagaagaaactgataaattcctggacaaacccaccctcccaagactgaaccaggagaaactgaatctctgaacataccagtaacaaacgccgaaagtgaatcagtagtaaatagcctaccaactaaaaaaaaccccaggaccaaatgaattaatagctgctctacatgtacaaacaagagctggaacaatttctactgaaactattcccaaaaactgaagaggaggaacaataccccaactcattctatgaggtcagcatcatcctgagaccaaaacctggcaaagacacaaaaaacaaaacttcaggcaaattatctttgatacacattgatgcaaaaatcctcaacaaaatactagcaagctgaatccagcagcatattaaaaagctaatccaccacaatcaagtaggctttatccctgggatgcaaggttggttcaacatatgcaaatcattaaatgtgattcattacataaacagaactaaagacaaaaaccacgtgattatcttaatagatgcagaaatggctttcaataaacttcaactcccttcatcttaagaactctcaataaactaggcattgaaattgaaggaacacacctcaaaatagtaagagctgtatatgacaaacctacagccaacatcatactgaatgggcaaaagctggaagcattctccttgagaaccagcacaagacaaggatgccctctctcatcactcctattcaacacagtactggaagtcctggccagagcaattaggtaagagaaagaaataaagggcatccgaataggaagagagaaagttaaactaccctgtttgcagatgacatgattctgtatctagaaaacctcatggtctcagtgcaaaagctccttaagctgataaaataacttcagcagagtttcaggatacaaaatcaatatacaaaaaccactagcattcttataaaccaacaacagccaagagccaaatcaggaatgcaattcatatggaaccaaaaaagagctcaaaaagccaagacaatcctaagcaaaaagaacaaagctggaggcattaggttacccagcttcaaactaaactacagggctacagtaaccaaacagcatggtactgtaacaaagacagacacacagaccaacggaacgtaacagggagcccagaaataaggccacacatacgaccatctgatcttcgacaaagctgacaaaaacaagcaatggggaaaggattccttattcaataaatggtgctgggataactggctagccatatgcagaagattgaaactggaacccttccttataccatacatagaaatcaactcaaaatggatgaaagacatcaatgtaaaacccaaaactataaaaaccctggaagacaactcaggcaataccattctggacataggaactggcaaagattgcatgacaaagatgccaaaagcaactgcaacaaaagcaaaaattgacaaatggaatctaattaaactaaagagcttctgcacagcaaaagaaaccatcaaaagagtaaacagacaacctacagaatatgagaaaacatctgcaaactatgcatctgacaaaggtctaatatccatcatctatacacaattttacaagaaaaaaaacaacccccattagaaagtgggcaaaggacaagaacagacacttttcaaaaaaaaaaaaaaaaaaacacgttgccaataatcatatgaaaaaatgctcaacatcagtaatcatcagagaaatgcaaactgaaaccacaatgagcggccgggcgtggtggctcactcctgtaataccagcactttgggaggctgaggctggtggattacctgaggtcagaagttcgaggccagcctgactaacatggggaagccccatctctactaaaagtacaaaaattagccaggcgtggtggtgcatgcctgtaatcccagctattcaggaggctgaggcaggagaatcgtttgaacccgggaggcagaggttgcagtgagccaagattgtgccactgcactccagcctgggcaaaaagagcaaaactccatctcaaagaaacaaacaaaaacacaaagatatcatctcacacctgtcagaatggctaatattaaaaaaagtcaaaaaaaaataacagatgctggcaaggctacagggaaaagggactgcttatacacgttggggaaggcagtatggcagttcctcagagctaaaaagaaaactaccattcgagccagcaatcccattactgggtatatacccaaaggaatataaatcattctatcataaagacacatgcacgtatatgttcactgcagcactattcgcaatagctaaaatgtggaatcaacctaaatgcccatcaacgaaagactagatgaagtaaatgtagtataactatgcagccataaaaaagaataagatcatgtcctttgcaagaacacgggtggaatgggaggccatcatccttagcaaactaacacaggaacagaaaaccaaacactgcatgttctcacttataagcgggagctaaattatgagaacacatggacacagaggcaacacactggggactaccggagggtggagggtaggaggtgggagaggagcagagaaagtaactattcggtactaggcttagtactaggtgacaaaataatctgtacaacaaacccctgtgacacaagtttacctacataacaaatctacacatgtaccctgaacctaaaatgaaagtttttaaataaacaaataacatttttaaaaaaaagaacgccagagattttataaaaaggatttgaggaacattacaaacactaaagacaagcaaaagcagcatgatatatatgaacagtaggagtccctaaagaagcaaatcaaaagaagggaagagaaaaattagtttaaaaaacaaaaaaaacttcgctgatactatttttgaaaaaattgaaactaggtactgaaagagtttacatcactgtaaatatgtgagttatctgagaatatcaactcaggaggactaataccaaaaatatatttaaatgactaaattttaagaaaaaagaaatagcaactcaaggattttttttttcttttgagacagagtttcgctcttctcctccaggctggaatgcaatggcttgatctcggctcactgcaacctctgcctcccgggttcaagtgattctcctgcctcagcctcccaagtagctgggattacaggtgcccaccaccaagcctggctaatttttttttgtatttttagtagagatggggtttcgccgtgttggccaggcttgtctcgaactcctgacctcaggtgatccatccccggcttccaaagtgttgggattacaggcatgagtcaccgtacccagccgagtcaaggattttatattcaacacaactgaccttcaagtacaaaaaacacaaataaaccagtcaacatgcaagaacacaggaaatattgtctttatgatctcatcctaaggaatctaataatattctgacaatcaaaatgacgagatacatggataggactggtgataagcatcacatatatactgtacttatttataacaccaagattaaacgaggattaaagggttaaatgatgtaacagctatatgatctagatatggtaaaaaccattttaaaacagagaaataaatgatagcatgtgcaaaaaaaaatttttactgtttccagtaatcaaagttgacagaggtagattactctgaggcaataatatgctctctgtattagacttactaagagactatcatggtaccttcccaaggggttttcaaaagaaatggaaaatgtgccatttttttctcatctatcttcaacgtaaaaattgtatagttctgccaagacagttgatttttaaaagtatgtttacatgagaaaatgtacaggataacttttagcttctggggatggaagaaagagcatcaaagacttgccgtatttcaaacttttgaaaccttaagcaaccatgagcagcaataacttctgtgtttatatgtctacgcctggctagacaactgaatttatgttagaacttggaaacagggtcctggaattttttcagttatgtgtcctgttttactggacactagccatgcccattcctttacatataattatgactgcttttgcactgaacagttccaacagggaccttgtggtgcacaaagtcaagctatttacaatctggcctttcacacaaaaggtctgcccacccactggttaaagtatttcttggttccttaaaaaaaaattcctgaaagttgctcctgtttcagaaataactgcttaatttattctccaaagattcctctctgttcctattgaatatgcccaattacctacttaaggattccacttgttgccttttattttattcttccatttttccatattaggcttgtacaatccgctaattataactttcctcactaattctagtcttacttttctcctcttattcttcctattaacctttcaatggaatttcaatgaacattcaatggaacctgttctagccatttgttttcacagtggccactgagatcacagaatttgaaaaccagatggagcctcagcaattgtctgttccagctcccttcttacagctgaagtcagcaggcctgggtcctgtgtgtctctatactacttgccaatcatgaccttatggaagacctccacagatttgagttccctcatctgaataagagagattttaatgttatcaactttaatatactttgattccatggggatcccaagagatttaaaggccttttcaaaattagttagtggtaagcccaaacagattagaagtcacaagatccaagcactgcagattttctaccaacttggtagttctcaaaatgctgttcaatcttctatgactgtcagattgattcggttttttaacagttatgtcccttggctagtcaaattgtgtgtgtcttcctgtttattcttactctcattcttttagttctgatacccaaatcatagttttcatttctcattcctgttccattttcttatttccagcttcttacagaatacctccaagtccccttctttaagactgtcattttctctataaaattagcctcaccaccaatgttctaaacaaacattggctcctctattgccaaattacctaccctttattttatttactttattgcatgtatagagagacctttgtttagtttatgtgaattacatgagttcttaatttcagaaattatgttccataaactttttgttttttagagacagggtctcactctgttgcccagaatggagtgcagtggtgcaatcacagctgactgtaacctcaaactcctgggttcaagtgatcctatcgcctcagcctcctgaagtaactgggactacaggtggacacgaccatgcctggctaaattttttgggggtgtgtagagatagggtctcactatgttgcctccactggtcttgaactcctggcctagagtgatgctcctgccttggcctcccaaagtactggaattacaggtgtgagccactgtgccagccacatttaaaaactgtaaattaaacgtgacatataaatggaaagagcactgtatgctgagtccaaacctgggttcaagttctcgctcttaaggggcattttactagacctttctgagacttaccttacttcacatggttaacacctacttcacagacaaatataatgaagggtctgaaaaacttataatgtactaagtacaaacaatagccttctaccagataaagggagtgtatcttagattacatgtttgcttcagcttaaatactttatcagacagcagtttggagctgcttgaccgataaaattccttttatcactttactgatatataattcatatatcataaattcactctttaaagtgtatgattcaatggtttttagtatgtacacagttgtaaccatcactggttacagatggtgccaggacagctggttaaccacatgcaaaataatgaatttggacccctacctcacaacatctacaaaaattaagtttaaagaaccataggtctaagtataagagcttaaactctaaacctctttgaagaaaacacaggaataaatcttcatgacctgagttaggcaacagcttactgaatatgatgtcaaaagtataagcaacaaaagagaaaacacatacattggaccccatcaaaattttataacattttcaccaccctaaaaagaaactccgcattctttagccatcatctctcaatcccctagcctcatcaaccactaatataactctctattcacctattctgaatacttcttataaatggaatcacataatatatgttcttttatgactggcatctttcagttagcataatgttttcaaggttcatcaatgttgtggcatgtatcagtacttcatttctttttattgctaaataatattccattctatgtatatatcatgtttattcattattcatcagctaatatagccagatctattatgaataatggtgccattaacactcatgtgtaacttattatgtagacatttgctttcatttctcttgggtgtatacctatgagaggaattgctatgtcccataataattctatgaggaattctcaaactgttttctacagcagctgcaccattttacagtcctatcagcaatgtacaaaggttttaatttctccacatccttgccaacctttattgtctttctgagtacagccatcctagtgggtgtgaaggggtatttcactatactttttgatatacatttccttgaaggctaatgatactgaacatcttttcatgcatttattgcacattcatacatcttctttgaggaagtatctattcaaatcatttgctatttttcaactgatttgtctttttattgttcagttataaaagttctttatatattctagaaacaaatcccttatcagatgtatgatttgcaagtatcttttcccattctgtggaatatcttctcactttcttgatggtgtcctttgaagcacaaaagtttctaattttgatggggtccaatgtatctgttttcccttttgttgcttatacttttgacatcatatccaataaaccattgcctaacccaggtcacgaataattatccctgtgttttcttcaaagaggtttagagtttaagctcttatacttacacctatggttcatttaaacttaatttttgtaaatcttgtgaggtaggggtccaaattcattattttgcatgtggttaaccagctgtcctgggtctgttaatgactgttcttccctccagtgcattgccttggcaccccatcccaagtttacctcttatgcaatcacctccctagtttaaacactcactggctcacccttaaaattacctgactagtttccttgctttctatactcatcttttaatactttagtatacaaatatttaatcttttacataattctattttagaaaatgaaaaagcagagtaacgacgagcaactcattcctgaggaattcacttcatttcccaaagaattagaaaaatgtatgcattttctaagggcgagtatctgaaaactaaaaaggtgtgggtgtgttacagcagcaggagaggtgaacacatgtggttaccatctgaagctacacacctacactaatacgataagcatcagacttgtgactattaagcacttcaaaaatggctagtgttacctgaaaggtgctgacattgaaaagtgaacaattttgtaagatcaactcatcaatttttaaacttatcacatgttgaaatatattttgtgcatactaaataagacctattataaagttagtttcacctgtttttctttttttttacagtttttaataagaagactaaaaaatttaaatttacatatgtggtttatattatactgctactgggcggtgctgttgtagacctcccaagagtgactttattcgacatggttagtgtcctagggaattaagttttttggggcagaactaggtaccaagcactaaggagatagaaaacggacttaagatttccaacccttgtgaaagttataatgtagtaggagatggggtaaacaactatctgatgtacatattcaactgtcactgaggaccagtagagagatcagaatccatgaggaggcaaattctgcctgtttttttctgatataattccagggcccacaagagtacaacagtgcttggcatacagtagaacactaaaaaattacttagtctttaagaatgaatagggtttcaatggtttctagaaatataagatgaagaaaatatcttctggaaatacaaatgaaagaatgaagcatatattattctagacagtaaatagcagaaaatgttaggttctcatcaattaaatggcttttttataacattacctccaactttcataaaattgactgtcagatgtcaaagaatatggatttgtctttatttggcaatacagagtatctatactccaggttattgccaaaagaatacagtttcaaattatccccttcacttactaccactgccaaaagcccacttgctcacctcagagagaacaagctttctgattcctctgtgtttcttaaaagtgggatgccagaggccatagccctccatttcaaactgaagcctatttaaaatacgtgttagggatcccagcccagacaaactgagtaagaatctctgatgggcagggactgtgcagttgatccctctttacaataaaacctggagagccactgctctaatcagcagtcagcacactatggcccacagttggaatacagccacattcgtttgcctgttgtctatggttgcttctacaatacggctgcagggttgagtagttttgacagagatttatggtctgcaaagcctaaaatacttatttactatctggctctttatataaatactttgctgatcctgctctagatagtctaaattttattcggcatcatcttagaacaccaaacaactaagacagttgaaagtaccattctgtagcctcagagaatgaagtcaattaagttatgctttggcataactcagctcccactggcaagactttttcattgtccaaagattttaaaaatgtttttatttttaattattatagtaaacagtagttgtatatatttatgggatccacatcatacattttgatacaagtataatgtgtaacgattaaatcagggtaactgggatattcataacctcaagtatttatcatttctttgctgttacgaacatttcaattccactcttctagttactgtgaaatacacaataaattaacgatagttgccctattgtgctactaaacactgtatcttactccttctaaccatatttttgcacccattaaccaagtcttccatccctacttccctaccacccttcccggtctctggtaaccatcattctactctctgtctccgtgagttcatttttctttttttttttttttttagttcccacgagtgagaaaatgtggtattcgtctttctgtgcctggcttatttcatttaacgtaatgtcctccagtctcatttatgttgttgcaaatgacaggatttcattattttttatggttgactaatattccatggaacatatttacattttctttatcccttcatcaactgatgtacacttatgttgatactataacttggctatcacgaataatgctgcaataaacatgggagtgcagttatccctttgatatactcgtttcctttttttttggacggagtctcactctgtcaccaggctggagtgcaatggcgcgatttcggctcactgcaatctctgcctcccgggttgaagcaattcccctgcctcagcctcctgagtatctgggactacaggtgcacaccaccacatttggctaattttttgtattttagtagagacgggatttctccattttggtcaggctgatcttgaattcctgacctcaggtgatccgctcaccttgccctcccaaagtgctgggattacaggcatgagccaccgcacccaggcctttctttgggatatatactcagcagtggaaatgctggatcatatggttgctctattttcagtttttgaggagcctccataatattctttttttttttttttttttttttttgagacagagtctggcactgttgcccaggttggagtgcagtgcagcaatctaggctcactccaagctccacctcccaggttcacgccattctcctgcctcagcctcgcgagtagctgggactacaggcgcccaccaccacgctcggctggtttcaccgtgttagccaggatggtctcgatgtcctgacttcatgacccacccacctcggcctcccaaagtgctgggattacaggcgtgagccaccatgcccggcctccatgctattcttcatagtgactgtactggtttacattcctatcaacaacgtataagagttctcttttttctgcctgctcactagcatttgttattgcctgtctttttgataaaagccattttaactgggatgaaatatttcattatactttcgattagtatttatctgattagtgatgttgaccattttttcatatacctgttgaccatttacccatatgtcttcctgagaaacatctattcagctcttgtgcttcagatcttttgcccatttttaaattggatttctttttcctatcgagttgtttcagctccttacatattctggttattatctcatcagttgggtagtctgcaaatattttcttcattctgtgggttgtttcttcattttgttgactgtttgttgtgcagcagctttgagcttgatgtgatcccactgtccattttgttgtggttgcctgttctttggaggtcacactcaagaaaccttagcccataccaatgacctttagtgtttcccaatgttttcttctagtagtctcataacttcaggtgcttaatccattttgatttgttttagtatacggcaagaaataggggtccagtttcattcttctgcatgtggatgtccagtcttcccagcaccatttattgcagactgtcctttccccaatgttcttagtggctttgttgaaaatgagttggaggtaaatgtgtggatttttttctgggctctctattctgttccactggtctgtgtctgtttttatgccagcaccatgctatagctctggagtataatttgaagtcacataatgtatgtaatgtgattccttcagttttgttctttttgcccaggattgctttgcctactctgggtctttgtggttccacaaaaattttaggattgtttttccaaccctaaaacataattctgtgaagaatgtcattggtgttttgacaagggttgcaatgaatctgtaaattcctttgggtagtgtggacattttaacaacactgattccaacaatactgaatccatgaccatggagtatctttccactttttggtgccgtcttcaatatctttcatcagtgttttatagttttcattgtagaaatctttcacttctttggttaagtttattcctaggtattttattttattttatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattcttttgatgtgatgtatcgcatttacagatctgaatatgtattaggtggttctcacattgctataaagaaatacctgagactgggcaatttatataaaaaaagagttcattggctcactattctgcaggctgtacagcaagcatgacagcatctgcttggcttctggtgaggcctcaggaaatgcataatcagggcagaaggcaacaggggaacacacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttctttttttgttgcgtctttgtctggttttggtaccagggaaatactggccctttggaatgaatttggaagtattctcttcttagcttttgtgatataattcttctttaaatgtttggtagagttcagcagtgaagccatcaggtcctgggcttttctttgatgattttctttttttcttttcttttattactgcttgctctgaaaatatttcttttttaattcaaaaaaccaaaaacaaacaaaaaacaaccaaaaaaccattcctggagggatggctggtgaggactttgattttgtcatagtctctctgtgatgaggctcagaggaaacccagctgttttcctagtacaacagttagcatattcaacaactgaagaattgtgagttatatacctctcttatctcaatgtatcttctgatgacattttctgggctgccctctcatggcaaaaaaataactgaggcacagaaagaagccaggtacaaaatggaacctacattaatcatctaaaacggcattatcataacagacttgcctgagccattacttaccacaatgaattggtatgacacttctaacaaggtcagaaaaatcagattctgttttcttaatattgaggatctttcccactttccctgagctaatgagacacaggtctgtggcaaatacatttagtattttcctacacatgaattcctaacaaaaccaagcaagagcatacaaagggaaacatactttagctaatttaaaggtgtcttatgttattttgcttattgaaaaaactgaaaaggtagtaaggaaaagatgtaatgtggtaatagcaaattgcatctgtggtctctaatgaataatctcgcttccagtaaaaaaaactatcaaaagagcttaaactcaaggtaaacaaaaggatgaaaatattaaaataagagcagaaatcaatgaaacagaaaacagaataaagaatgtcactgaaaacaaaagtaggtattttgaaaagatcaataaaattgtcaaacctctagccagactgaccaagaaataagacacaaattaccaatataaataatgaaacaaaacaaaacagcattatagaaccatccaaaattaaaaataagggaatattatgaacaatgttatactcataattttaacaacttacatgataaagacaaatattttgaaagacacaaactaccagtcaggcatggtggctcacgcctgtaatcccagcactttgggaggctgaggtgggaggattgcctgaggtcaggagttcaagaccagcccagccaacctggtgaaacaccggctctactaaaaacacaaaaactagccaggctggtggtgcatgcttacagtcccagctactcgagaggctgaggcaggagaatcgcttcaaccgcagaggttgcagtgagccatgatggtaccactgcactccagcttgggtgatacagcaagactctgtctcaaaaaaaaaaaaaaagactaccaaaaaacaaaacaaaacaaaacaaactgtaacaaggaaaaaatacataacctgaatattcctatataaaattaaagaaactgaatttgtaatgaaaacccttcccacaaagaaaactctagcaccaggtaactctactagtgaattctaacaaatatttaagaaaaaaataaaatcaattgtacatgaactctaccagaaaccacaaaaggaaggaacacgtcccaactccttgttttgaggtacagcttttccatgataccaaaaccagatataaacaatgttaaaaaaaagtactgaccaataaaacaagaatcttcacaaaacatcagcaaatcaatccagcaacatctggaatggataacatgtaaacaatcaagtagaatttatctgaggaatgcaaggctgttcaacaaacaacaagaaatccaccatatcaacagattaagaagaaaacccatataatcccagtcatacacacacaaaaaaaagcactgacaaaaattcaactttcattcatgattaaaaacaaccatctctcagtaaactaagataaaagggaacttcctcaatctaacaaatggcaaaatagaaatacaagggaacttccttaacctgataaaaggcatcaaccaaaaaaaaaaccacttactggtgaaagacagcttttacccagtattaagagtaaggtaagtatgcctgctcaccattcctaattaacaacatcctgaaagtccaaactagtgcaataaggcaagaaaaagaaataaagagcattcaaaaggagggaaaaaaactgcctctatacacagatgacatgactgcctacacataggaaaacacccaggaatctaaacaagaaagttcctacaactagtaattttaagactgcaaggttgctataaaaaaaaaaacaaaaaaaaacctgcatttctacacagtaacaaggaacaatcaaatattgaaatgaaaaaaaaaaaactatttacaatagcgccaagaaacatgagatatttaactataaacctaacaaaaatgtgtgcaggatctatttgccaaaaactacaatacattaaagaaataaaacaatgaggagataacattatattcatagtttggaatattcaatattgttaaaatgttaattatccccaatgatttgtagattcaaatgcaatcccaataaaatcccagcagttttattttctttgagggaaggaagataaaagttgacaaaattattctaaaatttatacagaaaggcaaaggagctagaatagccaaaataattttaaaaagtatttggaggatttgccctacctgatttccacgtttaatataaagctacagtaatcgatgcataagtaactggtaaaaaggcagacacacagatcaacagaccagacaagggagtccagaaatatatggtcaattgatttttgacaaagcgagaaaggcaattaaacggacaaagtataatctttcaaacaaaatgcttcttcaaaataaacactggacatctgtatgaaaaaaaaaaaatctctctgcccgtatctcatggcacaaacagaatttaactgaaataaaacttttaaaggaaaacagaggaaaaattattcttgattttgggtttggcaaagatttctgagatacaaaaccaaaaacatgattgataaaggcaaaaattaacaaactggactttatcaaaaatttttctttctttccttttgagacagagtcttactctgtctcccatgctggagtgcagtggcacgatgtcagggtcattgcaacctctgcctcctgggctcaagcgattctcctgcctcagcctcccgagtagctgggactacaggcacatgccaacactcccagctaatttttgtatttttagtagagacaggctttcaccatgttggccaggctggtctcaaattcctggcctcaagtaatttgtctgccttggcctaccaaagtgttgggtttacaggcttgagccactacacctggccagagctttatcaaaacttaaagcatgtactgcaaaagacactgtcattaagagaaagaaaaggcaaatcacagaatgggaaaaaaatacttacaaaataatacctgataaagaatctgtatcctgaatacgttaaaaaaaaaaaaaaaaaatctcaaaactcagtaacttctgtgtaccaaaaagaataatcacagagtaaaaaggcaatccatggaaaggaaaaaaatatttgcaaatcatatatttaacaactggttaatatccaaaatatataaagactactgcaactcaacaactaaaaaacaagcaacatagagcttaaaaatgggcaacagtcttgaatacgtgaagtctatgttgtattttgccgcaattttataaaatctcaataataagaaaaacccaattaaaaatgggcaaaaggtttgaatacattttaccaaagatatatggacaacaaatgagcacatcaagagatcattaatcttcagagataagcaaactaaaaccacgtgtgataccgctagatacccactgaatggcaattggtcttgctctgttgcccaggatggaatgcaatggcgtgatctcggctcattgcaacctccatctactgggttcaagtgattctcctgcctcagcctccaagtagctgggactacaggcgcctgccaccacgtccagctaatttttgtatttttagtagacggggtttcaccacgttggccaggctggtctcaaactcctggcctcgggtaatccaccagcctctccctcccaaagtgctgggattacaggtgtgagccactgtgcccagcgtttttttttttttttcttttctttctaaatctgacaatacggattgagtatcctttacctgaaatgcttgggaccagaaatgtttcagatttcaaatgttttggatttgggaatatttgcgttatacttaccagttcggcacccataatctgaaaatccaaaattcagaatgttccaatgagcatttcctttaaacatgacgtcatcactcgaaaagttttgaattttgcattttagatttcagatctgggatgctcaacccatatcaagtgctgatgaggatacgcaacaacgggagctcttatacactgccagtggtggtgttagatggtacagagaatttgaccatttctttaaaacttaaataattaccatgggacccacagcaagtcttttcctaagtatttacccaaaagaaataaaaagttatgttcatacaaaaacctgtacactagaggtttgttcataatcaatggaaactgcaaaacacaaatataccacaactggagaacgaacacacaattatacattcatacaatgaaatgctactatgcaataagagaaactactgatagagtaacatcatggagaaatcccaaatgcattaggctaagtgtaagaagtcagcctcaaaaggctacatgttgtatgagtccatttacatgacattctagaaaaggcaagaatgtacaaaaagaaaccatatcattggttaagtggacgtgaggggaccgggatgattaaaaataggtgttaagagaaagtttttgtattgaagttgtcttgtattttaattgtggtggttacatgactgtatatgcttgtcaaaactcagaactgtaagggtcaatttcactgtatgtaaattataccaataaaaacaataaaagtcttaataaaaataaatgtaatatgataaaaaaaataccaaatcattgacatcgccactagtcataaggtaagaagttattttatatgtttaatcatatgtatctgatttaaatatgctacctatcaatacatttcaaacaaaggaaggccatgttgcaggtttatgaaagttaaggttagtattagataatgatttccttcaccatttaataatgaaacattaaaaagttgactatatcttatcagaaaaaaaaatttttttttttttttgagagggagtctcgcctctgtcacccaggctggagtgcagtggcatgatctcggctcactgcaagctctgcctcctgggttcacgccattctcccgcctcagcctcccgagtagctgggactacaggcacccgccaccacgcctggctaatttttttgtatttttagtacagacagggtttcaccatgttatccaggatggtctcaatctcctgacctcgtgatctgcctgcctcagcctcccaaagtgctgggattacaggcgtgagccaccacacccagccaaaaacaactattttttaataattaatttacccattatctactatgtgcagatccaaacattcgtgagataatcaggggcagagtccagcaacatgattctttcccctttccatcttcctaataatggatatagctggtagaaatagtaagtgtaaagtgcaaggccagtatttaaatattctctctttccatacattctctaagaaagggagtaatcagtagattcagctctcttgaaagagaggaaagagaattttgagagacacttaactttacaaattggtaaagcatgaactggtgtcaacttgttccattttaaacttgtgaaaaccaaggttttcgaaggtgactgaatcacttccccatttctaaagcaagagaaaggcagaaccagaattcaaattgatagcagtctcacttcggacaaagttcttagtcccaccaagtaagaactcatctcttactactactcatctctcttctcgcatctgcaattgtttaagcaacagcttgggtcaacatgtttgaaatcaattaagtatcttttaggattttattatgcatacaacctggtttaatttcaaacttcactcccacaatggatgcatatatactcagaaaggttgaagcagtttataataatttatactaatgtacagagtcttttatctgatcactcaaaattttaaaagcaaatcactttttaagtcaggaataaaaacagcaaatactcaaaaggatatatgaaaaagtaatcatgctcacttttgaccttaataaaaaattattgtaactctaattttaaacaaaagaatatagaaaaagtttcctcctccctctggcttcctgacatctggctttcctctattgttttcaaagctgccagtatcctgagttatacacagattacttactgcaacacaaacttaccctgtgaagcgtcactgtatgttgttcccatatagctgtttcctccattgctgtgctctgataaaggaaaagaaaaacaaatcatttaccttttaagaaaatgtccttaataaggtgagcaagaacatccaacaattcagcacactgaaataccaaaattcacagttaatattagagacactctgaaaggaccttaataattatggaaagttttttgtttgcttttaagagacaggaaacgacacacaggaacttcctttgtttttaacttaatttggacagctgctctatattcatttcatgcaagctgaaatcagtattcaagctaattctgcaactttatacttagaaaagaataaaagttggagcggtattatcttaaaatatctaatggcacgtaaacatttaaaagcatctcttatgttttacaaacgaagggaaagttaaatgcctctgaacacagtaattataaatatacatgtcacaggaaaacagataaaaccattaataggtttggcaaatggctgctttaacgtcacaaacatgactactctacctagtttcagttttgctacagaattacttctcaagcttcatttataaccaaaagaaaaagaacagcttttctagtatatgtatcacacacgtagatacacacaagaaacaaaaacaaaaaagaacaatctcccaaactcccccaagaatcatcataaaataaaagcagtaagagctccaatacaggtcctgcccaaattatagcgtacttcagttttacctcctgtcatgagcctctcaatagagaggaaaataaattattattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtacagacggggtttcaccgttttagccgggatggtctcgatctcctgacctcctgatccgcccgcctcggcctcccaaagtgctgggattacaggcgtgagccaccgcgcccggccgaaaataaattattatctaaggcaggggtgtccaatcttttggcttctctgggccacacttgaaagaagaagaattgtcttgggccacacataaaatacactaacactaatgaaagctgatgagcttaaaaaaaaaattacaaaaaaaaaaatctcataatgttgtaagaaaatttacgaatttgtgttgggccgcatgcgacctgtgaaccacgggttggacaaggttgatctaaggaattagcagtaaggaattcaaaataaatttcttttaaatggggttaattgctcttggagacttaaaatatttcagtctctcttaatgttaccattttatgaaactgggactcctaaaatgtatttacaagtaaatttaaaaaagattcttcagagttatcaaaaggtaaagtaaaaagggagaaggctaagcatgacactctcagatcactagtcacccattactataaatgcctatttcataagtgaggtctgttttctcttactgctgtcattagcatcatgagaatatgcctaccaaggtgccatgggcccattctctcctttcccacagcgactttaattgaagattaatgccattttagaaagtaagtccctataaagaaagcctgcttccctaaattcaaagcaactagattatcctgccagatgaataagagaggagagagaaaggatctctctgttcactcccatagataagaactgccaacctcaccagcatttgtttcaatcttccaatgaagtgcaccaaaacctccctttaatgagacctccactggaaacaaagctgtttttttttttttaaacaaacattgaccgggataatgcactaaaaaaaaaaattcttccatcaatgagaagcaacaatagtatgagtaaatcagctaaacatcaacagtcccactaacatacacatgataaaagtatctgcaagagttgccagtttgtccaatctcagctgatattaagaatgagaactgcttgcatagctctcagttcatcttttcttgatctatttcattaaccagtgacattgttttactgcctttttaatctttttcctatcagtccaaatggcaagtgatgtgataacatgcacttaactctctttgataacatactctatggtatgaaacagttcatcatcctctctaaggtcttaatgaacacagttttccattttgtaagaagatgttaatcaaatgggaaaatttatttaacattaaggggggagcaggttgtaaaacagcgtgtacatggttatcctaattttgtttaaacattagtagggaataaaggctcaaaggataaacaaaatgttaacattgtttatcaccttcaaagtaaagggactgtgggtgacatttttctatcaggtgttttatcttcctgctttcctttctccattccccatcagaacaaactggcaatgtattttaaactatattcacaaaatctcattcctatttgacatttcgaatacagacagtccctgacttaggatgggtcaacttgattttctgactttacgatggtacccatacaaccattgtttttcatttccactacagtattcaagaaattatatgagatattcaacactttattgtgaagtaagcttttgtgttagataattttgcccaactatatactaatgtaagtgttctgagcatggttaaggtaggctgggctaagcttatgatactgggtaggttgggtgtattaaatgcatttttgacgtaaagtattttcaacttacgatgagtttaatcaggacattgttctaagtgagctgagaagcatctgtatctgtttttccacttggcttttaggaaaatcaaataatgcttaagaggattaatgttcttattgttaattataaaaaatgtttattctcctgttagtaagcaatctatacattaaggtcttaatgtacagtctccaggaggagtgcaataagagaaacttgctttgtacaagggagaagactaaaatactaaaacataattgctctcaccattccacatcaaaatcaatatagtttttctttggaggactggaaaagtccacatctcaaaaaacttctctgttaaacatcaattatagcttgatttatctgaaggaagacctatgtagaagaaagtaattgagaatgaaacatcaaaagaagtggttaggctcttgaccagccactaaaccaacttaatccataatataagtgagttactatgttttaccactccttatctttaaaaaaaaaaaacaaaaaacagaaaaatatattcctagtttaaatgatggaccatgtcatctctctccattctctagcctttcatttgcttctgtggcaaaagtagcaaattctatccatggttgtttatataaccaggcagtactgatgaggagttctgaatgaggaatggaaggatgaacaaacacgtaaatatgtaataatgcaaatacagtaaaatgataatggtagaatcttagtggttgggattcaggtaaccatggcagactgctttcaatcttgttacgtgtttgaaagtgatcataataaaatgctgaggaaaaactaagaaatccttctagtaaatcactcagaaatcaaagctaaaattgatatgagacatttttagtaccagtaaatttattaaccactattttaatgagcattccataaagaaaaaatgttcactaatgactgagaattttgatgcattagaaaagcaaggggtgtggaggttcctttggaagaatacctaagaaacgcatggcttctggagtggagaaaggaaaaccaggtaggaggagtctcacttttcactgggagccctttgtacttttaattacattcatctattacttatcaaattatttttaaaacttaatatccttattgtaaacttgcttgtcattttctcatttcaaacatgcacaagggataactgcataacttgcacaaaaagcttctggtaaattaccagtctcaggttcaagacatttaggcttgtaggagaccaaggggaaaatgtattactcctctaagcatgattctagcactaccattccctagtaactcagacagatgctggtaaacaggaaatgaactagaccaggcataaggagaccagagccgaaaggtatcatcaactagaaacgtgatcttaattttcctcacctacacaattagggaaatgggtgaaattatctcaaatgaaaagacttttctagctccaaaattctatcagactataattccaatgaacaggctacaaattcaataattagtgaagcactgcaggcatcaaaagtgactgcaattcatggttgctggattctgagttctgcgcacatttctaagtcagcatcaactgactagaatcacaatttctgaagaagcaaaaagctgtatttcacaatctgccaagagtttgtttagtttctttgttctaagctccagctggcaaagacactactcagatcaccaactctgaagggcttcctgccaaaacttcagatcccagttctaggcagtttcactgtccttcaggactgattactgaatggggaaagataggagggcacaataactgaaaagacaggatgagcctataactgggagaagaacaaatccaaaagagaagatataaagtatactccaaatgaagaactccttaacattatctaaatacacagccagttaaattttactaaccttatggctgtaatttcaaaaccaatccatgtatcattcattcattcattcattcaacaaacatgtatcagacatggtaagtgttggggaggccaaaaaaaggtccctctccctccctaggggctcaaagaagcagctgagaacactaaatggtatttaggttggtgcaaaaataactgcagcttttgccattaaaatggcatcaaaagatatgagctttttgcaccaaaataaataacttttgcaccacatagataagagctgttatggaagatgcaaaaggactgtgtctgctgtgaagatcagagatctgttccctgagacagcaacgttttgagttcatcaagcttgaaggatgtccaggaaaaaagtggagaaagatgtttcagaagaaacagcatgtcagcaagattgtgtgatgctacacatgacgctggctttgatatgactaagttgtacaatttatggaacaaggagagagtaaaaggagagaaggtgcaagggtaccagatcacaacaggctttataatataatgccaaggactttaaactcaaatggaagacactaaagaattttcgacgatcaaatgatataagaattcatcctgaaggctgtaatgggaaaatgatttgagaaagggaaaccagttagaaagttagtgagaagtgtgggtggagttcaaaatggctcttgagtagtcaaccaagtagcagtgctgaagtcaaaaggaaaagatgtaattacccaaggactaagataaccctgtggacaaccaaaggaatttgagaagaagcagacaatgaggatacatgaaaaccaatggagctaatacaaaacactacttactgtccagagaatacaccaaagcttaagatccctcaattttttagatcaatacacctcatttatctgacatcataaaataataaaatttccacaaatcttcaaggaacaccctttcttgatgacatgcagttccccattaggaaaaccaatagtaaaggtattaagaacactctgtgaaccctccaagttccttctgtgagcaaagctgctacactgaacggcttctcattccttctgaactccaaagtgtttctgttttggtctttttggcttttttccatccaaattgaaagcaagatcatctatggagatgaggttgagccaggaacttaaggagaaggacaaggtaggtttcagtgaataaaacagatgacccctgcccttcaatgaagtttcaattacataatttcaaattgtgatcactgcaacacaaatgaagtacaaagggaatagtgctacatgttaaaaggtaaggcaaaatatgtatatttggactgatctgatgggccgtcatttaaattcccaaaatagaaatgtccaggaggtagtaaaaaagatcactctaaaataaaatgaagaagggtcctaacgatattcagggattcaacaaacttcatgaatagaagataaaaattcaggaaacataagaattaaaataatgatcaaaataagaaggcagcaaccataggataaaagtctcaatagaaatttagtaaatttagcatccaacaccccactgtattcaacactggttaaatttacaaatgtatcactgtgtccatcccttggttaacagtttaggaaacaaatgatgagatggatatgattaggaaatattagtcggaaagacagacacagtgaacctgtaattttctggttgatcaaagctgaaggtctgctaaaaacattaagttcacagataagctgctacattagctataaagtaagagtgaaagaacatcagcttaaaagttaccattatgtgtacattaaatattgagaaaatctcagtagggacagttacaaatattcttggaaacttaaaatctagagtgctttcaagttatcaaaaataaaactatttttaggtatagcatcttctaaaggttgaagatagatacaaagatctctcacaatttattcaggtagacaggaggaggaagggaatggcatagcagagatgaagagagagtgacagtcctctgagtatatctttttgcataactctctttcttagaccacagtattgtttcatgacattacccttcacagatcaaaaaattaaactattaaaaccaaaaagacatgaggggaggggaggaaatcaaaaacagaataaagacagtaacaaatgaacataactatattacagatggagaatgtaaccacactaaagaagagtttaacttttctataaatctaatattttaaaataaaaagtttaaaaaagttataatggtatagaaaaatgcagaaagataccaattttggaaaaaatatttacgtactcagaaaaaaaacttggtttcagagttgtatattttaagtttttatatatcctacaatgaacacatgaatttcataatccttgaaaactggtaaacatcacatctgaattacgaaacaaaaaatgggcaaaagtggccaggcatggtggctcacacctgtaatcccagcacttttggaggctgaggcaggcagatcatttgaggccagatgttcaagatcagcctggccaacctggtgaaaccccgtctctactaaaaatacaaaaattagccaggcatgggggcacatgcctgtaatcccagctacttgggaggctgaggcacgagaatcacttgaacccaggaggtggagtttgcagtgagccgagattgcaccactgcactccagcctgggtgacacagtgagactgtcttaaaacaaaaacataaacaagaaacagggaaaagtgatctacactgttagaagttgggacagggttacctttgtgtatgaagtaactcgaagggatggaggtgggggagcttcgggacgtaaagtaaatgttcttccttgatctgagttgtgggcaaataggcatattcactttgaaaatatatcaatctgtgtacacctatgatttgcctaatgtattatgttatttaaaaattcaaaataaagtaacctgacagaactgtaagtaatttgactgcaatggattaaaataaatcaaatatgcttccatccatccatatgcccacagtgattttaaaaaatgataagtgctggcagaactcattattttgagaaactggtacgtatagggaaagaataagatatttactctgtctttcctatacaaacagtaccagtgggcgatcaaaatagtagatgaaggagagtttctttttttagaagcactccagctaaccaatgaaaaaggaataataaaaattgaatatcatcattttgtaacacctagtgaattaagggatctacacactgatcatcaatggctgcagacatcatccaaaaacaacagaaaaaaccctgggaccgaatgccacttatgaagtagaactgtaaaaacaaacaaaaaaatcaaatctgaatctgatcaaggctctagatctgtgctatccagtacagtagccaccagccacatggggctactcagcacttaaaatgtgggtagtccaaactgagatatggtatatgtaaaatatatatatgatacgaaatatgtgatatgtattatgatatgctatgtgcaaaatatacatgatatgtaaaatatacatgcaacagtattcagagactgaatatggaaaataatttaaaatatctcacctataattttatatcattgcatgctaaaatggtaatattttggatatgtgtgttaaataaaacatgaaaattaattttaccttaaagttttggtgtggctactacattagacagaattgctctagctacagttaaccaatttacaggaaatacagtgggccaaccaccattgtaatcaccacaaggaagcaaataccaaaattcatactgttaaaatttctacaaataatcctgtttctcaaccaataaagctgcaagggaagaggggaaagagagagacagaaatgggggacctcatatgcctaagagaaatgttaaacaatcacagtaagaggacctcatcaaggaaagttgacatttaacacaattagaaaacactaaacatggctgggcgcggtggctcacacctgtaatctcagcacttgggaggccaacgggggtggatcgcctgaagtcaggagttcgagaccaggctggccaacacggtgaaaccccgtctctactaaaaatacaaaaaattagccaggcatggtggcagatgcctgcaatcccagctactcaggaggctgaggcaggagaatcccttgaaccagggaggcagacgttacagtgagccaaggtcatgccattgcactccagcctgggcaaccaggagcgaaactccgtcttaaaaaaaaaaaaccaaacacttaagtacttgatttggagtttattttaaaagtgtgctaatgataatgtagttatagtacttttaaaaaagacatcttttagagatatatattcagacacatgttgagtattccattctatctcttctctgaaatgcttcaaaccacgtgtttccgatttcagggtgaaccatccaaaatccaaaaatctgaaatctgaaatgctccaaagagaattttctttgagcattatgtcagtgctcaaaaagtactggattttgaagcatttcagatttgggatgttcactatgtactaacagatgaaaagatatctggcatttgcttcaaaataatggggaagagaagacacaatgaatgaagtatagatgaaatgagactggctgtaagttgttaaccatactgggtgacagtaatgtgggaattcattatattccccacatccacttttctataggtttgaaaattttccacttaaaagaaggtaacttgaggggactagaaattaattactgatttaggaaagacccaaaccaagaatgcagctaccatgatgccaggatattaagtagtatttccatgagctggctattccagcaactgcttcccctcccctttcagaatagtaagaaaaatgcaactagtcctggagatggattagtaccttccttctgctgctaagctgaatttaaggtggtctaacattaccagtaagtgagttaacagcattgaaaaggcaactcttgtctagaaggggtaacagatactaatcaaataatagcagagaactaagtacaggttatcataagtgctataaaggggtacacagagtttaaagcacagagttttgacctagtttctgggctctgggcaaagtccttgaggagaagagacagctatgaggtgcatgaaagatggaggtggcaaggtttccgggtagaaaaaacagcacgtgcaagagcctagtgtaggaaagtgcatctctcattcattcaaataatgttttgagagtttcctatgtactagacactgtgttaaactacacgaataactggacacaactagtatgacctttgttctcaaggagcttacagtctagcaggagaaccaaatgatcgaaaaactccatggctaaatatatagtcacaaagttaaataagtactatgaaagaaggaaaaacagtgccatgaggaactcaaagagaaagttgacaggaagtacacttgctaggaaccaaaaagaggaaagcacagtttgagaacaagaaacaaggaggaaaaagatacgatgtggctagaggggtaggcaggggccaaataatccactaggagcttactgaccatattaaggattttgatcttttactctaaaggtagttaagcagcctaggaattttaggatgagtgttcgcatgtgtgtgtagcggggcgggggagagcggagagaaactaatcaaacctggattttgaaaagattatttcagaaaaacagattgtaaggggaagaggggggtatgatacttaggaggctattacaggaatccagagggaggattacttgggtgggggtgggggggtggtgggagggagaatgtaaatggttgaaagtacggataaaacaagtagaaagacctgaggtgctcagcaaatcaaagctgaatagaacttgctaatcaaccattcaccatactaggtagacatccaaattgagccaggtaccctggatttggaatagtctttcaactctattgcctaatccatcagactaaggactgtatctcttatctaatgccattgtaataattttttcaaaagtatctcaggaacccaaggaaccttcctctgaaaccataaaacatcttgctgggctgaaactactaacctacaggctgattgatctttgtccagaaataaataaatgaatcctccttctgaaaccacaaaacatcttgctgggctgaaaactactaacctacaggctgatctctgtccaaaatgaatgaatgaatgaatgaatgaatgaatgtcttaaataatctacaggccaacctttgtccataaataaacaagtaaataaataaaattcctatatgcctcctctctgatattaaaataggcttcacttaaaatgtttttagaagacacagctaacataatagcttagtatgtgctgagcccacaatcactctgagatgggtcttgtttgcatttttacatttgcattttgtgtacagatgagaaaacagccatttagtggcagactcaggattcagattccagaggctaaactcacatataagtaaaacttaagagttgctcggtgataatcttttcagtccttattttacttgacctctctgtgcaggatctggcctgctgacaggtgaatggtgtttacacgggtgttcactttataataatccattaatgtacatttgctttatgtacttttgtacacatggcaatatatttcacaataaaaagatataaaaaactaagtcaactagcaagacttaagtcagggtaacttacatgaaaatccggatttgcaacctcttgaaaaactgggagatctggcctgtcttcttccaagaaaacaatcagctggggctgagcaagagctgcttcctttagacaaactggcttgtgctctgatggagcagtgccctctcttctggctttcatgattcatgctgcttttctggtctaagacttacctaacaccatcccatactcttctccctggtgctctcttacaacacacgaacataaaaggatgtgaatgtatgacttatagaacatgtaagtagatgtatgattacctatggcaagtaaatttaacctcagatccttcacctgtaaaaacagagataatcgtagtatctaacagaattgtgaagattaaatgggataatgcacataaaacacttagctcagtatctgtcacagagtcagcatgcaatataaggggctactgtttgttttgacacatatttctcacacttataactaaaatgtaagcctacttgccatggctactgacttgatttttataggtgatacagcatcaaaatagtgtacttctgtattaacactccagtaagtattaatactccaataactgccactgttagaaaaaaaaaatcagtaaataaaccttccttagtacctttatatgacattaccaggaaaaacttccacaattatattttgaaaggcagactcatttttgccagattcatgtatttcccctgattgtggcttttggtggtctgatcagtcaggtaagtggatatcttactactaaaacatacttcaatacttactactaaaacatactttagtatgacaaacatcttagtcataaaatatcctccaaactaagaccaacttgatttttcaagataatcataggaacaccaaaagaagcttactaccttttgctcagctgttggtactccaatgactgcctcataatgcatatctaattcttgcccctcagacagacatatacaatatttttctccaaaaagccacagaagtctaactgaaactattttctcccgaaaccaataaagtcctcatacaatggaataccatgaagtacaagaactgaatgaaaactaatgagctacagttctccacaacataatcttacaaacataatgctgagcaaaagaagccatatacaacagaattcacactagaagattctgtatgcgcaaagttcagagagtcaaaactagtgctttcagaatgcataattaggtggtaactataaagaaaaactagaaaatgagaaacctagaagacaagatacatgcaatctttgaagaagggaggatatgacccagaaaaggcatgttagggattctagcacttatcattatggacagaattttatttgctgctctctacccgcaccattaaaatgccctatcagtacagagatgtgttcactgctgcatctccagcacctacaacagtgattggtacacacgaggtaaccaacaaatatctgctgaatgtaaaattccgctttaggaatccaaattgttacatatttcacagcttcttgaaccctaaatgtaacagtaacagctagtatagtgttcatttgccttgtcagtatattcaaggagctgttaagcatataagccaattactttataattcttaatgtctccctcctattgagatattgataccaaacatatgcagaaaacacttacatcaatgtatccagattcaattcaaacatttaaaaacattaacaaggaaaaatacagaaactctgctaaacagcaagcccaggtttagaaaatgactttgtcacctcctccaacgaagaaagcacacaagaatgctctgttattacaggatgaccataagtttgctcgtatttttaagagtaaacaatgcaaatcctttgtttcttcaacaatgagttacacaattcacaaagtgatcattacagcgtatagcagttgaaaactgtaaatttctaggatcgggatcccaaacaaaatgtactcatttaatatgtgttaagctaacaaaaagaattagtcattactggtatcctcctgaattttaaaattacatactaaattaagtgagctaatcttatattaagtttaactggtgatattcagttaccagaaactgttgtacaatctccaagataatgacaattccaaaagcgtgaaaattcctaagataaccaagaagaaaaatgaacttttcagtctttgggaatttacatttttttaaaaaggaaaaaatatttcggtaagtcaaaaaaaattaattaaaccaggtatacgctaatcttatgttcctaattagaatccacagaaagtaatatcagcttctgttttacctcctttccggacatgataaactagaattgagatcattcaccagttaactcacttcccagtattttcagtatatcaactgaaatatatccgcaacacaaactaataaaaccttatctcttgatctatcccaaagtgagggccacctgagattcagtattgagcactacatatatgacagggttttgttatcacatttcaaatggtgttttacagtacaaagtttggtaacattggtgttctcatgatctaaagctgtgttcttgtggtaaaggcaatcattcagagtccatttattttcatccatgcttaggatataagataaaactccctacccacgtattccccacatactgctcattattaagaatttatctgtttaagaggaatggaaataaagcacctggctagcccataaaggagcaacctgaagccactcttctctgcaataaataaataaagatgcactctaggtcagagagagcaaaagtcttatttttattgctggcttatgcaagaaatactgcaacacaccaattttataggattaactttaaaatctgtaaactatcctaatgtctatttctttctacaagactaaaagttgttaaagtaaaaaggtttttcaagatttgctttcaaaattcagaggtgcaaagcaagttccagtcaaatattccaggaggatcattctagacataaactatctttttatttaacatatcaaaactttgctaattagaaatgactggctcattccactagcttgtcttcagctactataatgctcagtcatacacaatgctgagcacgtgaatgctttcaggcaggcctgaaatgagcaatgactgagcagtcacagatgggtggcactacacatgaatttacagctggactcatggtctttcagtaaggtgaatttttatcatatcaggggtatgtcaagtaacaggattacgtcttcaaattttccaccaaaactattatttttaaagacattttccttagcagcatggtgatctatcatatttatacacagttttattcttagaactgtacagagtttacatttggtctctaaacagaaaagagattaaagagcaagtaaaagtcagagccagaccttgtttccaggattggaggggaaaaagggagtggaactactgtactttttttccttcaaatcaaacgggaagcagtactacatatactgcgttacagccctcgaagccacagattggtttccacctcattatttattggtgtctttccttttttttttttgagacagactctcactctgttgcccaggcaggagtgcagtggtgctatctcgactcactgcaaccttggctcaactgcaaactctgcttcctgggttcaaatgattctcctgcctcagcctcccaagtagctgggattttaggcatgtgctaccacacccggctaatttttgtatttttagtagagacggggtttcggccgtgttggttgtgctggtcttgaagtcccgccctcaggtgatatgcccgcctcagcctcccaaagtgcagggattacatgcttgagtctggcaaattggtgtctttcctaataatataatgtaatttgtgccaatatataacctgggggggaagaacaccacaatttgaaacataactatcttatgaagctgtcctgaaacaaatgtaagagttgtaaaatgtagttaggattatcagccaactatataaattaaagctttaaccatgatggtctaaaatgccaaacacacacaaaaattattgctacagtgaggatcattaaaagttggcagccaaacttcagtgacttctcacaaactacagtgagtttttcacttttaaaacagtatgaagcaagtatgcattgatcagtaactatcataattaaaacactgcatcactcactcaagaaacaatccctatatgtaatgactgactcttgtcattaatttttgttcattagcttggccattttctgcagctcttaaggtttcaaaaacgttaagatatcaagaaaagcccactgtatacacaaattaactcaagatggattaaagacttcaatgtaaaacccaaaaccataaaaaccctaaaagaaaacctaggcaataccattcaggacataggcatgggcaaagacttcatgatgaaaacaccaaaagcaattgcaacaaaagctaaaattgacaaatgggatctaattaaactaaagagcttctgcacagcaaaagaaactatcagagtgaacaggcaacctacagaatgggagaaaaacttttgccatctactgatctgacaaaggtctaatatccagaatccacatggaagtgaaactaatttacaagaaaacaaatatccgtatcaaaaactgggcaaagaatatgaacagacacttctcaaaagaagacatttatgctgccaaaaaaaaggaggtatttatgcggccaacaaacatatgaaaaaatgctcatcatcaccgatcattagagaaatgcaaatcaaaaccacaatgagataccatcttacacccgtcagaatggtgattattagaaagtcaggaaacaacagatgctgccgaggctgtggagaaataggaacgcttttacactgttggtgggaatgtaaattagttcaaccattgtggaagatagtatggcaattcctcaaggacctagaaccagaaataccatttgacccagtaatcccattactgggtatatactcaaaggaatataaatcattctcctataaagacacatgcacacatatgtttactgcagcactatttacaatagcaaagacatggaaccaacccaaatgcccaccaatgacagattggataaagaaaatgtggtacatatatacaccatggtatactatgcagccataaaaaagaatgagttcatgtcctttgcagggacacggacgaagctggaagctatcatcctcagcaaactaacaccagaacagaaaaccaaacaccacatgttctcactcataagtgggagttgaacaatgagaacacatggacacagggaggggaacatcacacaccaggacctggggcctgttacccgggttggtggtggggggaaagggagggaaagcatttaggaaaaatacctaatgcatgtggggcttaaaacttagatgatgggttcataggtgcagcaaaccaccatggcacacgtatacctatgtaacaaatgtgcacattctgcacatggatcccagaacttaattaaaaaaaaaaaagcccactgtgctccacttgatacaataaatcaattcctgggtatcatgtaaatcagtgtaacagtaaaaaatgacataaatcattttcatacttacattataatttcagatagccacagcgggcaatactactattcccgagacttaacaaaaacatttaagtattcagcaaaatctaataagcatatacaatagcacaatcttaaattaaattttattgcttcctccaaaggaaaacagcttgaaaacacagaagccactgaaacttccttcagccacttttctgtgattcaaccaatgaaatcgtttcttaacaatgattcataccactttcttacacatttaaacaattctttggtgacgcagagaaccaccctaattcttgtttttcaactttctaataatcttaaatcaaatacaccagtaaacaaaattctgactgcgaacgcagacgtttatcacacatataaaaaacgtttttttcctttatttatttatttgagacagcgtctcgctctgtcgcccaggatggagtgcagtggtgcgatcttggctcaatgcaacctctgactcccgggttcaagcgtttctcctgcctcagccttcccattaggggggattacaggtgctcgccaccaggcccggctatttttttttttttttttttgtatttttagtagagacggggtttcaccatgttggtcaggctggtcttgaactcctgacgtcgtgatccgcccctcctggcctcacaaagtgctgggattacaccgcgcccggccacgttttttccttcattactttttgtttttgagacggaagctcactttgtcgcccaggctgtagtgcagtggccccgatctcagctcaatgcaacctccgccttccaggttcaagcaattctccttccttagcttcccaagtagctgggattataggcacgcgccaccatgcccggctaatttttgtatttttagtagagacggggtttcaccatgttggccaggctggcctcgaactcctgacctcaagtgacccacccgcctttattacttctttagtatcatgcacggaggattcttttcaatctaggtacatacatatttttaagtagtattctacattttcttctattttagaatttttattgctctttgtcatttagatttcctttgattttttttagcctatgaggcagaaaacatttttaaaaaatggataaccaatagtcctagcaccatacattgaacaagccactttctccaatagtctacaatattattttttaccacatattcgtagttttccaccttgctggctaaatgaacttaaaagttatcgtatctctgtgtttcaatttcttcaccaaaaagtagagataatagttcacttcatagggttactgtgagaattaaataaattgagcacttagaacaatacctgacatgcaataatactgatgatcataattactaaaagcccataaatgcacagatgtttctggacctccctggttcctgaactgacgggctgctttaaatgactgtgaatttctaacaagtttcctgatacggccttctttttccaaaattttgtcgctatcattttatcatgtaggttttcttatcaatatgtcaagttttctacaatacaacactagaagacactgacttggggaaaattagtaaattctacaacagtgactgtctccatccagaaaatacattgtttcatctcgtttattcagatctcactttatgtccttcattaagattccagtagctcaccaatatttgttatatttatttctaggtagtctttttagagaaacatttagtagtatatatcagaatttaaactgcacatagcctttgcctcggtaattccatttttaagaatctgatatacagtaatatatgtgtacagatataaaaaggctactattccaagaacaaaatcctggaaacaaatgtctatcaagaaagcaaagataatctaaacagcagcatattcataggatgacaaactattcaaccattataaagaaaaccgaatcaaaagcactggcttattagacaagagtttcccaaactatcatgctaaaacagtaacagcgagcttccaaattaatgttgcctttttttttttttttttccaaactgaaaggagggtggggaaaacaaacgcatcatatgtaaagcactgagtccagcctggctcttagtaagcattttaatcaccttcaaaaattaaatgtgacttacggaaacaggtcactgaatattatttcatttcacttattcatttatggcctgttttgctctatataaaattctgaagtggctccataatacagcatcttaaaaaaaagctttcaacttgccctttactcgcaaatgtttacaatgcaaaaaagtccctacaacgtaatatttaacgagtgatgcttttcaatatgccatacaaatctcaatactataattcaggagaagtactcctcctaccttactgtggcaatccattgaaaacgtatttctctccatacttgaaataacctcttaaaaagtgtgttgtcttgcatattaagtaccagagatcacacttcaggaacaaagtgacattctgtgtaatacggaaacaaagcctttcctcctaggaaagaaagccccagaaaagacaaataatgggagcttattttaaaaccaaagcaaaatgttgccttttatcctaaatctctggatcaagttttacctttagattgttcttcctcaatgtaaggtcaaaaggtgcaagttaaatttttcttaaacgaagaatactatatcccttaaaacaatctattcattaataagtgtaaccgctagcttctcccagccagcaaacaagcttctgtgagagttcaaaagtttcagaggcatagtattcctgctcccagatgttacgggtaagcatttcaaacaaaaatacacacagaaaaccactacctgcccaagtatctcgatactatttgaagtaatgaattgatattctttaaaggggagattttttactcctcacatttctgtattcctttgtttgaaataacaagtactattttatgatgaaaaaattaatatacaaaatgggaggagcatcctagctgtttttcaggaactttggctttttaatgtaatacacaagttagtttcaaagcaatgggaaaatgcaataatatttcagagcacataggaaaagtaacaggaaaaacgttacttttttcggctgaactcaccggcctttactaatttttaagtgctcatcttattgtccattcgtaggaatactttgtattacttgtgaaagtttaattcaagttaaattattaaatgttaaagaggttattttcaaagttaccttaaataagtaatacagcatgaaagaaaacccgacctactacgcctcacaggctgagtggagtgttttgcagtctcaaagccttatcgctggcgtgcgcataccgcagggagtgacatcagatcgaaactacagggtttcgccggggaccaaccactcctccaaagacagcagctcccggccagcaggaggtggcaccccaagccccgacccgctgagagccggcttccagcccccgaaccctcactggagccgagtttctccgcgagggacctgttgcgtgtccccgccctcagcgagccgcagccaggcacaggcgccggcagctatgcacctgcccagtacggcggccgggcgcccgcagccccctccccggccgcccccagtgcggcccgcgccgcccccgcccgaggggctccccgcggcccgcggcccgcggcccgcggccccgcgccagccctgcccaccccgccgccccggggcccagacagccgccagcgagggagggcgggacgcgggccagatgccggtgggcgggcggcgacggtcggcccggtctggccctggcggccgcggaggcgctcaccttggcggccgcagctctggcggacatcttgtctctctccagcgccgcgcgaggctcctcggacccgaaactccgcggcgctggcccgcccgctcctcacgccacagcccaaataaacatctcccgagagcgagcggggcacgggcgggggcggccggaagggcccggcccagggggagggaattcaactcggacaaaagtccgggaagcgcccgccccgcccgggtcttctccacggggcgcgcccgaccggcacctccctccgagcgcggccacccactcggcctcccgcagctttcgcagcccggccacgtcggcctcgcccggtcgcccgcccgtcagcagcacccgtggcctcccggcgtctcctcggaagccggcttcgccacgtaacttcccgggaaccggcggccgccaaggaacgcggcgtccgctggctcagccggcgccggcaactcagcggccacgcaaacctgccggcccggcccactgagcatgcccggcccggcgggggcggggctggacgaggcgaggcgaggcgaggcggggagggggcggggccgcggcgggggagggggcgggacgagcggccggggtcccgaccccaagcgcggaaggaaaagccgggtaacccaagtaacttggaagacagtttccgctgccgtgcgagtcttcctgtttgtttttatccaaggtctggcagaattcgcccccaaggagaaagcgcctgtgcaccaaagctttccttaagagacttgtccacttgctcctcgacaagccacgcacatcatggggtgagccccatgcatgagtgcggctggaaaggccggcagagccgatacccgacagttgtttccttcactgggcaaacagcatggtcacggctgtcaccgcgtgcctcggcgttgttcccacggaaggcggaatgcattttctgcaaggcgcgtcatggctttcatctccgaggagctccggcagggtcagaagcgttgctctcgttcaccggcgccgactgccaaggctgaaactggtgatgaggtcatgggcacccggaggcagcagcctgagaaacaccctagagacctgtgacatctcggcccacaccccacattagacctcaagatatatccaaagtctctttcccgcccatctagacaggaatcttgaaaagtttatttttggccatcaagattgctgaaattcttgttgaccgaacgggtcaagctgccctgcattccaatgctgtccctccaactcaaagttgggcagaaaagggtgtaaacacgtgcagtccatggtccagtttaatcagccactacacaaacttcccacaatgttgacggctttgctaaacaccaaggaacatggtaagaaaccaatcctagactcactaatctacacttgtaaatgtaaaggtcttcaaaaaatgccagaaatccttagtaacatcaatgataacatctttaaagtatctggtatagtgccacaaccggcacagaagaaatggaagaaatcataaacatcaggctttagacaatggttttctctttagaattcaactgtatgaaaagaacaaatttaacaaagaagtatgtgtaggtgatacataagtatcaattaaggcttcgaagtgccacacatcttgcaacccaaagctgtctgaaccagaaaagagccttctgcaaaccaaacccttattcctttttgttcttcataaaaatggttgaagtcatttttgttttaaagtcatgttgtaattgttttgcttttggacaaagtattatttattcttttaagaattgtgggccaggcgtggtggctcacgcctgtaatcccagcactttgggaggccgaggcgagcggatcacgaggtcaggagtttgagaccagcctggccaatatggtgaaactccgtctttattaaaaatacaaaaattagcctggtgtggcgcgtgcctgtagtcccagctactcgggaggctgaggcagaagaatcacttgaacccaggaggcggaggttgcagtgagtccagatcgtgccactgtactccagcctgggcaaccagcaagactctgtctcaaaaaaaaaaaaaaaaaaaaaaaaaaaaaaaaaaaatggtggccaggcgtagttgctcacgtttataatcccagcacttggggccgtgcgcagtggctcaagcctgtaatcccagcacttgagaggccaaggcaggcagatcacttgaggtcaggagttcgaaaccagcctggccgacatggtgaaaccccatctctactaaaaataggaaagtagccgggcatggtgacagacgccagtaatgccagctattcaggaggctgaggcaggagaatcgcttgaacccgagaggcggaggttgcaatgagctgagatcatgccattgcactccagcctgggcaacaagagcgaaactccgtctcaaatcatcatcatcatcatcatcatcatcatcatcatcccagcactttgggaggccaagaccagaggattctttgaggccaggagtttgagaccagcctgggaaacagtgagaccccattaaaaaaaaaaaattgtgattaaatttcttcatatgcaaacaccatttaaaaaggtttgggaagtattttttaattttaaaaggtggtgatgaaagacctttcacattatctttaccatttaagaagatgtgcaattgcataagctgcctagaactaggtgtggtgtctttaatagcacctaaatctagagacactatctacaaatgcactgacatttttcacttttccttatttgtcacttttacaagttgcccaatgtgtaatttaaatgctagattgcaactatttgtcactaattaaaaatagttatatatttaacagttttatctttgccatggtttaaaaaatgaaatcaaacaaaaatatttcatcttgaaaatattattctttaaaaattatatttagtatttcagtgactaatagtatcactttaaaatttttcagtggtatttttaatatctaaattaaacttcataaagtctgttctttaaataaacaagagaaggcttttatcatctgtaaaataaaggtaaaactgttgccaacaattaaaaacaaagctttattcctgcagtttattttttaggtaggtgctttgacaacaagtggaaagtataaagaataatctgaaagaatcacccatttaacaattaaagagtttatccatggaacaccaaaaaagtattttctgacttttatgcttacacacgcatgtcatcatagctcctctagatcaatatgggaagaaatacaagttaattaaggattctcatttagagttactataatgtttaaccacaaatctctttcgattgtacagatttatcttatttctgatcatctctgcaactgaacaggaaactaaaaaaccacaacacttaaaagacaacttcctgtgggatttttggtgtctgcggctcagaatgaaaaaagcattatgtgtgcaaaatctttacacattttagatagaactacttaataaaacagccttgaccaaatgaacaactatatccacacctaatttgtatatatgtatatgtatggttttaattgcaaaaaagatccttaggaaagcatatttatgttatttttatatgaactgtgagtttacgcttgacaaagaggaagtatttatttacggtagtgaagcattagacaatctcgataatgtcagagaagagaatatatacaaaatattagaaggagaagcactttatcaagatgttataacaaccaaaagtaatcctgattccactcctatgccataccattaaagattctacaaattgttacagaattttcctctgccaataaagtcatgtaacaatgttaaatgggggaaagattcttttaaggctcataatgtttctaaatttcatagaccagtaaaaattttaaaacgatcttagaggtgcaatataggagtaccaactttttaatcttataaagtaaaaacattttaaaacaaacattataaactgtatatgtaaagataattaaaatggcaaattttatattatgtacatattaccacagtttagaaatacaaaaagaaagctattaccaacaccatttcatttttttttttttaaaaagaagacataaacactaaaaaacaagtctttttaaattcaattcagtatacagaaagttattcctcgaaagaattcctcctatggggctacccttacctctgactggggctaaggtggagttttcttttttcagggtcccaaatattgcacaaccaggcaggtcggaagctccataaatccatgactggaatccaggcaggctggcatacaggcctctggctcatcccttagcggtttgtcctccattcttcacagcttctccactctgatctacactttcctatgattcctttaagactccctccccagcccaggcaaaacatctcatctcataatccatagagaaaacagacattaaggaatagaaactcccttcccttcctgccaaaacactgacaagtctaccctgggcatccgcttttcctctccatcttccccccaagggttatgaattccatcttggggggctgaccctctcagctgtgtcctctttctgtatcatcttcatcctgtccttagctaatgaattctacctctgagaattcaagcgtcttctagtgtttcccatcttaaacacagtcagggctccccaggctacctaccaaggtgtgcactactgcaggtatacaagaccctagggcagaagggcttgcagttggggtttaatgtggttgctgtcttgaattgtaaggactttcgttttggatgtgtgttttgtaagtgaaggtcaatgggaaaatgaggcacacactggggactggggcctctgctctcacagggtcctgtcgcctcctaggagggtatctgggctgcccgctcccacagctcttgatacccctgctggtcctctcccactctgctccactgccactgctgaaagggatccaagcaaggtgtggggtttaagtatgcatacccacagcatcttgagtgcacaaaagccccaaacgggcagtgtcactttctgtctggtggctgcctggctggaggcaatctcttggtgagggtgagcctttggcccagcccggattccagatccagtcatggaggtttaaggatccttggtggttaccatctgctgtgggttggagcaataggcccgtggctcaaagtccccaaaccctgtccccagcagggcattcaggtcaggaggtttgcatgaatgtcatcacagcaagctatcaggcccagcacacattagtgggaccccagggccctctgaccgtctgtacttgctctgattacccacccctaatcctctagggccccagggccagagtgttctctgggctgtttccctgcctggggatgggatcctctccctccttccagccttcccgagtctggctgtgttcagtctcttctagccggcttgaggcatcctccagggacaagccacagaatataaactgtgtaatttcagtgactccacatgagttaaatattctgaaatttgcatttaaaactggtgttgcacaatataaacagtaaaattcatgctgataattcacatttttaattgttctttactctgaacatgaaatagtgcataaaaaacatgacaagtcaggatggaaaccctggaagaaaagaaaaagctttaggtgtacctttaatgacacttttttcctccctttgaaacaaagggcccctagattatagaggcagctctgagtccacctcttcctgcagatactgttctgtcagtttgtgacaagcttctcaagagtcgtctgccacaactaggtctttctgttgtgaatgcatgcccaggtcttttggcattcttccccctccccactttaatttcacaagtaatactggcatacagtccttctgtaaaagattcatgcaattgatatattttttaaagtccaacagaacaacatccactgcattcccattcctataattacccaggaataccatgatctaagcctaactagagagtgtatttctagatcactttctgtatatttatttacgtgatatgtatgtgtggagacagaggagagagagaatatatgaatataagaatgtatggttttgtgtgttttaaactaatgatagataatatttatattccataactttttaatgtaatatttcaccttggagattatatcaaataatgaaaatctgcttcatcattttaaaatggctgtttagtattccataatatgggtgcattatagtttatcaaactaagattatttctattataatgtcacaacaacaacaaaaaaatatatatatatctttttgtatacatgtataagtatttctctaggagagacatccaaaaaggaattattttctggattaaagaatatgcttacttaaaaaaaaatttcactgatactgccaaattgccgtctaagaaaaccagatcagcttattttgtttcctcctctccccccatatgaacacttgataatattaatcttttatagtttcacctatctggtagacaacaatggtatatcatttgcctattacatcacttacccattttgctctctcaggttatttcttttaatttgttaatgtgttctttggaactgaatgaattgagtcttttttttttttttttgaggtggagtcttgctctgttgcccaggctggagtccagtggcttgatctctgctcactgcaacctccacttcacgggttcaagagattctcctgcctcagcctcctcagtagctgggattacagaagcctaccacaatgcctggctaggttttttgtttgtttgtttgtttggtatttttagtagagacggggtttcaccatgttggccaggctggtctcgaactcctgaccttaagtgatccaccgccttggcctccctaagtgctgagattacaggcatgagccaccatgccgggccccaattctaagtcttggctcttggccggctctatgtgtgtgtgttaagtacaatttgtttcagaataagtttagctttacagaaaagttgcaaagatagtacagagagttcctgctgacttcccctaatattaatatcttgcataactatgggacatttgttgaaaactaaacgattaacgtgggtacagtataattaaattgcatcaagttctgcctgttttaactctttaatttctcttatatgcttccaattttgccaattcctcctactttccaaatgtgaaaactattttggacatgttactttcgagcctctggactttcataagcttaggtgtgcgagggtgcctggaggaggcagagagcataaatacaaagtcacatagagggtccacgtggagtttcacatttctgattcagttcaggaaacttttttcctcatgctcacctttatgaaagaactgctgtgagacatttctgagcctcaaacactaaggggagagtagaagaaatttacagctctttagattagtctgtcctcccaagatggcagggagtgccaaattcattgccttaaaaaaaagaaaaaaaaaaaaaaagatttcttaaaagcagcagaagactcccccagagtataatgtttgcatttttttacaatgtgtgtgttataaaacctttataataagtctttcaaaacaaataaatgtaaaatacagaaaaattagtagaacttgctaaaacactgcattttaaaaagaggtaagcatactttttattttaaaaatgttttaaaggacgataaatacacatctgtaaaaagaaacactggaaggaaaactaagaacaagtaataatggttacttttagaggagacagagggcagcaatgatatgagacttttctagatatgccctataaaccactttggctctggaaacaaaaattcttacattaaaaaaaaaatacaatgaaatttaaaaaaaaagccatctctaaaagctgaaaacaaattgaagaaagaaaattaatttacattaaatcagtgacctaactaaatagataaaagaattatttccaatgacactagcatattctaatgaaagtggcactgtaaaaaaatcttaaatttaattcagtagtcttttagtaataacactattactctgaaactgctctatatgtgtgtatgtgtacatcaactaaaactgttacatattcattagcatgtcatctaatatgtaattacacatgtcagaataatattatttatatgataaatgtataataattatatataatgtattgtctaatatatgatgtaatatatattagtacattttacgtctattagcaattaacacacatcaatttatatgaacattaccatactatgtatataatagttttgaagctacatataaatatataagaatttcaaagtaatattaacattattatatattagtgtataataatgctaatattacatattattacactaatatatattaatgtgtgttaatgttgttagaaaccaagattttctgtttaagagaaaagagaaacaagtataaaataaaaaaagttaagattttgcaattctagtttaagttgaaaaactcagcattaatttttttttaatataatgcctagctctggccattgaaaaggactgggagtaatggaaattcaatagcaaggagtactcctaatgtccgtattgtaatctccaactaggaacagctgattacaggtctggagcaagaaatatacaagataatattgggacattttgggccagaaagcaaggaagttctcaaagaataatgagtcaaaaggatacagaagccaacaacaagtagctcttattggccaaagatgatacaatttgatcctcaaaagaaaagaaacaaacaaaggaagaaaagaaaaagaatgcacctgactgaaaaaccctgaatatctaaaacccattaattcacaataacaaaaaagagcaggaaagcaagagagcccccaaaacaaacaataacctattgaacacccctggataaaacttgggaaccaagtccgtactctgtaagctgtcaattaaaagaggagaaagaggagaatatattttgtatgaactttatttcagatagccaaataactctaattgctgagggaaagtttttcttaataaatctggaaggaattatagaaaatcatcatcctgtactacttaatgaaataatagattcaggcagtgatcatcaaaggatcaaatgatcaatcttagcatcactgaaggcaagacaagcaaacatttatgcctcccatgtgaggcaattggaagcacacagtagtatctatgaaggattcctgccaaaaagtgaaacctgaatgaaatccagtctacagggctaatgtgcataaacagaaatacaagggaaggaggtacaagttaaatgactccaaaggcaagctttacagacggatgtgggagggcctatataggaaaagagaccccattttaaaaacaagttaataaaaaagaaaaggaaaatgggactgctgtggattttatgtggatttcttttcaaatctactcactgtaaaacgacattttaaagacaactagagaaatttgattatggactgagtgttagatgggacctagatgtgacaatggcatcatgactacataaggaagggacccctttttaggagatacatgttgaaatatttacagttgaaatgacatgtttgggatttgcttttaaatacttcagcaaagagaaaaataaaaaatagaggcagcaaatgcggcaaaatattcaaaattggtgaatcaggcgatgagcacatggagggtttattgtattattcatctttctttggagtatgtttaaatgttggtgtacatttgacagttctttatcacgcaaatcaacaataacataaaaactgaaatatttctgtcagctaaaataggtagactgtaaataattgccatacattattcctgtccctgtttggatgtgccactgtggctcttctcatcaacagatggagtcttttcttccatcccttgaatctggtcagcagtgagaactgctttagttaaagggtaaacatgacacaagcagaggcttgaaaagcactagggcattggggcggctgagagccctgggcctaccacaggagaagttcagactagcttgctggagaggtcatgtggaaaagaaatgagaccctggctgagggtctgccaacctgtagacatatgagtgagggaattgtagaccacacagccccagccaagccacaaactgactgcatctgcagagtcagcccaggcaagtctagctgtctgagccagatttgccgacgcacagaatcatgattgttttttaatatgctaaatactgaggtggtttgttacatggcaatgactgactgatacataaggataaacctatagaagtactatacacatatgcagaaaactgtcttagcttcttagcactgtgagggacatgccatgtactcaataaggatgtctgaatgggaattccatgtcactagaaaatggtatatatggaaactgtctaaaggcaatggaaggcttaggtagactacttccttttgtgtatatgaagtactatcaaaccaagtagttactccactgatagaggcagatgtgggaagataaactatgtagaactttttttccttggaagactaaaaaggtctggctttgccgctggtcaactatgaccagacactacggaaacagtcattgagattgctggcagatggcctggcctttctcccctgacacaattctgcaacccaagtggccagtgtgtggagagaacacacatccctgtgagaggccgcctagcttttcctcccctaagggccacactgggccaccccagcacacatcaacttggctggcacactttcctgcaaagcagattccactctgtgtactctgagaacaaatcatgtttcctccttgccaaaggtttttgcttgcaaatgttggatccaggtataaggattaatgagggaatatttagagtgccacaaaaaaaaagttctatatagaagccacagaagtacatgtggatcttctagtagaggtattttttactaaaagaaaataccaaaacattttcatcttaaaaagctcaagtaaatctgatcaatttagcagaatcacataatttgtaataatatacgtataaggattgtgtagttaatcttagtatcattagcaaaatactatacttgtaaaagaaaaattcaagatagttaaatatttctccataatagtagctatttaattggaaaattttttgttttctttgagacagtctcgctctgtcacccaggctggagtgcagtggcatagtctcagctcactgcaacctctgcctcccgggttcaagcaattctcatgtctcagcctcccgagtagctgaaattacaggtgcacaccaccacatcctgctaatgtttgtatttttagtagagatgggatttggccatgttgggaggctaatcttgaactcctgacctcaagtgacctgcctgctctaacctcccaaaattgctaggattacaggtgtgaaccaccacacccggcctacttggaaagtatttttaaattaattgatactttaatctttgatgaatatagctattctcagtatattaaaatgactactcacacaacgccacccacatttacatgctaatttatccaacctcctcatttatatttttaaagatgcaatataatttttgtaagtatatatatatatatatatatatattttttttttttttttttttgagacggagtcttgctctgtccccaggctggagtgcagtggcgcaatctcggctcactgcaagctccacctcccgggttcacgccattctcctgcctcagcctcctgagtagctgggatacaggcgcccgccaccacgcccggctaattttttgtatttttagtagagacagggtttcaccatgttagccacgatggtctcaatctcctgacctcgtgatcggcccacctcggcttcccaatgtgctgggattacaggcatgagccactgggcccggccgtaagtatattttttaaagcttaagaatcttgtgagtaaatagggattttttttttttttgagacaaagtctcactcttttgccaggctggagtgcagtggcgagatctcggctcactgcatcctccacctcccaggttcaagcaattctctgcctcagcctccagagtagctgggattacaggcgggcaccacccgcccagctaatttttgtgtttttggtagagacagagtttcaccatcgtggccaggctgttcttgaactcctgacctcacaatccacctgccttggcctcccagagtgctgggattacaggcatgagccaccgcacagccggcctgagatgttttatactattttgcagtagcaaacttctatccagtaaatgtttcaagtatctttttgaaccatgactttggagttaacattattcaatgaggttaatgacacaaaaagataattaaatatggtgaacggaaagaatggacagtaaaagctaagaaaaattggtggcagcttcattatttgtgaaactaaacttgaaggggacaaattaaaacttgcagctgagcttcaagtgcagcaaaaaccggcagaaaccagggtccccacagggattctgcgctttggggagaacttctgttcttctgctcctgttttgtcctgttttgtctttctgaaaaggcaacacaaagagctgaggaaaagccaatagattcattatcattctacctaataataaaataatgttctcttaacaaagtgtggacacacatggcgaaggcatcagaaagaacctgatggaaataatctggaaaaggtcttttgggaatgaagtttcctcatctgcagaatggaggaggggtaatgagaggggcttgttgggggccaggagaagtgggctggatgaattccaagatcctttatagctataactttcagtgatctaggttaaaagctgaagatctttttcatccctgactatgaggccaatgtgagatgtggttatctgtaggtcttacagtgcttattataaaactatatattaatactttgtttccatgaaaagctctaattttaaatgtgggtaattttaaatgtgattaatatttccataacggagtgcatattatatgaaaatcaaaagttttataaaagctgggcacatttaaaaacatacaaaatcccagctcagcttaagtatatggttgcaagagtgtgtgttttcaaagggtggggcttcctgtctctggattgtttggaaacattctgacaaagccaaattcatttcactgatatcctgaatgcagcaaggaactggtgcctaaaatagcacaaaattgcctgtagtcccagctactggcgaggctgaggtgggaggatcacctgaccccaggaggttgaggctgcagtgagctatgatcgcgccactgcactccagcctaggccacagggcgagaccctagctgcaaaaaaaaaacaaaaagcacaaaacatgatactctaacatgtagaatcagtttaagtcaactaagaaatgtgataaacacccaaaagatttcaaatctgtattctctaaatccttttgagagagtctccacaattagctggactggaaaacttagcaacatttagcatacttttcggtcacatattcattcattctttttttaactattcaacaaataggtaaatagatggacggggaaagagagagagagagagacagagagagacagagagagagagaggagatagatacctcttactacatgccagaaacaatttcttttaaaatttttccagtttttttcttctttaacttcatactccctttgtctcctgtctttgttgggtatgattattcaagaatacatttaacttgtggcactaaatccagagcactctctaatagggagaaaacacaaccactgtggtgtcaggaggaggaagtaaatgtgtgagcagcttggtacactcttcactatcctcacctcaaaggaaatacagaggtggatcaggaagccagtttcaactggacttactgctgcttcttgctgacactattgttacgttatctgtgggatgatcaactttttttttttttttgagagacagagtcttgctctgtcgccaggctggagtgcagttgcacaatctcagctcactgcaagctccgcctcccgggttcacgccattcacctgcctcagcctcccgagtagctgggactacaggcacccgccaccacgcctggctaattttttgtattttagtagagacggggtttcaccgtgttggccaggatggtctccatctcctgacctcgtgaaccacctgcctcagcctcccaagtactgagattacaggcctgagccactgcgcccagccgggatgatcaacttttaaagagtcaacctgggacacagtgataatgacaaaaaccataacaacataacattgctatggtctgaatatccccccaaattcatgagttgaaacttaatcaccaatgtcatagtattatgaagtggggccttcagaggcaactaagtcatggagacagagccctcatgaatgagattactgacctgataaaagggctggagggagagagatcacccctttttacccatccatcatttttctgcctctgtcatgtaagaaaacagtcttcctcccctctagaggatacagccacaaagtgccaacttggaagcagagagcagccctcaaagacaccaaacccactggcgcagcccccttggaccttgcagcttccaaaacagtgagaaataaatttatactgtccataaattacccaatctatgatattttgctatagcaacacaaatggactaagacaaacataaaagaagtaattacacatgtgttactgctttaacacagaaaagatgtggaggtgaaatatattattctgtattatttacttttctgtaacataaatgttattatttaaacagaacaacaatagaactagttaatgatagtaattaatagtagaacaaattaagcaatgtgtgagaaaaatataacaatacttttaaatgtttctttctgttctctgatacaggagtttattttaactatttttttaaaaagtcttcctagcactttggtaggctgatgcgggtggatcacctgaggtcgggacttcaagaccagcctgaccaacatggagaaaccccatctctactaaaaatacaaaattagctgggagtggcagtgggtgcctgtaatcctagctactcaggaggctgaggcaggagaatcacttgaacccgggaggcggaggttgtggtgagccaagatggcgcccttgcactccagcctaggcaacaaaagagaaactccgtctcaaaaaaaattaaaaacaaaaagtctctatttgttatttaaattttgtaggctttatatgttgtgtattcttaacacatataaatgtacgacttttacaaagaaaacataaatacaacatggctaatttaaaagatagtacctatatttagtaacaacagcaaaagatcatgtcctgtttctttctgccccatgacacagtgggatatctttactctttctgtttccttttccaataacacttctttgaactgcctgcagtggtaagacatatctcttttgacttgcacctctgctcttctcaagcgcacaatacactgattcctggtatcaatccaatgtgatgacatcaagctaaatatcctctcaaaagcatctgagtgtggaatacctataattttatttcctagcaagaataggattttagacttaggaggattcatttccagctctccaaaaatgtccatccctttgttaattaggttgttagcatctataaattcatcacataggctacacatatataaaatatccactgttctataaaaccttttattttgaaacaatcgtagattaacaagaagttggccaggcatggtagctcacgcctgtaatcccagcattttgggaggctgaggcaggtggatcactggaggccatgagttcaagactagtctggccaatatggcaaaaccctgtctctactaaaaatacaaaaattagccaggtgtggtggtgcacatctataattccagctacttgggaggctgaggcataagaattgcttgaacccaggaggcagaggttgcagtgagctgagattgcaccaccgcactccagcctgggtgatggagtaagactgtgtctcaaaaaagaaaataaaacaagaagttgcaaagaaatgtacagggtagtacaagctacccacacccagcccctccaatgtgaagaataccttacataactctagaacaatattcaaaccaagaaattgacattggtacattccaaacatgttattcagatttcacctgttatacatgtactctgtgtgtctgtgtgtgtgtgtgtgtgtgtgtagtgtgcacagctctctgcaactttatcacaatgtagtctttcttgtataaccataaccaccaccaccactgagggatttaactatgccttcaccacaagactctctcatgttactccttacagcctacacccatcctctctccccagtccctaacccctggcaactactaacctgttctccctctctataattatgttacttcatgaacattacataaatggaaccatacagtacgtaacctgctggaattatgtttgttcatcaccgtaacttccttgaggtttatacaagttgttgcatgtatcaatggttccttcctttttatcagaatagtaatccacagtaaaaattcaccttttttttttttttttttttttttgagacggagtctggctctgtcacccaggctggagtgcagtggtgccatctcggctcactgcaagctccgcctcccgggttcacgccattctcctgcctcagcctcccgagtagctgggactacaggagcccaccaccatgcccggctaatcttttgtatttttactagagacgaggtttccctgtgttagccaggatggtcttgatttcctgacctcgtgatctgcccgcctcagccttccaaagtgctgggattacaggtgtgagccaccgcacccggcctaaattcacctattgaaggacatttgagtggtttccaaatttcttgctattataaaaatagtggctgggtacagtagctcatgcctgtaatcccaacactttaagatgccaaggtaagaggatcacttgagcccaggaattcaagactagcctgggcaacatagtgagacctcatctctacatttaacagtttaaaaattagcagggtgtggtggtgtgcacctgtagtcccagctactcaggaggctgaggtgggaggattgagcctaggaggtagaggctacagtgagctatgactgtgacactttactccatctttggtgacagagagagaacttgtctctaaaaatataaataataaaataacaagaaaaatattatacgaaaaccgtgaaactgttatgaacattcctgtacaaatccccatgtgaaaataactcttcatttctctggaataaatgcctaagaattgaaatgataagttgtatggtaaattcatttttagttttgaaaggaactaccaaattgttttccagtgtggctgtctcattttatattcctaccaccaatgtaggagtgatccagtttctttgcatccttgccaacatatgatgttttcactattttttcactctagccattctgatttgtgtgtaatgataccttgtggttttattaagaatttgcatttcttcaaaagctaatgacattgaacagcttttcatgggcttacttgccacctgcatgtccccttgatgaggtgtgtgtgtcttttgtccagtttctaatcagatttttttaaactattgagttttgagaggtctttatatatttatgtgcaaggactttgttgaatatgcgatttgcgaatgcagtattttctctcatctagtttgttttttcatcctttcagcagactctttcccagagcaaaggttgattctgatgtgttctaattgatcagtttttcctcttatggattgtttttggcatcaagtctaacaggtcttcacccagtcctaagtcctctctcttatgaattttctagaagttttatagtttcacatgtaagtttgtccatcatttttaaacactctgaagagatgttattaagttaaacgtctctttctcaggttgggcaagagggaagaaatgtaggtgaggatagacgaaggggcgataagaaagggtgacggaagacaggctcggcagactttcccgtgagagaaatgctccagacagcaccctgttcctccaggagctgaatcttgggcatggattctccctaccccatccccgcccatcctgcccacaacactgccccaggacacgcctcctgaggccaggcagcctccatctttatgtggccaaagggggtctaggtagttgtcagcttcagcttctggaaagagaccagctgctgtatccagtgggtcccagtggtttgcttagataggatgccactcactatgccaggtgtttgggatagaagaaagaataactggaaggtctcagtattcaaagaacctacagtccagagaaggacacaaaataagaaagaagagagcaagggctaagggtacaggtaggagagagaagcagaaaaggggagcataactgagacttcgggaaggctttcctaggagatagcactgtagatgtgtggctatctgaaattgcaaactgtgaaccagagaataagagttcctgcatttcaaagtccttgaagtagatttcaaagggtaccagtttgagggctgctcttctaaaaataggacactggcatttcccatgagcaacaagaactcacaagaaggtggaatgtgactggataaggctgacaacaaggggaagcaagcctgacattctccccaccagcctggaagtctgggccttagcaaatgtgaaaggctagggttcaagctgaaaccccgtgtccttatgtaacctagacgaggctgcagtttagttgggctaggctacggccaaaagcttaccaagcagaaattcagggggaaaatatttcagcaaaaatatttaacccactgaaaataatttatacttgttcatatgtttacaaacaacctgctgattaaaatggctcttaactactcattaaaaggaggcccacccttcaggacctatactttgcaacacttagttactatttaattggagatacagtataagcaaaaatatgaaaaggctgcatttctttatatgctataattttactttgtgatgattctaactttctctgccctcaattagtctgatttagtgatgtcttgtcatgtataggctataaaatcctgatgctgtttctcaacttgccagtcagaatagcaggattaataaattctcaagatttttaaaagatcaaaattggagcccctgtttttttccttccttcctcctcctccctccctcccctcctttttccttcctttcttccctgatttttagtaacatttatcataaaaaatacaacctatatatttcttgaccataacttacatgtgattgagaagcatcgaattagagtttgtggtctctgtcttccaatatcttgtatgtactatacataataaagttggttcatcatcataactggggctttttaaagccagaaccccatcaagaattcccataagtaggaacatttccagaagtggtagggtacagtaagattttttgatctgctggtaaacgctgacggggatacccacttaggctattttattttgaaagagcgatgaaaatttgagcaaatgatagcttccagatacagtaagtcctcacttaacatcattgatagagtcttagaaactgccactttaagtgaaacgacgtataacaaaagcagttgtatcataggttcattgatataaacaagagttaagttcctggagcgtatttctggccatgaaaacatcaccaaacttctaaataaaagccccaaacgcttctaactattaagcattgaaataaatgtgagctatacatacatttaagaaagattaataagaacaagtaagatagctatttactcaattcttccattatcaggaataattaattgagtctgccagatcgtgtcccaacagctcagggtgcaaggagggaaccaaccctggacagtatgccatcccccaccgcaggtgcacccacacacacccacactcacactgggaccaagcagacaccatggttcacctcacatgcacggctttgcaatgtgggaggaaaccagagtacctgcagaaacctacagagacatggggagaccatgcaaactccacacagacagtggccccgcgccaggaattgctttctagtcaatgttgtaagaaaatgacattgaatgaaatgatgttattcaagaacctgctgtaaaggaaggccaatatatgatcagaagtgcacatctctaatgaagaaatcaggaagagccattttgctttcccttaaccctgctgcccccaggtaacaatagtaagtttccttcagttacccctttcttttccacatagaagaaggaaatttcacttttgaaatgttgaattatcctgttttcacgcaagcaaagttgcataatggtcttggctttgccagctacatggtgtctacaggtggacaaaatgcctatttctgtgtccttaccaataaaaatgggataatcactgatttttttaaaaagtcattgctataaagattaaaacgaactcctgtatgagaaagtaaataaaaccactaaaaaatatgagtaaaaatgctcattttgtaaccaaatgattctttatgtcccttttattttgtcctgctatttgctattgattgctgttcctatctttgacttttctttctgttttttttcttttttcttttctttttttttttctttttttgagacggagtttcgctcttgttgcccaggctggagtgcaatggcgcaatctcggctcactgcaacatccgcctcccgggttcaagcgattttcctgactcagcctcctgagttagctgggattacaggtgcccaccaccacacctggctaattttgtatttgtagtagagacggggtttctctatgttggtcaggctggtctcgaactcccaacctcaggtgatccgccagcctcagcctcccaaaatgctgggattacaggcgtgagccaccgtgcccagcctacctttgatttttctatcaatgcaaagttggaggagttaagcaaccattcctaagatgaagaaagttatcttctagaccaaattcaattttcagcagtaaggaacagacaaaaaatcctcttcccctgccccacagcttccattgtactagaaaaacacagacaacaaataaaacaaataagaaaaatatgtgaaatgttcaatggtagtaagtgctagagaggaaaaactaagtgaagaaagtgaaggaggaggatagggcatctgtggggaaggcaggggacggctcaatctatggattcaggaagggtgtggtctgcgtgctcccagtgtgagtgtgggtgtgtgggctggaagaggccagggagtgagtcacatgtacatccaggaaaatgcttccaggcagaagggacagtaaccacaaggtgggagaggccttgatgtatctgaggacagctggagatcagtgggctgaagcagagtgagaattgaaggggaggagagcaaagaagcagcagagctgggctagggtgggcagagcaccagagtgactgtttttttgtgtgttgttttgaaacagagtcttgctctgtcgcccaggctggagccttgagacggagtctccctctgtctcccaggctgcagtgcgcggctcactgcaacctcctcatctcgggttgaagcgcttctcctgcctcagcctcccgagtagctgggactacaggcatgcatcaccacgccggcggatttttgtattttagtagagacagggtttcatcatgttggccaggctgatctcgaacacctgacctcaagtgatctaccctcctcagcctcccaaagttctgggattacaggcatgagccactgcacccggcccacagtggctgttctaacagaaacgctgctgctgtgcagagaaggaaggcaagagcaagggtggacacaggccagtgaggtggcaccagcagtgacccagggatgaggtcatagcagcctggaccagacagcatcagtggatgtgctgctggactccagacacatggtgaaggcagagctgacaagatgcgagggtagactggatgcatggtatggagaaagcggggagtcaagattttttatctgagcaactagaaggacagcacagccatctagtaagatggtaaagacttctggaaaagcaggttttggaggctgatgtcaggagcaagtttggggcacgttatatgtgagtcatgtattacatatccacctagaaatgttgagtaggcaattggtgagatcaatctggacttaaggagaaatattcaggttggaggtacaaataatcatcaatttaagatgctatttgaagccatgaggaggggctagctcacaaagcagggtgcagataccaagaagagatccaagaccaggctttgggcatgccaatggtaagaggtttgggagaagtggcaatggtgactaagtttgagtggacagtaagacagagtatggcatcttggaagccaactgcagaacatgtttgaaaaaggaactgattgaccgtgacctgtgtcaaatgctattgttaggctaagaagatgataacagaaaaatgaccaaaatggatactcccaagccctcaaacaaagtatgctaaagcagtttttaatgttttaataaggtcttaagtttaagatgagaatttgcacaaatatttatatcctctcctaaatctcactaaaatgaccctaaaaataagaaaggataaagacaatattggtcaggctatgtctcttcctctctcttccctaaactctaaacagatgctgggattaattcaaagatggattttccagcttaaactgactattcatcccaggaaatccagaggaatggaagccccagagatacaaaaggaaatacgaaacctcccaggactccagcaggtttgtgaggagataacaatataggtggagtgacaagaagacacacataaaaagtcaagcaaaataaagaagacaaatgtcaatttacaaaataaattgtactggctgggcgcagaggatcacacctgtaatcccagcactttgggaggcagaggcgggcagatcacgagggcaagagatcgagaccatctggccaacatggtgaaaccccatctctactgaaaaaaaacaaaaattagccgggcgtggtggcaggcgcctgtagccccagctgtcgggaggctgaggcaggagaatggcgtgaaaccgggaggcggagcttatagtgagctgatatagcgccactgcactccagcctggtgacagggcgagactccatctcaataaataaataaaattaaattaaaaagttgtactaataatctaacatagttttcactattctattacaaggcagcagagagtgctggctcaccagtggccagggggaggtcaacattcacatggattaccatgagcttctcaattcccagtcttatctccattccctctcagctacacatatgcatgggcacacaagggacttctccatcatcccaaactgcctcctcccccaactcactgcactcacacctcctaaccacacacacttaactcctatctttgcgtctttcttctcttgcctcctgacccctccaatgcattctctacactgcactcaactgatctttaagagacccatcaccataacctctcctgcttataatcctgcaaaactgaagcccacatccttaatatggcctacagctcctgcagatcagaccttcctcccaggcttgtccaatgtctttccattcactgcgatagccccagtgagggtccccccagttctaggatggcaccatgctccttcccagctcaggccctgcacctatgctgcgcctttcattgccttctccaccagtgcctgacatggcacattagaaagctttcggttaataactacttctctattcacttgctgatttgatatcagggagttacacacaagagaagggagacctggataaaagggggaaatgacaagcagagagagcaaaatgatcagtttattcactcattctagacatattgaagaggttagggaggtccaggtaaattggagcagtggaaatcttaaagagccaggggtcaacatatcagccctacaaaagaaaacaaggggcctgatgcggtggctcacgtctgtaatcccagcactttgggaggccgaggcgggcggatcacgaggtcaggagatcgagaccatcctggctgacatggtgcaaccccatctctactaaaaatacaaaaaagttagccgggcctggtggcgggtgcctgtagtcccagctactcaggaggctgcggcaggagaatggtgtgaacctgggaggtggagcttgcagtgagccgagatggtgccactgcactccagcctgggcaacaaagcgggactccgtctcaaagaaaaaaaagaaagaaagaaagaaaacaagggctgagatcaaggaaaatggtctgaatacatatcaatgcctgattcaagtaatgtttggaagaaatcagtaaatatttattgaacacttactatatgcaaagcaacatagtacaaaacgatacatagtttacttttgtttacttgtttatttaatttttttgagacggggtcttgctctgtcacccaggctggagtacagtggcatgatcacggctcactgcagcctcaaactcctgggctcaagcaatcttttcctctcagcttccagagtagctgggaccacaggtgcgcaccaccacacccagctaatttttgtatttttttgtagagacgagttttgcatgatgcccagccaagaaccagccttttgattttttgcttttttcttttgttttcctatttttaattctattaatttctgctctttattattcccttcttttgcttgctttggctgattttgctctcctttttctaggttcttgaggtagtaaattaggttactgatttgatgccactctacacttttaaagtaagcacttgggctgggcccagtggctcacgcctgtaatcccagcactttgcgaggctgaggtgggcggatcacgaggtcaggagattgaaaccatcctagctaacaaggtgaaatctcatctctactaaaaatacaaaaaattagccgggcgaggtggtgcgtgcctgtagtcccagctgctcgggaggctgaggtaggagaatggtgtgaacccgggaggcggaggttgcagtgagcagagatcgcgctactgcactccagcctgggtgacagagctagactctgtctcaaaaaaataaaaataaaaataacataaataaaaaatagagtaagcggttagtgctattcatttccctctgattcactgctatggctgcatcccacatattttgaatatgttttcaacatatgtttttatttccaattatgtgtatttttacattttctttgagaaaactttctctttgacccattgattatttagaagtgttgttttatttccacgtttaaagctttttcctgttgtgtttctgttactgtttcctagtttgatttcattgtggcagagaacatactcacatgattacagttattttaaatttcctgaggcatgttttatgacccaagatatgatcaaatatggtctttcttggtgaatgttccatgagtgcttgaaaaaaaaaaagtttctgctgagggttgggttactgttctgcagatgttaatcagatcctcttagattgtgttgttcagatcttctttccccttgctgatttactatttagtatttctcagttgctgagagggtgctgtgatcctcaactataattgtgggcttgtctaggtctctttacagctttatcaatttttgttttgtgcatttttgaggctatggtgtttggtgcatatgaacatttatattttaagtatcagttatattaagcatatcttaaaatgctgaaaactctatttctagatattatctatgtagacagcctgatacattttatagtagtaacagaggaagttgactagagacaaatttaaaaataaaactttcagtatagataatgcagaaactattggctgggcatggtggctcacgcctgtaattccagcactttgggaagccaaggcgagcggatcacaaggtcaagagattgagaccatctggccaacatggtgaaaccccatctctactaaaaatacaaaaattagctgggcatggtggcatgtgcctgtagtcccagctacttgggaggctgaggcaggagaatcatttgaaccagggaggcggaggttgcagtgagccgagatcacaccactgaacaccagcctggcgacagagtgagactccatctcaaaataaaaaaaaaaagaaactattatcccaacatattattttctgtggttttttttaaatatatggagaactgatggtgctacgtttttataaaatactctttttcacataagataaatagaatatataataacttgctgacatatcatcagtaaagacttctaaatgataatgtaacatctctgaaacatatcttataaacaagagaaaaaaagagtagaaccaaaatgaaactttaaatttaattacattaaaattaatgttttgagtaggttttgttgaataactagtaggcttgacccttggctaaaaaataattttcttcacgaaatctacatacagcacttctacctttcttatatttgccacatttcattttgtgttatagttacatgtatgtttgttttaatagtattactacattgtttgtacacagccacatgtatggtatgctggttttaaaacatatatttacaaagtcttagatactcagcaagtggagtttattccactcaccccgcaccccccactgttttaatgtgggcttagtgactcacttctttttaaaaacaaattttatttaaaaaaaaaaaaaaaagaccaggcatggtgactcatacctgtaatcccaacattttgggaggctgaggtgggatgatcacctgaggtcagcaatttgataccagccttaccaatatgacaaaatgctctctactaaaaatacaaaaaaattagctgggcatagtggcatgtgcctgtaatcctagctactcaggaggctgaggcaggagaattgcttgaacccgggagtcggaggttcggaggttgcaatgagctgagatcgtgccactgtactccagcctgggcaacagagaggactccgtctcaaaaaaaaaaaaaaaagagacaaggtctcatattgtccaggctggtcttgaattcctgggcttaagtgatccacctacctcggtcttccaaagtgctgggattgtagacgcgaaccaccacgcctggccattagtgactcacttctaacaaacagaataaggcagaagtgatggcgtgtcctgcagatttggtcatgcatggccctgtgggttccttgttctctcttggatcactcgctctggggaaagccagatgctctgtcatgagggcattcaagcagcaccctggagtggtctatgtggggaagaactgaggcctcctgccagcagccatgtgctggagttaacctgagagcagatcctctagccttggatggaccctggatctaaacctcacaccttatacaaaaattaactcaaaaacgtatgacacttaagtataggtgcctgtagttctggctgacgtcttgactgcaacttcacaagaagtgctgaaccagaaccccctcaactaagctgcttctagagtcctatttattgtgaggaatattattttagagactttgtgaaataataaatgtttatttttgtttgtttttgtttgatacggagtctcactctgtagcccaggctggagtgtagtggcgcaatctcggctcactgcaagctccgcctcccaggtcctggtttaagcaattctcctgcctcagccacccaagtagctgggattacaggcacacgccaccatgcccagctaatttttgtatttttagtagagacagggtttcatcatgttggccaggctggtcttgaactcctgacctcgtgatccgcccaccttggcctcccaaagtgctgggattacaggcatgagccaccgcgcccagccaaatgtttattgttttaagccaccaacttttgttatatagcaataaataaataaataatgaaataggctgggcacagtggctcacacctgcaatcccagcactttgggaggctgaggtgggcagattgtttgagcccaggaggtagagaccagcccggggggtaacagagcaaaaccctgtctctatgagaaaaaacaaataagtaataaaataaaatataggctgggcacagtggctcacgcctgtaatcctagcactttgggaggccgaggtaggtgaatcacttgaggccagtagtttgagatcagcctggccaatatggtgaaacgctgtctctactaaaaatacaaaaattagctgggcatcctggcatgtgcccgtaattccagatacttgggaggctgaggcaggaaaatcacttgaatccaggcggcagaggttgcagtgagccaagactgtgccactgcattccagcctgggcaacagagtgagactctgcctcaaaaaatacatataaaataaaaattttaaaaataaaataaattatagaaaagaccagctctttagggaaaaaacaataaaattgataaacctctagcaagactgacagaaacaaaaagcaaggaaacataaaaaatattaagactaaaataagggatatcactacagaccctacagtcgttattagtataataaccaaatactataggcaattttatactctgaaatttgataactcagaagaaatgggcaaatacctcaaaaaccacaaatagccaacacggatgaaacaggcaatctgaatagccctattaccaatttaaaaaaccaatatctaatttaaaaactcccaaaagataagtttccagggccagatggtttcactagagaattctaccaaacatttaaagaagaacaacgccaataaaaatccttgcaagatatttgtagatatagacaagactattctaaagcttatatggaaaggaaaagaaattagattagctaaaacaattttgaaaaaaataaaatggaagaaatcagtcttctggatttcaggacttattatatagctatgattaagactatgtagtattggcaaagggatacatataaagatcagtggaacccagaaataatcctatgcaaatatgcctgggagccaggcatggtggcatctgccttctacctatatcatatatgtccaactcttttttcataaaggtgcaacagcaattcagtagaaggatagccttttggataaatggtgctacagcacctggacaatcacaggcaaaaaaaaatgaccctggatctaaacctcatgccttatatgaaagttaactcaaaatgtatgacacttaagtattataaaattataaaacttttaaggtaaaaaatgagaaaatctttgagctctcaagctaggcaaaaatttcttagacctgacactaaaaggacagttcccaaaaggaaatattgataaactggacatcatcaaaattaaaaattttttgttctgctaaagagctgtgatgaggatgaaaagacaagctacagaatgaaagaaaatatttgtaaaccacatatctgacaaaggactagaatatacaatgaagtcttaaaattcaactgtaaaaaaacaaacagcccaagtaaaaaatgaacaaaagacagacatttcattgaacaggatattccgatggctaatggaccacaaaaagacattcaacatcattattcctcagagaaacgccaattaaaaccacaatgagacatcactgcatacctgtcagtgtcatacctatttggtgacagcaccaagtgtggagaggatgtgaaaaaattggatcacttgtacattgctgggaatgtgatatagtacagccactctggaaaacagtttagcagtttcttaaaatccaaaacacgcaattaccatacccagcaattgcactcttaggcatttatcccagcaaaataaaaacttagggccgggcatggtggctcacgcctgtaatcccacactttgggaggccgaggtgggcggatcacctgaggttaggagtttgagaccagcctcaaaatggagaaaccccgtctctactaaaaatacaaaattagccaggcatgtggtgcatgcctgtagtcccagctactcgggaggctgaggcaggagaattgcttgaacctgggaggcggaggttgcagtgagccgagatcatgccattgcattccagcctgggcaaccacagcgaaacttcatctcaaaaaaaaaaaacaaaaaaacttaggttcacacaaaaacctgtacacaaatattcatagcagcttaattataatatccccaaactggaatcagcccagatgttcttcaataagtgaatggttaaactgtggtattcaccccatggaatattactcaataataaaaagaacaaactattgatacatgcaacaacttggatgtatctctaggaaattatgttgagtaaaataagccaatcccaaaagtttcattctgttttgggttttaaattccatttatagaacattttaaagtgataacattttaaaaatggaggatagatcagttcttccagcatctggggaccagtagaggggctggaggaacatgtgtgtgattataacaaggcaacatgagagagtctcctggtgttggaaacgttccatatctcaatccgatagtagatacgtgaaccaatgcaggtgatactgtacagaacttaatatgcacaaattcaaataaaactggggacatctgaataagatcagtggattaacatcaatgctaatatcctggttatccttctataaaatattaccatttggggacattggacaaagtatacaaggcacttctctgtaacaattctcataactgcatgtgaaactataaataaaaaatattaaagatgatgtgaacagagatacacacttttaggtggctgtatttttccccccacaggagtcatacttaacacaatggccaagctataaaaattgaatgagaggaactgatgtcctagggttacttatcaacatatctaaagtaaaataaatacaagcatagtttttaaaatttcaaagctctataaaatgcaattttacaaggttactaaatgtgcttgttttcaggatcctgaaggcaatttcctggtatcaaaacccacatatcctttattgagaatgacttgcacaacactattctgcattacatgggaataaaatgatgggtggttttttccgagagaacatatccaggagcaacgacgcacctgcagttggagcagatagtcgctatactttcaccgcatcaccactagatttccatgaattctgcatgagaaaactgtgactgatatgtcagttttttcacttagtttatagtacacgcaaaaataacatggccagtctcttgccatgttatttccaaagaaaattacttggaaaatatacctttcaccaaactctaaatccatgtgcaaaatgtaatattttatacaccatataaaaataccaaaaaacatctagcagtaccaaatcaagatgagacacaagagagggatcctatgcactggtagctgcaggatggcttctgtagtaagttgtatggtgtggtctccaataagatatgtcctaatcccagaacctaggaaggtgaccttattggaaaaaagggtctctatagatgtaagttaaggatttggggctgaagagatcattccagattatccagatgggccctatgtccaatgataaatgtccttataagagggaggcagaggaagattggtccgagacaaaagaggggaacgtgatgtgaagagggagggaaagattagagagatatgaccacacgtccaggaatgccagggcatcaccagaagctgggagagacaaggaacacattctcccctggctctccctcagggcgtgtgaccctgccagattttggagttccagccttcaaaactgtgagtaaaactatttctattgctaaagtcaccaagtgtgtggtgatttaggatggcagccacaggaacagtttgactcccttcacccggagtacaatccacgcacctgccaatcaaagcaacaaagtatgaaaatcactactttaaaaactcaagacaaaagaaacctcaaaaatactagcttatgtaaccatgagaccttcaaactggccttgaattcagaataaacaagaaacagccaaatagaaagctatcattgaggaggggaaaaaaaaaggttagaaacaactaacttttaattctgttcaaagagaagcagtactaccaagatatcaaataaataattcctttaattaataagcaatctgcaaagaatgagcataaaattgtgaatatgagttaatttgatacttccactgtataccagaaacactactttaaaatataatggaaaaaacactcctttcacaaaagtaatgaaaaatatgaaacatagtttcaagaagtaactttaaccaaccttgcatggacctatatgaaaaaaaaataaacagcttttattaatcattgtttatatcttcaagaacacttgaacaagtgggacctgcttggttgttgggtagaagattgagtaactgtaaggtacaagttagtctcaagatgctgacaagtttgacacatgcaaaaaaagtcccaaatatattttttgagtgaagttaatcaaataactccaaagcacaactggtatgaaaatctagtgagatcacaacacaaacaatagataaatgtttgaagttatagatatcccaattaccctgatatgatcatgacacattgtatacatgtatcaaaatagcacgtgtagctccaaaatatgtcaactattccatatcataattaaaaaaataaagtgagaaagaaaagatttattaacacttatagccaggtgtggtggctcacacctgtaatcccagcactttgggaggccaaggcaggtggatcacttgaggtcaggagttcaagaccagcctggccaacatggtgaaaccccgtctctactaaaaatacaaaaactagctgggcctggtggcacgcgcctgtaatcccagttactcaggaggctgaggcacgagaatcgcttgaactcaggagatggaggcttcagtgagccgagataacaacactgcactccagcctgggtgacaaagcaaaactccatctcaaagaaaaaaaaaaaagacttataaagtaaactaatgggcatagtgatgacacggtctgctaaatattaaaacaggacataaaggtacacttattaaaacgtaaggaacaacatacagctgcacgaagcatatgtccatataggaacttgtatgcaaacattcacagcagcattatttcataagagccaaaaagcaaaaacagcacaactgtgcttcagctgatgaacagataaataagatgtggcatatccatacaatagaatattattcagtcataaaaatgaatgtagccaggagaggtggcatgcacctgtagtcttagctactcaagaggctgaggagggaggatcacttgagcaccgggcaacatagtgagaccctgtcactttaaaaaaaaatgaggctttcctctttacttctacaggtattgatacataatacaatacaacatagatgaaccttgaaaacattctactaagtgaaagaagccagacacaagagaccatatattgcactattccattaaaatgttcagaacagataaatccgtgagacagaaagtagattagtggttgccagagactgggggaagggggaatggggagtgactgctaatgggtatgaaagccttttgggtgtgatgaaagtcttctggaattatagttatatttttaccttgtatcatgtcaagaaataaacttcagatggagtaaagatttaaaaatagaaaataaagtcatgaaagaacagttggacctccgtatctgtgagttctgcatccgtggattcaactaacaacagatcagaaatatttcttaaaaaaatatgtgggtgcggccaggtgtggtggctcatgcttataatcccagcactttgggaggctgaggcgggcagatcacgaggtcaggagatcgagaccatcctggctaacacggtgaaaccccgtctctatgactgtgccactgcactccagcctgggtgacagagcaagactccgtctcaaaaaaaaaaaaaaatgtgggtgcatctgtaccaaacatgtacaaactttttttcttgtcactatcccctaaataatacaatataacaattatatacagagcatttacattgtattacatattataagtactctagagatgatttaacatataccagagggtatgtgcaggtcatatgcaaatattattcaattttatataaggaacttgaacatccatggattttgatatctgaagggggtcctgggacaatcccccatatataccaagggacaactatactataagaaaataaagaataatatttctataatcttatattggggagtccagtctaaatatgacatggattagagaagttataaaagacatacagacttaagcatataaatatgacaagcttccagaagatgagagacttcttgaatggatactgttttttttttttaaggatgtttctatttacatatcttacccatttcctgtttagaaaaaaaaaatgcagctcgctgccagcacacatttctcagggcaaacaggaaatgggttaaaaggcctacgtatgtagtagacacctgctgggtggtctcctgattcaaccattctttctcttatattacgtggatcgggcctcaagccttggtcatctttcttcttgccacatggacaagaagcgcagggaaggcctttttacagacaaataagaataaaatatgtatgtgaagagggcagacataaatgatgcagaactgaatactgatgtcatgcaaattctctgttccagcctttttccaaggccaatatgcattcttgcctttggggactgggagacactccaatattcctctatgggtttcttctcttacttaaaagatgtttaaatgagtacattttattatatttaaaatgactccattttttgagatggagtttcactcttgttgcccaggctggagtgcaatggtgtggtctcagctcaccacaacctccacctcctgggttcaagcaattctcctgcctcagcctccggactagctgggattacaggcaccagtcaccatgcctggctaattttttgtatttttcgtagagacggggcttcaccatgttggccaggctggtctcgaactcctgacctcaggtgattcacccgcctcagtctcctaaaatgctgggattacaggcgtgagccaccgcacccagcctaaagatgaccccatttctttaactcagtaattctgccttcaggactatggaaacaggccagctgtggtgtcttactcccgtaatctcaacactttgggaggccaaggtggatggattccttgagctcatgagttcgagaccaacctgggcaacatgtcgaaacttcgtctctataaaaaatacaaaaattagccagatgtggtggtgcatgcctatggtcccagctactcaggaggctgaggtgggaggatagcttgagcccaggaggcagaggttgcaatgagccgaaattgcaccactgcactccagcctaggcaacagagccagaactcatctcaaaaataaaattaaaaaatatggaaacgctgcaggtataaatattaatccaatgattatatactgagtccctagtatgtgccaggcactgtttaaggccatgtggatacagtgcttctgaagacagatagccactgaagaattattgctttccttttttttgagacagggtctcactctgtcaatcaggctggagtacagtgccacaatcacagctcactgcagcctcaacctcccaggctcaatcaatcctcccacctcagcctccgagtagctgggactagctgggcacactccaccgtgcccagctagtttttgtattttttttgtagagacagggttttaccatgttgccctggcttgtctcaaactcctgggcctaagtgatcctcctacctcagcttcccaagtagctgggactacaggcctgtgccaccatttttgtatttttggtaagctaatttttgtatattttttgtttttttgttttgccatgttgcccaggcttgtctcaaactcctgggctcaaggcatcctccagcctcagcctcccataacgctgggattactagtacgagccactgtgcccaacctgaagaattatttctagcaatagaaacctcttagacagatggatgtccaataactgaggattgattgtggactatttaagtgacattagttacattaatgttacttaagcattaacatgctatttgtaataacaaggaaaaagtatgttattttgttaagtgaaagaaacgattaacttatagtttaatcataactatataaaacattttaaacctatatatagaacaaaaggtcggaatgatcaaagtgttcgcatctattatctttgactgatgagacactatggtagtatcttctgctgtagaaaatatccaaattttctattataagcaaacctactttggagaataaaataaaacaaagtcaaatattaagaagagctttgggaaaacagaacccaaagtgcaaggcatcagagaggtctccatcatctgattatgaaatcttggactctgaccccgcagcaatctaccagaaactctaggcaacaaggatgggacttcccaccccatgcacagaggtggccccggtaagaaggcagagtttgacagtcattgtgggtgctcccacccacagctcctgtcaggaagtggctgtgaaaccgggttcctcagagccatcgtggttctctggaggtaatctgggttggggagtggctggaggaagtaaataggggtccagcttcctttgccttctcagcctggtcctctccatcacaggtagctttccacaaactctaagttgaaaatacaagcagcttcttccgagaattgttcttgctctctagagaattctcttcattaacgctgttagtatcccttgactggaaggcaccatagcatttatgtgtaattcctgaatcacctccatgattttcagatattttaggaaccgggatgttttcctcaaatgaaatctcctgtgtatactcaggataaaagtgaaagaggggagaaaaggaaaaaggaggccttgtgctgctgtgaaacccaacagctctgaggaaccgggttcaaagccacttcctcaaacaggagctgtgggtgggagcctccacattgactgtcagcctctctgcattcttactggggctacctctattcaaggggcaggaatgcccagaccttctgcctagagtttttggtggattgtctgggagtcagagcccacagagtctgctgccagacctgaccacatcccaaactctgactcaggagtaagcgctttctttctctccccctggaatcctgtttcactgtttaagtgttattgcacctccccttctgcactcctgttccctggttccagggagcagaaagtaattacaggacacctatgctgtccattccgtcttcaagtagtccagaggcacccttggatttgcacagttatacttaaaaacccagaagacacttcgcccttgccctaggatcaccccctcaactccctagtccctggcaatcattagtctactttctgtttctacaaatttgctcattctgaacatttcatataaatggaatgatacaatatgtggccttttgttactcacttccttcatttaccctgagttttcaaggttcccccatgtggtatcacatgtattaatacttcattactttttatgggtgaacaatagtatggatatactatggatataccacattttgtttgtctatttttcagctgatgaacaattaggctgtttccatcttttggttattaggaaatgcaggcatacctcattttgttgtgctttgatttaatgagctttgcagacactgagtttcttaaatggaaggtttatggcaaccctgtatctagcaagtcgacaggcaccatttttctaatggcctgtactcaccttgttagcgtttcttagcaaaattttaaaattaaggtatgtacattgttcttcttacatgtaatgctactgcacacttaatagactacactatagtgtaatcataacttttatatagactgagaaacgaaaagaattgtgtgattcacattattgcaaaacacaacatttgttttatcatgatgttctggaatggaacctgcaatatctcaggtatgcctgtaatgctgtgaatatgcatgtatgcattttgtgtggacatatgttttcaattctcttgggtatatacccttaggaatgaaattgctggttcatatgacaactcttatgtttaacatagacctgcaaactgctcaggaactgcaaattattttccacagcaatgacactattttacattcccaccagcacgcatgagggtcccaatttctctacattcttgccagcacttactattgctcttctttttgattacagccatcttagtggacgtaaagtggtatctcattgtgattttgatttgcacttcctgacgattaacccatttatgagggaggttgcaattttttgaattgcagacgtgtgaaaaatcagaccttggtgatgaccttgagcagtaggatataaataactcccacaggtttagcattccagtagtggaacgctaggcataaatgggattcaacgatactggcatcttttcatgtgcttattatctatttgtatgttgcctttggagatatgtctactcaagtcctttgccactttttaattggcttgtcttttttttgttgattcataagagttatttacatattctggatattagacccttttcagatataggatttgcaaacattgtctcccacactgtgggttgtcttttcaatttatttattttgtgatggggggagattagggaatacgaagaatgcctgttctctttactgacggtatcatttaaagcacaaaagttttaaatattgatgaagctcattgtacctattttttttcttttgtcacttatgtttttggtgtcatatctaagcaaccattccttaatccaaggtcatgaagacttactcctgtgttttcttctgaaagtcttacagttttagctcttatgtttaggtctatgatccattttgagttaatttttgtgtatagtatgaggaaggggtccaacttcattcctttacaggtagatatacacttgtcccagcatcatctattgaattctttagttaagaagcactgaatcctagtccaacatcttcattttacagataagaaaattttggcccagaaagatcatgttaaaattactttgtgttgagaataaaagaaaatacatctgaaagaagatataccaagtcaataataataacaacaaaaaaagaacatacagagaaagagaaaactttttgtttctgttcttcagaatttctaagtccagtgagagaggtaaacagtacaacatgggatgttcaggactaatcacagaaatatacaaagtgggggtgaaatcatagagaaaagcctgcttaactgcctggtgatttaagctaagattcaccagggaggatcattctaggcaaaacaaacaaaaaaaaacccctcgtatacaaaagcctctcagctggaatgttatgggaagtgtacatgtggcaagatcttaagttgaggcaaaaggaaagcggagtgatgggagccaaagctgaagcagacttggagccaaacaccaggctgcatttgcccttgggaggtaggcaataggtttttttcttttcttttttttttttttttttgagacagagtctcgctctgtcacccaggctggagtgcagtggtgcgatcttggctcactgcaagctttgcctcccgggttcacgccattctcctgcctcagcctcccgtgtagctgggactacaggtgcctgccaccacgcctggctaatttttttgtatttttagtagagacggggtttcaccgtgttagccaggatggtcgcgatctcctgacttcgtgatccgcccgcctcggcctcccaaagtactgggattacaggcgtgagccaccgtgcccagctggggatcggtttttataacaaggcaatgacaccaccagatctgtgctttagaaatctgattgcttgtctgggcacggtggctcatgcctataatccgagcactttgggaggccaaggtgggcggattccctgaggtcaggagttcgagaccagcctggccaacatggtgaaacccccatctgtactaaaaacacaaaaattagctgggtgtggtggcaggcacctgtaatcccagccacttgggaggctgaggcaggagaatcgcttgaacccaggaggcggatgttgcagtgagcccagaccgtgccgctgcactccagcctgggcgacaaagcgagcctttgtctcaaaaaataaataaataaataaatctgattgcttgcaatatggacgatggtttgcaggaggtagaggctggaggaagggtttaggtgattcttgcaaaaggtcatgacaagagcctaaaaacagagtcctcagctcacaacgagttctcagatgcggctggcagatatgtgttgtttggctagaacagtgtttttaaagcatcttgaattcctgattggggaggaggcagaggcaagctctctctggggtgtcacaaccacaacactccctctttaggctcgcccaggcagaggcacccatttatgttaccagcctggccctggtaagcatttcagttgcaacctacgcctaaactaaggcagtgatgatgtagacagagaagagcacatgtactctcagcacaatttagaaagtgggctggcagtgctgctctttggtggtagagaacacagggtgatgttcgtctctggacttcaatgtgcctaactcacaccccatcccccagaatgatgacaaagcttttgctgaacttgctactctgaacagtttgccctcctggttcatggcctctcatggaagtaacaaaaagtacatagtcttttaaaatgtcttgggagctgtgttttctttcctgctgaagctttgtaaagtagaccttccaattctctaggaagcaaaggttcttttaaaccataggcttcaacttcccaaagttgtttaaggattctggtgctagccaatgatacagtattacttttgtcttcaactggtatctttcaaaggatttatatttctcaaaattaaaaagttgtacccggccgggcgcggtggctcacacctgtaatctcagcacttcgggaggccgaggcgggtggatcacaaggtgaggagtttgagaccagtctggccaacatagtgaaaccccgtctctactaaaaatacaaaaaaaaaaaaaaaaaaaaaaaaaaagctgggtgtggtggtgtgtgcctgtaatcccagctacttgggaggctgaggaaggagaattgggtgaacccgggagtcagtaccctagttccaagacaatattttattttcttttgaacttcattcactcaagtctttattcagagtgtaagttcctagagggtggggactgtgcatctcatttagcttagtaactcaagagcttaacaaagttcctaacccatggcaggggcttattgagaattgtacaggtttcctaccgtcaacactgttatctattagctcttttcagcttcagttacctgcaagcatctgggccgggttcaactgcaaaaggatctcacccatataagaggaaaaagggcagtagaggaaggaacctggaagttgacctctgcacatttctggatcttttttgtggtgctggcatgttgtgggcctggcaggaacaggcttccagttcctgtctgtcttatcactatctccacctttcttatcagttagctacgtggggggctttctgtcctacagatcctttatacttggcacgcttttttcttggccttactcagtactgagggtgaacatttgtatgctactatttattttaagtgttttgctttataaagacctatattctgttggtaaaactgttttctaaaattaaaacatatttattgataataaaaggcaaaattgcagctaaattttcttcttctgtgggagtgacacactaagagtacccttccaattctgtgatttgaaggttcaagaaaccacgaacgttcctgtgagccaaaagctttataatttgcttgagttgaaaatctacaagtgaattttaacaggataagcaatccgtaacaggaccaggaaactattcaaggacaagaatagactgtttttcttggttttagctacacaaatcaacaccaatccttctgataagacgagaattactctttcaacagttaccgacagtagcaaatgccacgaagatattaacaaacagcaccaatttaaagcctaagagcatggggaatgcagctggtgattcttacaaatgttaatgtaaactctgcagtttattccactccacattgctaaaaattttaccctgccaggcccactgcaacctcaaaataatactcttcccaacataaagggctgcttcttttaacttctccagagtgatttttacaaggaaggaaagttgccatatctctaagaccctaggggagtttagaatatgatcaagttccgaagaagtgcatttttgatttgtaaaaattattttaacaaatattggtcaaatgagtgaactgcattcatgtgcataaatatgtagaacatctgcaaacctctcacatgcatccagaggaatactactctcctgaggaggcttggagcaaggaggcctagcaaagatggacatgcaccgagcaatgtgcgggatctgggctggacaccatgataaatatcaaatgaaccagagggtccattaaaagctggctggagaaaaaagtcacataaagcgaggtgaatgtggaaaagtgaggggtgagttaagacaagctgaaaagctaaagaaatagaagtagagtgtttaagagaaacatgtacccagttttattgagatcaattcaaatcgccaggcactgtgctaggagacagggaacacaagctatttaagagaagctttctgcccttgattgtaatgagacagaaataaatctgcaattaacaatcataaaggcatactttcatcttgggcacttggaagaaaggaaacatagagctgacataaactttgatgtaaatgcagctttaagcactttttctttttctttcagtgatatggcaccttctccttttcaaaaatagcagcatattaattctctgttaaatcttttctttgaaatttgcgtttatgtctggcatgattttaccccatgtcacctggtcctgctccccgcattcttgttccttctggcaacacccacccaaatttcaacacatttttccgtcacaaatttagcattagcttaagtcattaactatatttacagcttgtcttcatccttactgaaacataaaggatggttgcaataaacagtgtgttttgtttatgaagaaaaatgtccattttaaatcagtctgcttgaatacatcatttctgtatttgaacatggctttggcagatgcagggaaggatgaaaactccacactcactggaaaacaaataggcagcattcttcattttattatgtgaactccccacacagtatgtcatgtggaatttgtgtgggattttatttactatatcacaaaagctgtccttactgtatatttatgcagaaaaaaaacaggctgcttttatgtaagtcaaatgtcacatcagaaaataataccccggaatgtctggaaagtattctggtgtttttgatccattaaaaaatataatttgtctttcacaacaacaaattaactgaaggggtaaggtatgtttaataaaaaataacgaggccgtctggctggagaccgagctgtcaggaacctggagaaggagatctgcaggctctttccaggggccgccctaacctgagacaaccaggaagacagcgggatggcccccagcacacaaggacccacaagagccaccgtcaccctgagcactcagaaagatactcagactgagcctgagcgcgtcttcactcagttccagtttcattcacgtgggtactcaaagatgcctatgcttccagttgtttctgtgttctctgtgttctcctgcagaatccattgaactggacttaagacatttatttcagacaaataagataaattatgtagtatataaaatgtaaaaggtggaaagagcaatttctgactgacacaggaacattcctggacacgagaaaattcaacccatcgatgttgagcgagactcagaccagacatgctgtttgtggctaatattagaagtcatttaactgtcaaagcaaatggcactttatgagcaagaaatcaactgaaaaaaatgaattatttatggttttgataaggtcataaccatcacaaaaggcaacaagggcaaaacagtaaaactgtctgttcaagtaaaagcagccctccctggaagaaggtaacttgcttcctgtctcactttcacattgggccttgctggctccaacgtggcccatgtgtgctatgtcaggggaagtatttctttcccttgccactatgtgggagcttttaatacagttctcaactctctatgagctccttgggtgtgtatattcccttaaaaattatctcagtgtgtaaaaaatttgttttaaaaacattttaaagaagaattggctgggcatggtggctcatgcctgtaatcccagcactctgggaggctttgggaggacatggcaagagggtagcttgaggtcaggagtttaagaccagcctgggcaacacagtgagaccctgtccctgcaaaacattttaaaaattaaggctggacgcagtggttcatgcctgtaattccagcattttgagaggccaaggtaggcagattgcttcagcccaggagttccagaccagcctggacaacatagcaagaccttatctctacaaaaagtacaaaaattagccgggtgtggtggtgcatgccagtagtcccagctacttgggaggctgaggtgggaggatggcttgagctcaggaggcagagaggttgcagtgagctgagatcacaccactgcactccagcttgggtgatagattaagattctgtctcaaaaaaaaaaaaaaaaaatcagctgggcgtggtagtatgcacctataatcccagctactcagaggctgaggtggaatgatcgtttgagcctataagttcaaagttatagtcatgttttgtgccattgcactcagcatgggtgacagagtgagaccctctctcaaaaggaaaaaatcagcggcaatagctcctaattccctctttgtaattttccgggcattaaaaataactggtcagttaggaggtggctaactctgctcaatggttgtgcaaaagcttaggataaaatacagaaacaggagctgaggaggcttctttcccttttcagtgttgtggcttcatataaaatctacatgtgagctctaatactggtccacgcatgcctgtgtggctctcagcgttctagaggccaaggctaagctcactataatataaatgaataaatgaatcaggactgttgagttctcctttcaatccccaagtcaagcacagtgtctaccacataatgtcaaataaatatttatggaaaggaagaaagggaaggaaaaaataaaccaagagaatgaaacagttagatcatgaatggcgctggtatccactgggttcccgtatttcttaagaaaatgaaccctctaaacaaaatagcccaagttttaagtttgttgaaacttcccttaaagatcagttctggggacataagagaaagattttgctactgctaacaaagtttgcaaaactttgaaaagaaaggttttggcacaggcaaaatctgaaaagagtaataatgagcagaaactggccctagcagacagataataaatcttcacattctgaagcttccatattaaaagtgtggaactggagaagaaataatcgacacagctcaatggatcacaacaacaaattaaaaatatataagggaatttcattttctataaaggtatacaataaaggtatattatattattataaaggcagcatttcaagaaaagagattgcttaataaatgtgtttcatgcaactaggtaaccatctgagaaaaataaagccagattccgatctcactccttataccaaaattaatttcagatgaatcaagttttccaaatgtaaaaatgaagccataagagaaagcgagggtgaacagcgaatgtgtgagtaatctcaaaggggcatggtctctttctatgcaggacacaacagtcaaacaaacaacaaacaggaaaaatatttcaacacagctacaaagggctggcttccttaatttagagagatactgtttatttcatccatcacactggcaaaactctagggagggcctgggaaaacatttactgagatactattgaagggagtgtgtgttagacgtgacatctctgggagatttggcagtgtttatcaaaatttagaaaacatgtatctcagcaatccctgagccacaaataatttatcctaaactcccactacccaaggttctgcactaaggtccagattccagaagaagtaatgcaatcccaagttcatccttcctactgtggtcaaggttaaaccccacaccccacgatgtgactgctgaggcgacttatcagtcccttgaagccaaatcagacaggcaccttacagacaccgcatcacccgctgccctgttccacctgccaagggtctgtgcctcctcactagactccagcatcttgaaggcagaacgatatcctttcccctgtctttctttctttctttctttttttttttttttttttttttttttttgagacagagtctcactctgttgcccaggctggagtgcagtggcgcgatctcggctcactgcaacctccacctccctggttcaagtgattctcctgcctcagcctcccgagtaggtgggattataagtgcccaccaccacgtctggctaatttttttgtatttttagtacagatggggtttcaccatgttggccagactcaccatgttggccagactggtctcgaactcctgacctcaggcaatccaccaccccgccccccaccgcccagcctcccaaagtgctgggattacaggcgtgagccactgtgcctgtccctttcctctttctaatatcacatttatatagcccagagcagaggctcaaaataacattagatggatgaacaaataaattactgaatgtgtaaatcagataaactagctagctagaagtactagtgggcaggttaaagacaggatggaatcataggtaaatggttaagaaaaaaaagagaaagggatccaagagtttagaatagttttctaataaatttaaggttagtcctgtgtgtaaaaactatctttatattaagtatgcaaaattatcttataatacacagaggaaccggagcagacaataatgaatgtcaggcatttagcaagctgggttagatttgatgaaaccgaaaactcttaagcttggaaactagcttgttaaataacaatgttcctgtaaacaggcaggctagatttattgtgcccctgggaaattctctggaatgaacacagaaaatgcttctgttgattagcctttttagcttgcgggtgagtgttgacctaaaagggaaaggcttgccctccagattttacataatgtgcccttatcaattcctgtcaggagaactgtccctgcagggatgttaggaagactaacgattctgcctcagtaacacaacctgtgctcccaggagcctgctgcgaaacagcagcttatctcttacacctgcttatggactagaaagaccaattttaaacagagggccaatgcaaagagaagagaagataaaggacattaataaagctaacaagttgattgatatattcaaagagaggaaaccgaggccgagcatgtgtgatcactggcccaaggtcacgagggaactggcggccagccccaggacacagagggcttccctcctccagccacctcctcaacgctagctggagagcagggaggaggcatttcccagaggcaagctctgaatactccgctgtgttctcactggacaaaggaaaggaaagatactcctctaaagacggcactgaacactcacttagagacggtaacagaagcctctgtcagcaactcaaggctcatttaaccaacttttgggatattacccacacagtcctaaaaacgtatgcaaagcaggaagtgagataaaagagacctcaaaaattctgagagtaactataaaattagacatattaataaacgtgcaaacgttataaaatgggaaaatatatacagttggtttttccggctgtggtagctaatcaaaaatgacatctccttccagctcccctcactcccaccatgccctcgtgggcaaaacctgctatgatttgcccgtgtagccccctctctgtgaacgtaggagaagcgaagccattggctttctgagacttgctcatcagaagccttgctgctgccacctgcgcctctgggaaagcttgccgtgggagaggcgcaaccgcctggagaggccttcctatgaggaagtgcgttagtcacgtaggagacggccccagctggcccggccacccagctgaggcgccaagctgcacgtgaaaaagccgtcttgggcatacagccccactgggcattcccgtgagtccagccctaacgtcatcggactgcagccccaagagagacccgagggagaactgcccactcacagaaccaagagggagaatgatcaacaatccacaaagtttcttgcaaagcaacagataactgaaccattggctagccaagctgtacaaaagcattaaaatagatttattgccataagacatgagaagtataaacaaaaaaaagttactaaacaattacagagcgcctatgcctcttctttgaatggaaggccttagaaatacttccatattttctgaggtattttgaaggagtacaggtctgaacacacagcacacagctgtcagaaggaaggccaggcatttacacagggtgggctgtggaagaagaaacctcgtaggcagcgggggacacaatggtgactgcaggaaggcctatgaggctgtcagctggaagactccttgataccatttcattaccagtccaaaacacagtcagctctgcttgttttttctcttacaaactctagtatgctgtagggttagagaggtacttatattgtaagcatacatgtgcaaataactgtgctagattatgtggcaacctgattttccctagatttgtcatcttatatttcaatcagacatgatgatgaagagccttgaactcaaattcaaatttaaaacaaagatgaaagcacagactagaacagaaaatcaaaaacacaattcaaggatagtataacaaaaacatatttcagatactgaagaaagctggtcctttgcaatagaccatgttccacggaggtctgccctctgacaagccgagggccttaaggcacataacctctttgagacttgagatcttcagaattgttttgaaactatttcttcattgggaagaaaaaatggttctgtgatcctcaatggtggtgaagttctaggtaagagctttaagcgaaacgatggaaaaaagcaagaactaggagctggtacgttagaagcatctactgcattcaaaccctgcattaggccccttcatacaaacctcctttagtcctcgtcatggccctgcaccaagggcttggtgtcccctctttggagaagccaccacacagaaaggtccagtcaccagcaagaggtcgtgcggcacgtccactctgagtgagtctcacaggggatctcaaatgccctctttcactctgcaaggtattacctgcactgtgggctcagcattccagagatacgcatgggaatagggccaggtccctgcctccaagagctgacagaaggctggaacaaacacacatgtgcacgcaccattcatttccacagaaagtcatttttggattcaaagctgcgtttgaaatgggtcttgcaggatgaatgggatttcacagatgaaaactggtagaagaaaactgcataggctcatggattcattcagcaagcacacacacaaaggcctgctgtgggtgaagggcaaattctgtccctgaagggcagagtgagtgctgggagcttcaagcatttcttttgaggtccgtttagcaaaagaatttcttattaaatagacaactcactttatattttgtcacatacactaaacacttgtgggaaattctctctgccattcagattttaaaaaattgattctggatattagctgttcccaaattcaaaggcgacatccctcacagcaaaaacctaacacaggtcctggaaaccgacaaggccctgctgcaggagctcacactcctgcggtccctactcccagggatcaagcctggctgctacaactctgtgtgcaagagcaaactgtttcttgtgatgagtcagtttcttttttgaatcaaaacagaaatgttaagaaaatatggagagctattcttttatgatcaagacaatttttgctatgctttatattcttttacagtttcctattttaatattctcatctggtagatttcaagcactgacctctccctttctttcaacaagggtataagaagacagactccacttgctcagactaggcatggggctttatggcctttgggatttcttaggggagacttgagacttgagagctggagaactgtcaagctaatgatgtaccccttttccttgccatttcaacacgaacaggtatttctctccaaatctagaaatccttctgtaaatggaacggcagatcattattttgcattttgctgagaacaagaagtacgtgagatattgcacaaagtacagcatgaggcatagcttttacccaacaggctcaaaactctaaattaaaagaaaacaaagggacagaaagaaaagcagttttcttctcttccacctcctcctcctctcgcctgaaatgtaccacccacggggagttgcacagcttagggcttaggcagagatgatattccatgtactttttcaggtttcccatttaaggctgtcaccaccattaagccaaatgacagtaacggaggtgcggtcacattaataacatgagggctgttctagggcaagatagggcctgcgtcatggcttcctctatccctgagaaggagggtgacagaagagaacgcctgcagggtgacagtaaaggagtgtatcagggatggggttgcagagcactgtgcagtccccactgtgggctgtcggagtcaatcaggcactcggctcattggaacttctgtcccctcagcagtaagggcggagggcaaaccttgcaaacgacacatcttagttggaggacatgattggggctggcatcatcaaccatatgagatgagcctacaacagacagcagtcagagacaataccccgggttaaaaaaggaatctaccccattatgaaatagaagaaacctcagcaagttgttgtctatgttctctgagctgataaaatggtattaccatgaactaagggtagctagtccctcaaaatccatgctaatgaaattctctaagtccagaaaaatgagcaaaaccatcattttaaaaaaatttagaaatttttatttttatttgcttataaacttcattgtgagcttttggaacaaaaaagtctgatttcctatttaatgaagaatggcttttaaacaccacaacttaatgcatagctgtatcaatattacgtaaattgacaaatgtcacacaaaatgtggtgcctaattgattttgacatgcacgtacataaagtaggaccattcaggtaaatacagagctaataattacaagaagcaaataataccaatgaaaaccattttttaagggtattagattttcattctcttcctcatcaaaaagaagcatgtattgaacatctgcctgtggctagggttgtagtaagcagaaaagtgacttgcctaaaggatgagaaatcctattacataaagattttttattttaaatgtaggcccactctccacacacccacacccatcagttacctagcagttccttataaggagtgtgaaatccaagtctggcaactcactggggacttcaagcaaaaccttctactctgtcctgttaggtgtgcagccctatgataaggcactgtggccatccgcagaataggcagaagataagcctctaatctgtacttttcaaccaatacctgggaggctttttaagagtgatactgaccttgttttcattggttttatttcattttacttaagtacttgttgccattgaaaattacagccggccttattgtcttcaattcatttgcatccccttttccaactactattcctaaagcaaatcatgcatttgcttttgtgcaagtgtctgaggactaatttctccctaaagatgcggtgttcaaatccataaattctcccccaaatacatgttgtgggttttggttcttcatatttttttatttttatttttttctgagatggtgtcctgctctgtcacccaggttggagtgcagtagcatgatctcgactcactgcaacctccacctcccgggttcaagcaattctcctgcctcagcctcccaggtagctgggattacaggcgtgcgccaccatgcccagctaatttttgtattttattagagacagggtttcaccatgttggccaggctggtctcgaacccctgaccttgtgatctgcccgcctcggcctcccaaagtgctgggattacagacgtgagccactgtgcctggccagttctcctcaatattaggaggaacattgtcaccaggctccctgtgaggtggcatttccaatgaccaaatatagttgttacttaagtcaaaactctatacctgccttgtccaatatggtaactgctagccacacgtgactaattaaaattagataaaattttaaaatctgctcttcagacacacaaaagccacatttcaaataacccatagtctcatgtggctagtagcaatgatactgaacagtgcagaaagttctgttgagaagcattgctctacattaagcttgtctaacctgccccacatgtggcccaggatggctttgaatgcagcccaacacaaattcgtaaacttgcttaaaacattatgagattttggccgggtgtggtggctcatgcctgtaatcccagcactttgggaggctgaggcgtgtggatcacctgaggttaggagttcgaaaccagcttgaccaacatggtgaaactccgtctctactaaaaatacaaaaaattagccaggcgtggtggtgcatgtctgtaatcccagctactcaggaggctgagacaggagaattgcttgaacccaggagttggaggttgcagtgagccaagctcgtgccactgcactccagcctgggcaacagagtgagactctgtctcaaaaaaaaaaaaaatatgagattttttttgtgactttttagctcatcagctatcattagtgttagtgtattttatgtgtggctgaagacaattcttccaatgtggcctagggaagtcaaaagattggacatccctgctctacatgatgcaagacgggtctgcttgtgatcttggttcatatagaatagtttctactagtatacattcaactgagaatattcaaatgagtaaaaaccacgtggactgctgcagccctccattcctctgcagaatccgggtgcaatgtaacatcaggcagtgctgtgagctgaagcctaaggacctagcacactcttgaccatatcctgaaactgttcccaaccttttcctgtgacacatttatacctcctaagtgcatacaacacacatttatgagaacacagtgaagcaaaaatgctcaagaaatggaagtgacttcagttaatttcaactcagggttgactcagtttctcctcacttttgtcaaaattttctgtgtaacatgccagtctgcattgcttctctgatagggcaggattctacagctaatgttaactaaatgaggatgttacattaattaaaactcattgttcttataatttcatgtaaaccaattaacaaatgcaaaagattttagaaaactggttttaacatttgactccaagatataaatagaagtatttcttttatttttattgtttgagacatgctctgccttccaggcttggagtgcagtggcgtgatcacggcttactgcagcctcgacctcccgagcttgagagatcctcctgcttcggggtcctgagtagctgcgactgcagatgtgcaccaccacacctgagtaatttttgtatttttcatagacacagggtctcactttgttgcccaggctggtctcagactcctgggctcaagcaatcttccccaccgccttggcctcccaaagtgctgggattataagcatgagccaccacacctggcctagattatttcttttcttctcttctcttttctttctttctttttctctttctttctttctttccttccttcctttctccttccttccttccctcctcctcctccttcttctttcttcttctctttctttctttgtctctctctctttcttttttttttgagagagtctcactctgttgcccaggctggagtgcagtggcacaatcttggctcactgcaacctccgcctcccagggtcaagccattctcttgcctcagtctcccgagtagctgggattactgggattacaggcgcgtgccatcacgcctggctaattttttgtatttttagtagagatggggtttcaccatgttggccaggctggtcttgaactcctgaactcgtgatccgcttgccttggcctcctaaagtgctgggattacaggtgtgagccaccccgcccggccgattatttcattgtttaaaacaaatactttgactttttaaaaactgaaatttgcctgtttttcccaaaagtatagtttttgtttgtttgtttgtttgttttttgagacggagtcttgctcttgcccaggctggagtgcagtggtgcgatctcagctcactgcaagctccgcctcccaggatcacgccagtctcctgcctcagcctcccaagtagctgggactacaggcgcccgctaccatgcttggctattttttttgtatttttagtagagacggggtttcaccctgttagccaggatggtctcgatctcctgactccgtgatccgcccgcctcggcctcccaaagggctgggattacaggcatgagccaccgcgcctggccaagaatagttttcaagaagcgggttaactgtgactaatcaagtacaacctaaactgacttgatctccttgagtagcctctggactttccccagagctgttatgaattcttgggaagcagctgatatattctcaaataaatacctcatttttatgtcagatcattctgatataatcttattttagaaacacagcccatagttcagtatatgacaacaatctgttcttagaatagaaatctgcaaaattaaaaaaaaaaggagcctccggaagcccagaagcatctttgaaaggtgtctctacaattttagtttcatagctctgtataacatccaaccatgcatgtaaacagctgaaaggaaaagcaacttcccttttatatgtatctgttagccattcttcctggactgtcagggaagccgatgtgggaggaggggctggcctgggatgagtatgggagaaaaagtgacttgcatattaattaacgcccatgctggccgggcgcggtggctcatgcctgtaatcccagcacttagggaggctgaggcgggtggatcacgaggtcaagagatcgagactgtgctggccaacatggtgaaaccccgtctctactaaaaatacaaagattagccgggcgttgtggcacgcgcctgtagtccccagctactcgggaggctgaggcaggagaatcgcttgaacctgggaggcagagcttgcagtgagccaagattgtgccaccgcactccagcctgggagacagagtgagactccgtctcaaaaaaataataataaaaaaataaaaaaaattaactcccatgcctcctctggcttcctttcctccatcccctgacattcatgtgcaagtggctaaaataggctaaagagaggatcaagtacagtttccgtggggaagaacatctaggtaggaaaggtaacgccatgcggtcttgaggctgggaacagacggacggcaaggctcaggctcctgtgcttgctcccctgagctggttttcaccaccagtggacagacgcctccctatccctccagctgcctccggcgcttgctgcccagaagcctccctggagccaagacctgagagcccaattctccagtggcctttttaattttaaattttgaatatttcttaggtttatatttctaaggctgcattaatgattattagtcgggtgaacttttacagtggttttaaagctaagtctgggtattctaggaaccatctaccctagcgacagcaatcctgtggtcaccaccatcagtcacactcctctggccacctggtaccatagtgatggaattgtgacatcaggtgtgtgcactttcgcatatagcttagactctcttttttttcttttttctttttgagacagggtctcactctgtcacccaagctggagggcagtggtgtgatctcacctcactgtaacctccacctcccaggctcaggtgatcctctcaccttagcttcccaagtagctgggatacaggtgtgtgccaccaagcccagctaattttttgtatttttggtggagatgaggtttcaccacgtcagccagactggggaccaatttataacattagataaatgtattggaagggcaatggagaatatttcaactgtgttagctattctaaaatatgttgagtatcacctcaaaaaaattatcattagaatacaattaattttaaaattatgagagcttttactatataatatttactgctttcctctccactacatcttcaataatttctctcttggtgcaatttttttcaacaatttattcaatcatttctctgtgtatgtacattcgagggttttcatttttggtgtctaaaactgaagctgtaataacaataaacatccttgtccttgttctggtgtgtcctttgtttagtttattaaaatttaaacagattaactgaggtaaaattgatatacaaagaactgcacgtatttagtgtgtgtaatttgatgaatttggacatacgcaaacatctatgatactatccccacaatcaaggatagatatatctagcacctcacaaagtttcctcatgtcctttttgttttgctttgttttttgtggtaaaatctaccctcttaacggattttcaagtacacaataccatagtgttaactacagacactacattgttcagcagttctctagaacttactcatcttgcatatctgaaactttcatacccactgaacagcaattccccatgttccctaccctgcagcccctggcaaccactattgtattctctgttctacgagattgactatatttatagatatctcaaataaatggagttatgcaatatttgtcctgtgactggcttatttcacttagaataatgtcctccaggttcatctgtgttgtcacaaatggcaggatttccttctctttttaagccgaacaatattccattgtacgtatatatcacattttctttatccattcctctgttgatggacaggtgggttgtttctatatcttggctattatgaataatgccgcaacaaacatgggagtgcaaatatctcttcaagatcctgttttcgcttcttttggatatatacctataaatgagattgctagatcgtgtaattctatttttcattttttgaacagctccagctgttttccataactgtggcattttacactcccaccaacagtgcacaatgcaagggctcccttttctcctccacatgatctccaacacttgtcttttgtggtttttttcataacagctatcctaacagatgtgagctgatatttcattgtagtttagatttgcatttccctgatgattagtaatattaaacaccttttcacatacctcttggccatttttgtatgtctcctttggagaaatgtctgttcaagtcctttgcccgtttttaaattgggttatttgtatttttcctattgagttgtaggaattcgttatatattttggaaattaaccgcttatcagatacacggttcacaaatatattctccccactctgtaggctgccttttcacactgctcattgtttcctttgttgatgtgtcccttttggagacaggcagtccattgtggtagtaaggaggtgaagtttagagccctattacctgagtttaaattctgccagtgtcactgttttaccttgatagatactttattctttcgcctggtttcctcatttgctaatctaggataatattaactgaatgtgacaggttcacagccactaaaattttatccaattaatgttcatcatctgttacttatcagcagattccaatttgaaccacacattggatatatatttttcacctctattctggaagctttgtggatacttaccagtaattccatatactcaccgacaaggagctttaaaaagtgcttctggacaataaaactacgacaatgtttttgagagtggtctattccctaacactacctatatacaccagtcctaaaatattttctgtgctacagaaagtaaagtgttcaaggatgtttatttgcaaagagtctgacagatatagctaagcttataaagatatatatatagatatatatagatatatatatttttagttattgagttcatcattgttagggtggtttcaaaatttgaagtttttcttatttctgtggtattttataacattaaacctagggatggcatcaaacacaatttcaaatgaatgtgttgctgtgctggatactgagaagtcagactacaaacctctgtcctcacatcaaccccagccaaccttaaattccccaagtgcaccaactaaaaagaccaagtgagcccttcatcagcacacttaccccactagcaaggacctgacagagttttcaccatatgttttgtgtttgtgcgtttgtgttttggttttggtgaaggggagaggacatgtcagtaggctcaaagctataactacagagccgactttaaatatgaaatggctttcataccttcatctcattgccagtatcaacaaccaaggacttcctggcaacacttggagattttagagacatcagtaacctttctaaaaatgattttgtgactttcattctaaatggctaggcaaacaaatcattcaatagactgcagaaaatgggccacaaaatgaccaggaggcacatgatatcatacacaataagagagtatggggacaaaattcagtttgttatgagatttaagtgcaaaattcctaactgacttaggtgcctggattaaatgtgttgggcaaatgaagagcaactgcatctccatgtgtcggaccgaaaggtccttgtataatgaccctccccaaacgaagagccactggtccaattcagtttgaggttccctacaggttatcaataaaggttttttaaaaacctgctggatcaatctggtggagggtgatttacagagtaactagaaaaagatttggcccaagatttggccacctggctgcttcccactttggccacagcgatggcttccctgctctggaatgccttccagacatttcccttcgtcttcttgctgccccttttgattctgccactcttaggacttctacatgaaaggaatacaaaaactcctacaatacttaaattcttttaaaaaggttgtttgaaagagctaacctaattaacagggaaaaaaatgcctttacttgcacttcaggacaattgtttctgctacagaagaacctttaataatcttcccaggctaaactgtggagacctttgattttatacaacccaaagcccactggaaatctgtctgcttcctccaactattgtcaaagaaggttaatttggaatttaacaaagtaaaagatttcttccaaactctcagcttgccttgggacttaagtgacgctgggtccgtttcctgcagccctgggacacttgcaagtgaggctctcagggagccttgttgactgcgttgggtgaaatgcacagggaatgcagggaatgtggcatggtgttctgtgttccttctcactctgcattgtttatgcttgctcaaataacttatatttgctcctcagttggaggttaaatttcttctgtatcatgactgaggcataaaattataaaataagtaagtataatctcctacattcctcacagcaaccatttccctacctccttccacacacaaacaacttttcagcagtgaagtggtacgtgtccttttttttttccttttaatctcaggatgatttagtctattaaggccatttaatggaatgaccagatgacaaagaagaaaaaggattgttttgagtaagagtttcctttttcatttctggctttaattgtgaggttatggctttcagaaaagaaaagaaaagaaaatgcctgtagtgataaaagagctgtatttcaacaaatgattatatttttataaatcttgtagaatttgtggatgtattttattaataaaatatttacacctcaagtttataaaggaatagacaaaatttacacagggtttgacagtcttatgtatttggtggtgaaattatcacaatttatatccactcgtacaatgctattaataaacaaaatgcttgtgacaagtatgggaattcttagaaggtaaaaattcccaggaaaacgattttaggctgaaagctaaactagggtatccctactaaaacaaggataccctaatgattattctctcctttaacaaaatttgaaagcacaccttttcctcctatattatgcagcatgtggtcataatttgtacttgttgctgtgttgaactcacaatagaaaaaataaatgaaacatcttttgagtaaactaaacagatgtctcatgttatccttttaaaatacagctggagaaaccttagagatcatcttgttcaacggttctcaacagatgctccctggaccatctgtatcaggaccatcttgggggtatattgaatgtgcaggctgtcagccccacaccaggcccagtgaatcttagagggtagagcccagacatctacagtgttaccaagcaccttatttcattcttccatacactaaattttgagaatctctgttgtcctatcttttccattttcaacaaagaaactcttacccaggttgtccaagatagagtagcagaggtaggcagaacttcatccaatagtaaaaataccacactgctcttctgtaatataacatttactaaaaactaaactatagaaaagcagaattaatatttctattaaagttctgcaacgtacagcaatattttaggcctttcttatccattcttttattccacaaaccttcattgaatgcctgcactacctaaggcatcgatgctgtagcagtttaagtttacaactgagcggagatgagacattacacaaagaggtacagttcaaggaaggctgccacaaacaccacaggagcaggttaactaaagggatcaaaaagttctaagcagctagccctcacctctggttcagatgacccagatgacttcacagaggaggggctgttctggccatggctgagctagcaacagatatggatggacaagggataaactcaccttactattctcgttccctagcaagtgtaaacattaaaggcttctgtcatcctggggctgcagccttcaaaggaagttctttatacaaactaaaaattagaggtgaaagaaaacaggatcctcattttaggtatggaatctctaaccctgcttttccctgactcccagcctcaaatactcctccttttcgggttctgttgtagatctcgatcctgtcctcctcccgcaacttatgatagggaatcctaacactcaccattgataatacattatccttttaggaggatatcctttgaggggactggcaatctccctggggtcagaaaatgagtacgtgtcagctaccagggtcatgcagccaccctgagcccaagccagtgttcctaccactgcagagttccctggcaagggaacacatggagatagtatctgggagaggaaagggaatccagagcagacttctgaaggctgtggggagggactgcaggctgcgaggctttgctcctcgctccttttcctcttcctactcctttagcagtaagagctccccaaccatgcttgggctatggccatgccatgtggcagtacagttagcagacaactgccctgctaagctttaaaaaacaaagacactaaaacctgataaacaaccagcttttctttgcttccttggatcagtaaattttaaaaagaagcaggggaaagaaaacagagaactgacctagaattgccaaccttttatttgggcatctaagaacatctgaaaaataagcaaaatagaaaagcctctatttcagtaaagagcaatcctttaagtagagtaaattcagactataaaaacaaacatatgatgttttatctgttttgtaaaaatcatttttccttggactagtaaaaactgcatcatgtcgccccatctgtagtacttagaaacagctgcaggctgtttaagtttctgtaagtttctataagcatagctcagagactcaaaagagaagggggaagaaggcttgggacaggaaaggaaagagcaaaagcattagggtttttcaagacgtaccaacaagcataaagttccactcgacaatttcagattttaaaacccctcatcatctataatccaggctatgcctgttctttgagccaacagaaccaaactggatgagatgccaatttaaaaatactgtgtgctctaaataaacttaaacatcagcagtgtagaaaaaccacattatatcaaaacatattgtttaaggtactaagaaatgtctctgcaaaacttaatatgagctttaaaagcatatcatgccaccatcaccatcagtcattaaatttttattttttcatttaagcttttattatttaaaaaattttcagattcaggccaatgttaaaagatatgaggcagaaaacaaaacctaaatattaaaaaggaagataataaaatatgtatttttggatggtgtgtttataggaatcaaatggtaaacaattacatttaatttacagctgagggtccctgtagtcacagttacttgggaggctgaggcaggaggattctttcagcccaggattttgaggctgcagtgagctatgactgtgcctgtgactggctgctgcactccagcctgagccatagagagaggccatgtcttaaaaaaaaaagtaggtcaatactagatatacaaaaccaaattaccagatactaccagtttgaaagtatagtaaaaaaagatcaaaacacaaactataaaataagtaataacataacaataaccataatgagaaatatgtaggacctatttagagaaaattggaaaattttgtgagaaatataaaaagtaagatttggataaatgcttagtacatgtcatgggctcggtggtaaagactaaaacctgttagataaacagtttttccccaaataatctgtaagttcaacataaattttccaaagttcatctgaaaaaacaaacaggaaagaacaacaaagaaaattttgcagaagagtcctgcagggggactggccctatcagatgccacaacatgtaagccgtgtggcacagacagaaggacaggcaagcagaacaatggaacagagaagataacccagaagaaacacccatccatattcagaagatgccacaaatccatcaaataaaattgagaaaagatggcacccactaggtaacaattcagaccaaaaacaagagcccctcacctgattctatatggtgaaatatattccacatgaatttagagtttagcaacaaaaattttgttaaggtagaaaaatatattgtatatatataatataaatatatacatatataatataaatatatacatatatatgtatatatattttttgagacggagttttgcttttgttgcccaagctggagtgcaatgcgcaatctcggctcactgcaacctcctctcccaggttcaagtgattctcctgcctcagcctcccgaatagctgggattacaggcacgtgccaccaagcttgactaattttttgtattttaaatagaaatgaggtttcaccacgttagccaggctggtcttgaactcctgacctcagatgatccgcccacctcggcctcccaaagtgctgggattacaggcatgagccaccgcacctggcctatatcagatattttaaatcacttctaggaaaaaaaatgactttctaagctaaaaaataatagaagaatctaaaaagaacagagtaacatattttatcatctacaaatcttaaacttctatttttattttttaaatacacttaaatgcaaacaccaaattggaaaaagtatttgtagcaaaggtcatcatcaaaagactaatcgctttccaataaacagtgctataacatttgtataagatttttggtagcccagtaagctaagacaagctttggggaaggcaatttggcaatacatgtaactggagccttaaatatatttgtatctgtgacccagtaattccacttctgggaatctagcctaaggaaacaatccacatataataaatattctctgtgtacaaagatgctcttcacagggaaaaaaactgaaacgatctaaaagtatattaaagaacagttaagtaaatgatttaaaaattttaaatggtacttagagtgtataatagtatttcaaagtgtttataataaaatgttaaagaaaaaatcaagatactaaattgcatattcaataaaaatacaattttattttttaaatatagatttatatatgaaagtattaaaatatttatttaaacactattatatccattttatatgtgtatgtacatatatatgtgcatatgtcatatgtttacacatatgtagaaatatattaggtataacagaaatatatgcaataggaatatacacacacacatatatacacgcacacacaaatcacctgcttaatgcctttaatctattcaaaaaagaaggcattgaggctaagacatcaatgtattattaccatttgtttcaaagtgtaatataattaattctcagatcatcctaaagttccaattttttccaaccaaaataaagtcataaaagaaacacttggttaatgaattaaacgtatattaaagagtccttctcatatttaaagctatgaggcatttaaatacaaataaaatcatttagtttcctaaaatggtgagcaacacaaaaacattctggataaaagttctttattgtttctacttccagcagcgtacatcctgaacctacattctctccctagataaggagtggctctggctcagtgtccccagagttccagcagctctcatgcattttcacccctgctattagaatgaccccagtgtgtagccgcacacactgactgcagcacagaggaatgcgggatggcatcagcagtgctaaagagtggggctaaaagcccagcgagaatcacaggagaatgcagaactgtgttctgaggcagcagggatggactggatctaatctagtgctataagtgcaaaatgcccaggaaatgtgctctgtggatagccaaggactcctgctccccaagacagagacgcaaatctgctcccttagttgggtaaacaactctgggaagataaataagtgagcaggcctccaagtaaatcaacccacagcatgtgtgcataacgttttagtgttaaatacaaaataatctttgactgattgtcatttcaagtgtttataatattccaggggtcctgtcataatgttcttatcatctgtaagctgaaagacatatcagaaatttattaagtttgtaaataaaactgctatgtttgagatcacttgattagtgcaaagtttaatctattttgtatgaaatactttttttctctgttaagatggtaagtttgcttctcagacattttaaatacttaaaatatatgaaacctacaaatgtagttttaaatgtctgagggaaatctaattagctaaaattaatcaacaatcagtcttattttatgcaaaaataattagattcattaatagaataacaagtcttataaattgaaaaggaaaagaaaaactagctttaaaaaagtctaacttcagtaaactgaatgctacttttgaacaccagtaactacaacagttcttttggacattacaaactagcattaactcaccccaacctctccagcagccaggctgcagagatgtaagctaggctccacggagcaggcacacccatgggaaactttgatatgaatgtcatggcagtccctagcctctcctcagtcctctcccacttttagctggcactgagtaatccattccttcctccagaagagacccagtgctgtgagacattattcagtcaaagtggttttacaaaagtcatttagtaaatggcttactaaactacttagtaaacgactaagtctttggtaaacgacttcactaaactgctaaccacaggaaaatggttagtagaattaatatctttcccacataccacatagcaaaacaattttaatttcttccattatttgtgtcctttcctctgctcaaaagttgcctttcccgccagcttcactgtctctcttttctcctcttccacccctctcttcagattcagatctggctgtcaatggcatgccccgatcagcaaaacaaaagttccaccatgggccagagagtggccatccaccccgaccttgagtccacctcgccaaatgtgaaagcccaacgaaactgggaggggacggggtgggatcccgctgccaaggaaatgagatttttctcctgtcatttaaaatgaactgattgttatacataatttgaagcgaaataagagataacaggaaacaggccacctgaaggaaacagaagcagagccacttcactattttgcttaactcttcatgccaccagtaaggatctttaaactggaaaaggctggagcccaggaagagcatttcaacaacttcaaggcgcagtgaattactcccactgcaatgaaaagcaattacatatgtttctgtgcagccattgttggtgtagtttcctaagggaaaaaatggacagctgtcaggaaatggaagccagaggaatgtttctcggttttctgaaaagagcaaagagtaatgttctggtaaatatggcctggaatcctaatgaaatcctaggacagactgttagatgaatgttcggttgtgaaaggaatagagtccgctcaataaaaaatatgttgaaaaatgattaggctatcctctagtccttcacagaggacttggtgagacagtacatctctatcaaactgctaatgggggaaaggtaatcttatttcactacatctacatctactgttaaaaaaaaaaaaatagaatcatcagaaaatcaatgccagagagtgaaagctataaataagagactctgccagcgagatgtctacttgttccagtgcagcccggtgaagcctgcatagagagcttgcatcagtgcatgctctctaaaaaggtatgagggaggcaagggcactggcaccaggccaagctctacctccctgccaggtaccttggtgcagggcccacattctcctagagcagcatcttttccaaagatactttttgtggccctatgaacaactgaatgaagtcaggagctggaagctcaaatcccccttcttccatgcaatactctgaaaccctccctgggctgcagtcccttatgaatggatgtgaggtggccttccagattgacggtgaggactaaatgtcaacaggtagtaggagcatcaaatgcagtgcctggtgccatcataggaaaatccccaaggggaacagagctctgaagtcctcctactctccaattctgagattctgtgaccagagtttgaaatcggaaacttgactcagatcctttttggtcatcttttctttgcagtaaaaatgtaaaatgtgaactgaaaaaaggggattccctgaatggtagtttgtctttctattcttcccatcttgtagagttcaggcaaccctcatcttattgtgcttcaccttattgcactttgcagatattgacttttttataaattgaaggtttgtggcaactctgttcagcatgtctactggcaccattcttccaacagcatgtgctccctttgtgattccatgtcaccttttggtcattctcacaatatttcaaactttttcatcgttcttatatctgttgtggtgatctgtgatcagcaacatttgatgttaccactgtaattgttttggggcaccacaaaccctgcccatataagatggcagccttaatctacaaatgttgggtgtgttctgactgttccactgaccggccattcccccatctcttcccctctctgcaggcctccttattccctgagatacaacattattgaaattaggccaattgataaccctgtaagggtttaagtaaaaggttcaaatgttcaagtaaaaggtctaagggttcaagtaaaaggtccgtcatattaaatcaaaaactagaaatgattaaacttagaggaagccatgtcaaaagatgaaatacgctgaaagctaggcatcttatgccaaacagttaagctatgaatgcaaaggaaaagttctgaaaggaaatcagaagtgctactccagtgaacacatgaatgataagaatgcaaaacagccttattgctgatatggagaaagttttagtggtctggatagaagatcaaaccagccacaacattcccttaaatcaaagcctgacccaaaacaaggccctaactctcttcaattctgtgaaggctaagagatttgaggaagctgcagatgaaaagtttgaagctaggagaggttggttcatgaggtttaaggaaagaagccatctccgtaacataaaagtgcaaggtgaggaagcaagtgctgatgcagaagctgcagcaagttatccagaagatctggtatgataattgataaaggtggctacaccaaacaacagactttcgatgtagatgaaacagccttctattggaggatgatgccatctaggactttcatagctagaatggaaaagtcaagtcctggcttcaaagcttcaaaggacaggctgtcttgttaggtgctaatgcagctggtgactttaagttgaagccaatgcttatttgtcattctgaaaatcctagggcccttaagaatgatgctaaatctactctgcctataccctataaaaggaacaacaaagtcgggatagcagcactctgtttacagcatggttggttgaatattttaagcccactgttgaggcctactgctcagaaaaagattcctttcaaaatattactgctcattggcaatgcacctggtaatccaagagctctgatggaaatgtacaaggagattaatgttgttttcatgactgctaacataatatccatgtgcagcccagcccatagattaaggagtaatttcaatttttgagtcttaatatctaaaaaatacattttatgaggctatagctgccatacatagtgatttctctgatggatctgagcaaagtaaattaaaaatcttctggaaaggatttgccattttagatgccattaagaatattactgattcatgggaggggttcaaaatatctacattgttgattgattccaaccctcatagatgactttgaggggttcaatagttcagtggaggaagtaactgcagatgtggggggaaatatcaagagaactagaattagaagtggagcctgaagatgtgactgaattgctgcaatctcatgataaaacttgaacagtcaagaagctgcttcacgtagatgagcaaagacaatggtttctcgagatagaatctactcctggtaagacaccatgaacactgttgaaatgacaaaaaaggatttagaatactcataaacttagctgataaagcagtgacagggtttgagaggactggctccagttttgaaagaagtcctaccgtagatcaaatgttatcaaacagcatcccatgcttcagaaaaatctttcatgaaagagagtccatccacgtggccaatttcactgttgtcttcttttaacaaattgtcacagcacctcaaccttcagcaagcaccaccctgatcagccagcagccaacaacctcgagtcaagaccttccacaagcaacaggattatgacttgctaaaggttcagataatcactagcatttttaacaatgaaacattttaaaattaaggtatatatattgtttttcagacacaattaataaactatagtatagtgcaaacatattttatatgcactgggaaaccaaaatattagtatgactgactgcattgtgatatttgctttattgtggtggtctggaatctaacccacaacacccccaagatatccctataaacgataaaaaaacaaaacttctgaagtaataggtttatacttgttcccctgtgaaataaggtgctgaagagtcacaaaatcatgctctttgctgccctgtgttttttcctttgtgttttgatcagatactaggaagcaacatttatctaacaggtagatttttacacaaaaggttgggaaattccatctgaccaggtctagtttttactggtgatttcattaagtgtgtggggggccagatggatagaaatgaagtcacttaagggatacatattgaaggatgtgcactacctacatatctgagattttaaaatatgcaaaattggccaggcgtggtggctcacgcctgtaatcccagcaccttggaaagctgaggtgggcagatcacttgaggtcaggaatttgagaccagcctggccaacacagggaagccctgtctctactaaaaatacaaaaattggctggatgtggtggcacattcctgtagtctcagctacctgggagacggaggcaggagaatcacttgaatcctagaggcggaagttgcagtgagccaacatcacgccactgcactccagcctgggtgacagagcaagattctgtctcaaaaaatatatatgcaaaattgaaaaaagcatacacataaaggaatatgaacataggtgtcttggcctgttgtgcggctataacaaaatcccataggctgggtaggctctgggcagccaaaccccatggctttgctgagcacagcccagagcacacctattgcgagctgtagtcaggtgcctgcagctctcccaggctggaatcgcacaccagtggctctactggtctggagtcatgtggtggtccaccctcacagcagcctctgcttggctcacttgaccaaggcttctagctgctacattcttcagaatctaggtgggtgtatcaacacccctacagcttgtgcactctgcatacctgcaaagatggcactgcctgggggctgacaaggtttactgactctgtctcctggaggggcagccactgccacacctgggcctactaaagccaaacctggggtagctgaggatccctgccctagaatgtggagagcagagctttgagatggtgcccagttgtgcagcaagcacaggggtcccacagttcatccttggcccatcctttcaaattgttctgccaccaaggcccttgcattctggccttgtgatgacagtggtagccccaataatctcgaaaacgtcttcaaagtcattcttccatgtcttcatgactagcacctggtggattcacaccaatctcatcaaagagttgcttggccacacccttgctgttctctcccaaacacacttccacagtatggacaggtttagaattgtccaaatatttaagttcttcttccctcttgattgaaaattctgcttttaaatcattattctcttctcacattttactataagcactcaacagacgccaacccacatctttgacactttgcttagaaatttcttgtgccaaatatcctatttcattgctcataagttctaccttccacaaaatgtgaggacccaaacacaacttagttaagttctttgccactttataacaatgatcatgtttcctatggtttctaataacatgttcctcatttccgagacctcatcagaattgcctttacagtccatatttctgacaatattctgatcacaaccacttaagcattccgtaagaagatggaggctttctctacagctctccttccctccttctaagctctcaccagaattgccctttagggtccattcacagcaatctaagctttttctagcatgcacctcaaaactcttcttgtctctatccattatccagttccaaagccacctccacatttctaggcatttgttataacaacaaccacactcccagtaccagtttctgtctttgttcattcaggctgccataacaaaataccatagacaaagtagcttataaacaacagttatttatttctctggaggctgagaagtccaaattcaaggtgtcagtagacccagtgtctggggagagcccactctctcttatatagtgccgccttcttctgtcctcacgtgatgtaaggaggcagggcagctctctggggcctcttctacaagttcactaatctcatttgttacggctccactcatgacctaatcacctccaaaaaggccccatctcctaacaccatcagtttaggggttaatatttcagcatatgaattttgagggagcacaaatgatatggtttggctgtgttctcacccgattctcatcttgaattgtaactcccacagttcccatgtgtcataggaggaaccccagtgggaggtgattgaatgatgggggcggatctttcctgtgctgttctcctgatagtgagtgagtctcatgagatctgatggttttaaaaaggggagtttcccttcacaagctctctcctcttgtcttgctaccatgtgacatgtgcctttcaccttcctccatgattgtgaggcctccccagccacatggaactgtcagtccaataaacctctttcttctctaaattgcccagtcttggatatgtctttttcagcaacatgaaaatggacgaatacagtaaatttgtatcaggagtggagtgctgctgaaaagatacccgaaaatgtggaagcaactttggaactgggttaacaggcagaagctggaacagtttggagggctcagaagaagacaagaaaatgggagaaagtttggaacttcctagagacttgttgaatggttttgacaaaaaatgctgatagtgatctgaacaataaggtccaggctgaagtggtctcagatggagatgaggaacttgttgggaactggagcaaaggtgactcttaccatgttttagcaaagagactggcagccttttgctcctgccctagagatttgtggaactctgaacttgagagagctgatttagggtatctggcagaagaaattcctaagcagcaaagcattcaagaagtgacttgggtgctgttaaaggcattcagttttataagggaagcagagcataaaatttcagaaaatttgcagcctgacaatgcaatagaaaaaaaaatcccattttctaagaagaaattcaagccagctgcagaaatttgcttaggaatgaggagccaaatgttaattcccaagacaatggggaaaatgtctccagggcatgtcagaggtcttcacagcagtgccccctccctgcccatcacaggctcagaggcctaggaggaaaacatggttttgtgggccaggcccagggtccccatactgtgtgcattctagggacttagtgccctgcatcccagtcgtgactaaaagggcctaaggtacggttcaggccgtggcttcagagggtgtaagccccatgccttggcagcttcgatgtggtgttgagcctgcaggcgcacagaagtcaagaactgaggtttgggaacctctgcctagatttcagaggatatatggaaatgcctggatgtccaggcagaagtttgctgtagaggtggggctttctttcattgagaacctgtgctagggcagtgtggaagggaaatgtgaggtcagagtccccacacagattccctactggggcactgcctagtggagctgtgagaagaggaccactgtcctccagaccccagaatggtagatccaccaacagcgtgcaccatgtgcctggaaaagccgcaaacacctgaataccagtccgtaaaagcagctgggagggaggtggtaccctgaaaagccacagggacagagctgcccaagaccatgggaatccacctcttgcatcagtgtgacctggatgtgagacatggagtcaaaggagaacattttggagctttaagatttgactgccctgctggattttggactcacatggggcctgtagcccctttgttttggccaatttctaccatttgtaacagctgtatttacccgatgctgctacccacattgtatttaggaagtaactaacttgcttttgattttacaggctgataggcagaagagtcttgctttgtctcagatgagacattggactatggacttttgagttaatgctgaaatgagttaagactttgggggactgtcaaaaggcatgattggttttgaaatgtaaggacatgagatttgagaggggccaggagcggaatgatatggtttggctgtgttcccacccaaatcttatctcgaattctaactcccacagttcctacgtgttgtgggaggaacccagtgggaggtgattgaatgatgggggtgggtctttcctgtgctgttcttgtgatagtgaatgagtctcacaagaactgatggttttaaaaatgggggttttccttcacaagctctcttctcttgtctgccgccatgtgagacattcctttcactttccatcatgattgtgaggcctccccagccacgtggaactgtaagtccaataaacctctttctttcctaaattgcccagtcttggatatgtctttatctgcagcgtgaaaatgaacgaatacaacaaacattcaaatcatggcaatagaaaacatttatataggatccctcagattttttttgaaagcaacaacttatttaattttcatcaatagttatatttagtgatcatatttcagaatgtttcatataaaatctattagacaaatgaacacaacatggttattacataatgctaatacaggtggagcacccccagtctgaaatctgaaatgcttcaaaatttgaaactttctgagtgccaacatgatgttcaaaggatgttcatcagagcattttggatttcagattttcagattacggatgctctacctgttaggtatctgcaaatattcaaaaatctgaaaaatatctaaaattcaacatactttttcacaagcaatttggacaaggcataatattgaagaattactcccaccttgaattctctttggagtgaggaaacaataaaatgcttattaaatatatggaaatacataggttatagataacagagaaactaaaatgtattgatttttggttcattttgattccgtttcagctaatatggatggttgaaatgaagtataaacagatgaaataagaacaaagataaggagtgttagggtgggtccctaggaagggaatgtggaacattactgggatgataataattatccaattaggttaatctctattattttgtacattcaatcagtagccctgaaaagataaagccaatgtttcatgaggcagaaagtgacttctaaggaaagaagcccccacaaagccatgatcctcccaactgttaggtaaaagtggacccccactagcatgaagaaataatcgtctcttctgtttttaattatatatggacagacaagttccaaatccttattttatgttttctacttcaattattcctttcctattgcaatttgagttcattttctattctgctctcaattaagtgaagtcaccattttccctttaatcatatgttatcctccaatttactttcctacttcatttacttccttactattgtctttgggaagttttatcagctcttcagatgggcagaagatgtggtggcagggaaaggggcaggggctggctggagaccacctgacagggagtcaaggcctgtctcaccaggtgtgtgagcacaggcaactgtggagccctctgaaccccaacctcatcttcagtaaaatggaacagccacatctacatcactacaggtttgcttgaagtttaaagctattctacattaggagttcaataatcataataaagttgtcagttttctttttacctcctaatcaatgtgttagtccctgaagaaaatcattaagtaaaaaggaccccaccgacccactcacccacacactaacacaaaatagttgtccaatggcaggaagttggattaactgattaatttattcaggaaatatttatttacattttgatctactccatgccagatactgttataggtactgaggatacagcagtgagcaggcaaaagctcctgctctcgtggagcttctattccagtagggaaaacacaactaataaaatgaatgagcaaaatgtatagtatattaaacggtggttaagtgccattagagaaagagaaggaggaaactcagggtggggggatggcaaatgtgatcttacagggggttcaggcaaaggtgacatggaaatgagactggaagtagtgagtgaggagctgcatggctgtccagaagcaaggagccacctgaaaaggctctggggcaggagtgtgctgggcacgtgaacacagccagggtggctggaaagagctacaggggaaagagaaggaggagatggtgagaagggagaggtacaggccttcctttggctttgactgagtgagatgaaagggcaagccaagttctgagcagagaaataacatagtgcagcttacctttaacaggatccttctggttctctgaggggtgcagtgggaacaggctgcaacagggcaagtgtcacagcagaagctactaggaggctacttcaacagtacaggtgagagatgataagagtttaggtgagggtggtaagcagtcacatactggatctattccaaaagtgcagcctctgcagagtttgctgagggactggatacatgcagagctgagagaaaaaagtcaaggatgaccccaaggtttctggcctcaacaagttactagctgtataaactgcatacaaacttgtttctgaccccgaggactagatgagtaatcaatatacatgaaggcacagcccagtgtacggcacatgggcttgtgtggtatgcttaggttcaagtttacaaactctattgaatttctactttgtgctttgccctgactttgctaggtccagaaatacaaacatgagtaagtgtgaaatccaccctcaggagtttatgatctagtgagacaaagaatcatcctttatagtacaagcttccccagcagccacagaaatgagtagaagattcagatgtcagcagggaagggaatgattgactcagagggaggatatctaggagggctgcctggagtaggtgacaacagagtagtggtgtcttctcaagaggaaaatcgatgaggactggcacagctgggaaaaaggtgataaagaggacagtagtggctagacttctcaagaagaaaatcgatgagaatggcacagctgggaaaaaggtgatagagaagggcattgacggaacgcttacccgctactgaatgatgatcacttattgttgaagatagagactgtgtctcttctaacaccacaatcctgagatgtaggcacgacatcctgaagatcgcaatgtgtacacagtttcttgtaaatattctgcaactacatagttatttgtttgactgttcctgctttcacaattataatttggtccagtcaactctagtcagcaatataacattaccttgtacacctccaaagcaaaattgtgcaaaagtatagctgcctgaggaggcaagtcctgatccccactccttggggccttctctatccatagatccaaaaaaccacagatgcttctggtgtgttctgccaatgatccttggcagtaaacaagtgtcacgtctgactaggcaccatggctcacacctgtaatcccaacactttgtgaggccaaggcgggtggatcacctgaggtcaggagttcaagaccagcctggccaacatggtgaaaccccatctctactaaaaatacaaaaattagccagcttggtggcgggcgcctgtaatcccagctactcaggaggctgaggcaggagaatcgcttgaacctgggaggtgaaggatgcagtgagccaagattgcaccactgcattccagcctgggcaacagagcgagactctatctcaaaaaaaaaaaaaaaaagtgtcacttttaataacattactcaattgatgacatgtctgcatcatcatcaattatgattcaggtattttcatactgttctcatatactttgtaccagcccgtaattctgcatttgcttttattttcttagtaagatgaaataaaaggactacaaacatttagaataatatgaaaaaagaagccacaaatattaaccctctagttcatgtcatcaaccctgaatgcaactctatttccacaaattggaagaggggaaaaaatccagatagtaaatgaaatttttactatcatattttattctttaatttgaatcatgaagaactttgaaagtttattttgtgagaaaactggaaaattaaaaactaacagaaatagttcataaagaaatgcactttttaaaactttccactgcattctcttcctcttggtggtgaaagtatagattcaactgcttggaaaaaatatagactacgcgcccagtatcattagtttgaagtttgttctaactgtggtatagatagaggaagaaatcattagcaaactaaaggtaaaatacactcaactatatgaaaatcaatcaacagtcaggcttcattttttaaaaaaactttccattaaatcacaacacgcactcaagtttacaagggtcaagtcctagtaaaaacacctttaaaaatgaacaagaaaatcagagctattcttcattgatgttccttttttgtcatgaacctgttctgtatgaacaaaattcctttatttaataaattgcactaaggcatcatttgctcagccataatggaattactttgatccaacggaaataaataaggactagagaagtggaaatcaacaagtcagcaagttaacatctcagttgttgtatgctattcacctctaaagaaaaaaacactaaaggcccgacacggtggctcatgcctgtagtcccagcactttgggagaccacggcgggtggatcacgaggtcaacagatcgagaccatcctggccaacacggtgaaaccctgtctctactaaaaatagaaaaattagccaggcgtggcggcgggcgcctgtaatcccagctactcgggaagctgaggcaggagaatcgcttgaacctggaaggcggaaattgtcaatcccatttaagaaaactatcttttctatctaatatgccaggttttgacctaagtgattacaggcaagcccagcctctataaacaaaatgaggctgttcccacaaaacacactagaagggggcccttgccaggctccctgtctcacccacttccctccccatacatacacttggcggcttctggcttggagaagggtgagccaggaggaagcaaaactttccaactgatctatgtgtcatcgtttttaagctccatatgaagctcaagatgaatattttataaaggcacaaaccctgcatgccacaaaattttagttttcttacatgatcaactgtacttataatatcatgtaatatttatctagaaggatcttcttgtcacttggtaaaacagtgggtaaaaattaaagcccaatgcactgagaaactattaaatgaacaaattacatgttcaatcttaccgagtttcagaatctttttttttttgagatggagtctcgctctgtcgcccaggctggagtgcagtggagtgatctcggctcactgcaacctctgcctcccgggttcacgccattctcctgcctcagcctcccaagtagctgggactacaggcacccgccaccacgcccggctaattttttgtatttttagtagagacggggtttcgctgtgttagccaggatggtctcaatctcccgaccttgtgatccgcccgcctcggcctcccaaagtgctgggattacaggcgtgagctaccacgcccggcccaagttgcagaatcttaacaaattaggaaattagatatttgtcctctttttctgaaatcaggggaacttcggggaaaaagcagcaatctaagtagaccacagcaacaagaaattcctttatggaaaatttgcttgtaaaaatccaaataaagacgtatttgtagagggcaacctgaaggcaaaatatcatgctcatacaaaatgaactgcagaattgagaagcacaagtgcctggaggcagccccattatcaattctttgacctcttggagctgggtgtgagggctaaaaataaacttacttcaccagctgaactccttcaggccttaacatctaaaatcctggatccatagatgtgtttggataaaggacggagaccaggggtgggcaaagtggtagcaaaagggtggcgggtgctgcaggccacaatgagggttcaggatttccttctaaatgtgattagcaggagagtgacaggatgatttacatctgaaaaggactgctccaactgctctgcggagatgagaccaggtggatacagagaaaccaggtactggctactgcataatccttgtgagagacaaaggtggctcggatcaccaagcagtagagcaggcagtgagaagttatcaaatttggcatgcagctagaggagaaagccaacaggacttgatggtcagtcagatctggattgcagaggaagagaaagtcaaatctcttccacttttcacaaaaataaactacagattgttccagtagtcaagatacatcattcaaaggaaaactatggcaatggctataaacaaataatttaccaaaaaaaaaaaagatgtatgtgcaaatcaccacatcaaaagatttcaacaccactagtaattacagaaatgcaaactaaagcaaaaactagaatgctttcccctgtcttattagaaaaaaaaataaagataatcgaagtgggctgaacagtattcctcaaaattcatgtctatctggaacctcagaatgtgagagtctttgcagatgtaattagttaagatggggtcagatgggattacagtagaccctaagcacaatgactggtgtccctataagaagaggagaggacagacagagatacacaggcagggaagaaagccaggtgaagatggaggtagagactgcagcgatgcagctacaagccaagaaacaccaataggaactgcagccgccagaaactaggaagaggcaaggacagatcctcccctggaacctttagaggaagcatggccctgctacaccttgagtcagatttttggcctccagaactgtgaaaggatacatttttgttgttttaagccaccaagtttgtggttctttgtcacagcagtcctagcaaactgacaacgtaattgacagtattactgagagtgtgaaaagtacagtcatcctcaggcctgttggcaaaagcatagattagcacaacagcctttgggaaaaataatttggcaatgcttgccacaattgcaaatgaccagatcttttgactcagcaattccaatgtgaggagtttattctaaggagataattagaaacatgtgcaaagattttaaaagaatgttcctcacagggttaaaactggaaaaaaatctaaatgttcaaaaatttaaaataagtcaaaaaaactatggcgcaaacttacaacaaagtaccatgatgggaagatagtttggcagtttcttacaaaaccaaacaatcttaccaacccatccagccatcacactctttagtatttatccaaatgagtcgaaaacatatgttcacacaaaaatctgcatatgaatgtttatagcagctttaatcataattgccaaaacctgggagtaaccaagatgtcctcaaacaggtgaatgaataaacaaactgtggtacatttatttaccgcagtttagaatattatttagcaatacaaagaaatgagctattacctacaaaaaacatggaggaaaattaaatacgtatttggtttcttttacttagtaatctgaaaaggctggatattgtatgattccaactatctgacattctggaaaagcaaaaactgtgactgtgaagattagtggttgccatgggtttccaggggtggtatgtggaacaggtggagcacagagggtttctagggcagtgaaactactttatatgatactataatggtggatataagtcattatacatttgtccaaatccatagattgcagaatgccaagagtgaacccaaatgtaaaccatgaactttgcatgataatgatgtgtcaatgtaggttaatcagtggtaactaaagtaccgctctggtgtggatattaatagtgagggaggctatgcctacgtgggtgcaaggggtatacagaaactctctgtactttccactcaagtttgctgtgaacctaaaactgctcttaaaaataaagttaggccgggcgcggtggctcacgcctataatcccagcactttgggaggccgaggtgggtggatcacttgaggtcaggagtttgagaccagcttggccaatatggtgaaacctcatctctaccaaaaatttaaaaattagccgggtgtcatgatgcacgcctgtaatcccagctactcaggaggctgaggcaggagaattgcttgaacccaggaagcggaggttgagccgagatcgcaccattgcactccagcctgggcgatagagcgagactccgtctcaaaataaataaataaataaataaataaataaataaataaataaagtttaataatctaaaataaaaattaaaaaatgttcttgaaaaatactgggtttttttgttgttgttttgtttttgtttttgtttttgagacagagtctcactctgtcacccaggctggagtgcagtggtgcaatctcagctcactccaacctccgcctcctgggttcaagcgattttcgtgcctcagcctcccaagtagctgggaccacaggtgtgtatcaccacacccaactaatttttgtatttttagtagcgatggggtttcaccatgttagccaggctagtctcgaactcctgacctcaagtgatctgcccttctcagtctcccaaagtgctgggattacaggcatgagccactgtgcctggccttgaaaaagtatttgatgataaggttattcaagacatgtgatgtactattaactggaaaaagcagaatataaaaatataaactacagtatgattctaattttgtttttaaaaagtatatggtagcaaaatattatctaacaattggtgaatctggatgaaaaggtacataggagttcattatattattcttgctacttgtgtgtaggtttgaaactttttcaaaataaaaagtaaaagaattgaaaaaggccaggtacggtggctcatgcctgtaatcccagcactttgggaggtcggggcaggcagatcatgaggtcaggagatcgagaccatcctggctaacacagtgaaaccccatctccactaaaaatacaaaaacttagccaggggtggtggcgggcgcctgtagccccagctactcgggaagctgaggcaggagaatggagtgaacctgggaggtggagcttgtagtgagccgagatcgcaccactgcactccagcctgggtgacagagcgagactccatctcaaaaaaacaaaaaagaattgaaaagaagtggtacatacatgtattcatatgccattagacaaggcatagaaaacactacactattaatactggttatctctgagcgatgagattatgcacaatttcggaggtttgtgtgatttcttatattcgccaacatttctacaataaacatgtttgtaatcaggaacatagagttaatgtcatttaaaagcaataacaaatgcaagggtctaagaaacctaagaacattaatttgaaaaataacaaacctcttcaactaagctatcaatgccacctgctttgttgttttaacttacccatcacattcatgttcatggcctttgtaacctcttccattcctcccagcttcccccaggttcccgcgacctctttttcttttgcctggcaacctgtctccctatgcagagatgttgaacaccgcctaattcctttgcttgcataacaaagttcctcagaattttcaaccacaagttcttccattcctcttatcattttctgctctttagaaaaacaaagtgagaacaacagtgctcttggaaactaaaaatatggacagagaggggaaaaacaccgatagaaatttggaagataaagttgagaaattaccttataaagcaaaaaaaaaaaaaaaaaaaaaaaaaaaaaaaaaaaaagaagaagaagaaggaaagataaagagggaggagacaggagataaaaggtccaacatgagaagaagaaaatgtttcccaaatttcgaaggacattttctattttgaaagggcctactcagcaagtacccatcacaacgaatttaaaaagacctattccatggacatcagaacaccagggataaagagaagagcctaaaagcttccaaagagacagaagacttgagaaagtgtaaaggactgggatatcagaatagcactggatttagtgataacactgggaactagaaacaattaatgatgcctacaaaattagaagaacaaatttccaacctagaatgctatactcaaccaagctatcaagtgggcaggtgatataaagacattctcagtcattgtacctcccttgacactacagtagccaccactgatgtccacccctgcagccaccctcattcttccttgctaacaaattcaaattttattctgatattaagtggccatctgttttgaaggtggggcaccagtcccaagagggtgaatttattagcagacgccagttatggcaattccaatccctttgatacgacctgagatgtgaagttggctaggaggttttgagaaaataatctcctggcttttaaaaagaggctcggccgggcacagcagctcatgcctgtaatcccagcactctgggaggccaaggtgggcagaacacctgaggtcaggaattcaagaccagcctggccaacatggtgaaaccccatccctactaaatatagaaaaattaggccgggcgcggtggctcacgcctgtagtcccagcactttgggaggccaaggcgggcggatcacgagatcaggagatcgagaacatcccggctaacacggtgaaaccccgtctctaccaaaaatacaaaaaaaaattatccgggtgtggtggtgggcgcctgtagtcccagctactcaggaggctgaggcaggagaatggcatgaacccaggaggcggagcttgcagtgagccaagattgcgccactgcactccagcctggggaacagagggagactccatctcaaaaaaaaaaaaaaagaaaagaaaaagaaaaattagctgggcgtggtggtgcacacttgtagtcccagctacttgggaggctaaggcaggagaatcgcttgaacccaggaggcagaggttgcagtgagtggagatcaggacactgcactccagcctgggcgacagagcatgacttcatctccaaaaaaaaaaaaaaaaaaagaggctcaccagagaaaatggttcatttttaaacttccagctattgtggtctgcatatgacaccagagacatggcagctaccttgcagctatcccatgaagacaaaccctcaccttaaagaattgaaagttggctcaaagaaggagttgaaagttggaaagaacctaagtccttggaaatattaccaagcctaccctgtagccagccctaacaccagacttatgagtcaaaacgaagttcactttcttgatgcccaagtcctgagtcctcagcacctacaggagaaagactggtttcccactgtgcaaagacctgctgcagcccttagggtactgctccctggaaaccccaattctcataccatgctcacacaggattttgaggtgagcggggcatcctacccaccaagcagaatgtctttatgcactcgggccaagctggagtctgcagattagaacctgggtctctgaagaatagggtagctaaacccttccaggacttcacatggaacccatccatcagttaagttgttggaggcagaggtgggaaaccaacttagcttttaattttaattattctttaagtcttcatcacttatctcagtctaagcagagtttctaggctgatccagatttatgctccacagaggactgcgtatctgcattgaaatcagaaaacactctaaaaggcaacgtgatatttgtttatttgtactattaaaaaccacaggagaaaataccttatctggaaaaatagtttgaacttttactcacctcctcaaatctaaattgatatctaacacccattttccttgcaaaacaatagccggcagtagaaacagaacgtttatactaagaaatgttacagaaacctgagaagaaataaatacagtacttattttctatgtacactcactttctcctttaacatcaaagtgtgtttatatttttaaacactaaagtggaaagagtgattttattaggttcactccacccaagttcattgctacaatacctgactctctgccaaggtgcttagcctatcgctaggaagtcctaaacacaggcctgtttttaaacactttcaccactcccttagcctttccactttgaaaatattgtctggtatcatgtttacttctacattttaaacactgtttatatgtagaagtgtattttaattattgtcagcgattaatactattcttactatctgaatgtagattattctatatttcattaaagttgaaagtaattatatttgtggtttagctctaacaactgcactaataatactagtgataaaaatgcactcataaatcagtttgtataattattgatatgcataatgactaacaaaattgcttccccaataactctaatgatatgagagtaatcacctcctctcctaaaaataacacgctacaagcacagagaagtcccaacttatacacggattctgcattgtcaattatatgtgatggggtaaactaaaagagagtgacagattatctgaggtggaattaaatgatcaatgagccctgaaagacagggagaggagaacatacacctgcatggtaagagtacatcaacgggtgcccctctaacactcactagctgatacttttagctccagataactctgttgctttcagaccactggaggcagtaagctgtactatgatgatcttagggagagcagatgcaaataaataatatgctaaagattcagtcaccttattcctctacaatacatttacctgcattggtatctctcatgaaacctactcaaatgcagtcatgtcagcagttgcccactgcagctgaggtggtcccaatgcttcaggctcagagctggcatacagcacaccagatctgctcagtctcagaacttaactccaaaacccagaggctgacagagctgagttgctgtttctagaatgactatctcaagaaccgggcaaggcataatggaacccattagtaaattcagcagaagaaggaagaggcaggaaaataagaagggggaatgtactagtctgtcttcatgtttctataaaaaactacctgagactgggtaatttataaagaaaacaggtttaattggctcatggttccatgggctgtacaggaagcatggctgaggaggtctcaggaaatttacaatcatggtggaaggcaaaggggaagcatgcacatcttcacatggccagcaggagagagcaaagggggaggtgctacacacttttaaacaaccagatcttgtgagaactcactgtcacgagaacagcaagggggaaatccacccctatgatccaattacctcccaccaggtccctcctccaacactgtggattataatttgacttgagatttggatggggaaacagagccaaaccatatcacggaagttcagtctcataatgaaagcaaatctcataattatttttgttaagcatgcattcctctgttgactcaactaagactcaggctctgggaacttaaaatgcaccaggctttatctatgttaggagttatggggatatagaaaaataaggcatgatttggattcttggggagttcgcaatccaatgaggagaaagatgagtgtcttagtcacctgggctgctataacaagataccacagactgggtggctttaacaaatatttatttctcacagctctggaggctgggaagtccaacattacagctctggcagatctaatgcctggagaggcccgcttcctgctttgtagatggctttttgctgtgcctcacatggtggagagagaaaagaaaggcactggtccccttcttcatatgagggcactaagcccattcatgaaggctctactctcacggcctaatcacctcccaaaggtcctaccgcctaataccatggcaccggggagttaggatttcaacatatgaatttttaacacaaataggcagtccataaccacaagaaaacaactatttagttttgaatcaaatattaggtagaaccacacaaaattatgttaattgtagtgaaaaacagaaatatttgtagtcaaagaggtagcttggggccgggcgtggtggctcacgcctgtaatcccagcactttggaaagccaagacaggcggatcacaaggtcaggagtttgagaccagcctggccaacatagtgaaaccatgtctctactaaaatacaaaaagtagccgatgtggtagtgcatgcctgtaatcctagctactcaggaggctgaggcagaagttacgggaggaagaggttacagtgagctgagatcatgccactgcactccagcctgggagacagagcaagactctgtctcaaaaaaaaaaaaaaaaaaaaaaaaaaaagagggagcttggaaaaaatattctgggaggtgatggaactgttctgaattttgattgtggtggttacataacttattgcacttatcaaaactctcagaaactgtacaccaaatagagtgaatgctaccgtatgtaaatttaaaaataagttttaaaagcagctgaatatcagtaatttcatacggtttaacttagtagatgcgccagctcaggcagacagttctgcaggattgcaggaagcagagacgagcagagattaatagaggagtgatagtctcatgaacaacaaccatttcatcagagccttgaaaaaataaagccctcaacagtgaagaaaagaagggcaagaaggtaaatatcctagagacaaggacagcacaagcagtcaaaaagttctacaaactcacagcaggtgtggagaatagcaaatagagcagtagatagttcatgaaagcagggggatcacaaaaaaaaaagggggtagaatacggaggacttaaaagaccagattaaatacactagaatttattctacagtcaatggcaagttagtaaagtgtttagacaaaggactgacatgactaaatctattttggaaagataaccttgataaaaatatggaggatttgttggttgtgggaggtatcagaggcaggagaatgacctacaagggtttcttaattggggtctgtgaatttcttaaaatggttgcaatattgtgtatgtgcacacacatttgtacatacacacatctttttctagaagggggtctatggttttcattagctactgaaggagttcataacctccaaagggttaagaactttaagaactgtattgttcaagtgcatcaagatgcagcaggagttaagtttgcagtgagcagaataaattcagagacacttatgaagatcgcatttctggacttaaaaataactagtgagtgagagtgagagagggaggatctaaagatgacaacaaagtttctagcttgctgacctgggaagtgttgagggagaggaagggagagggaggaaaaggggtatcattacactaagaacaaaaaaatgatttcacttcaaagaactgaatatttaacctctgcacttgtgtcactcttagctggagattttcttctatttttatgggccaaagtatttctggctaaagagagagataagatgtactacagaggaccgtacttgcatatgaaaataaaaagcagatgagaaaacaatcttcaaagcctttctcagagtgagttcgctctccggaggcttgctttccacattctcatggcattaggaaacctcagggggatggtatctgcctctgtcacacaagggaatgaatgtaacatatagtattggaataagctgaagatagccatccaaacagtattaatatgttttaaacgtacaaaacatttcatatgacttgaggatttttgtaagttagaaattcgactcactagcatggattacaccttaaataaatatagtttcttccctggtgttttcatacatcatggagcaaatttatatttatttggtaaacatttgcttattaaataaacgtttgcctgaagttgaaaggggatgctatatagagctcccctaattgctctgttagctcatttgacctccagaggccctgggatccaaagagctgcacccccacctcaggaagcctggagaaagccaggcagcagcaggacagtgagattttgttcaacaaatctgtattcatagccagatactataatgggggttggaaaatacaaagatgtgaggggctctcagcttgtctgtaatgaagtgatcagggcagggcaagagtgtcagattcagtcatgtaggagcagccctgtgcagaaagaaccccacggccagggagggaggctccagggaacatatggctgtcaccatatgggagtcgagagggctgagaagacagacctccggggagagtatctgaggcttcctaaatgctcatacctcaatttatagcagagtgctgtcacctgaattccactcacactgctctgctgggtctcctcactaaagcaagcacacccactgagaactacggcacgcttgggccatctggcccctctcccacaccctgcaacacacacacatacacacacacacacgcacgcacacacatgcatgcacacacaggcacacactcaccaactgaggtctgtgaacaatacaacctcagtcagttgcactgtttcatttgtacatattaccgtaaccaacaaatgactgcaaaaaaactgttgttcaatgaatactctggaaatgcatgatggaggtagactgctaaaaaaaatgctgccaaatcaggtgtgaaagacattatctgtaaaaaggaggaaggaaaattgttaaaaagaaatctaccagatttccaggtgtccttaagtccttccaactgtaatacggctgtggttaacagaaaaacaaagatgtggaataaggcagatccatattaaaagaaatagcctgggacttctgtcaaataactggtgagtaaatgtgcatttctgtgtatgtaattaaaataaaatgtttaaggaatatatggatcattttttttgagattctgtttactggccaactactataagaattaaccaaaaacctaatgattccccaattcctcttctacataaatttaacaacctcccactgtcagccaacatcactcccattaccagttaaactcccttccaactggaaaatcattgctctgttactggtctttatcaaagatgatttccaaaccatacaatctcatttactgtgatgtagatttagctttacttgttaaaaaggattttatactaagatttaaaccttaaccattgccaaatcttccttcagtttgcccagtaagatttcatacaacctagaaaagaatttagagcctgaataaatatatgaagtgctctagcaaagcactttcttagtgtttgtcatcaattatattccagttgcaaaattttagatattgaagatcatttcaaaaaacttttaaaattaaaatttgaatgcaaagtatgtagctactttctttgttttggtatatggcaatgtaagatactagagagtaaaacattcaagttgtaactactgaaattaaatttgataagaaacttgtccttttattgaataattactttattcatgttttttgaaaaatgtattcagttggaggagctgtcctctttttaaaactgatgctttaaaatccacgttataaaaacattactaggccaaggcgggcggatcacctgaggtcaggattttcagaccagcctggccaacatggtgaaaccccgcctctacaaaaaatacaaaaattagccgggcgtggtggcaggcacctgtaatcccagttactcgggaggctgaggcagcaaaatcacctgaactcgggaggtggaggttgcagtgagattgcgccactgtactccagcctgtgcgacaagagcaagactctgtctcaaaaaaaaaaaaaaaaaaagatcatagctctttcttcagtgtcttaaaatatcaatatattagtatataatatatctctagcatttttgtaaggtctcagaagccctatgaaatgctctgggttggcacttgatctttacacacaggattcaacataacagagcaacttgagaagacagaactggatttcctgaatgggtaatgagctcctttacatttaattcactggaggctaacatcatccttaattaaaaaagaaaaaaaaaggtactattaaaattacatttacttcctacaatagaaagccaaaatggaaactaccagagcttcatgaattttaaagccctacgcaaacgttgttgcacaaacacaatttcctctagtcctagaagttttgctcaagttgtattagctccatacaacctgacctacttgttctaaaatatttggttgcaattcaaagatgggattctttcttatggatcccacatttatagagcaaatgtacctaaatgttaatatatgttcatcataaattagattaaaaactaactcaagttaattttagtatgtcattatacagtattaactaaacaattaggataaaccactacaaaacagtgagctgtgacatcatagagccatttcctttcaagccctacccttaatccactcttccacctgccaatacacacacatgcacgtgtgcacatacgcacacagaaccccccctccaccaccacctttcatggtgtatttttcaacccctttagagaattgacaaggatagaagacatttaagattaaggtccataaagtattcattattgttgttttctgctttctttaagaactgtctcgtcctatcaggacacacagctatgctagctcagctgtaaacaaaaggatacgaccttgaaggtgtctatagctcactggttttagatgccgactccacatcttcatcacagctcctaggtggtggctgcactgatgtgtacaataagataaactgaatcgctagctgaaataagcattttgaattttcatttgtatgtgagtggattcaaaagattaaagtgctatatccataattacatgctcactactattaaaaatacctaagctaacttctaattaaaagggtggatagtacatgtgtattacctcctctccctcctgaacccctgccaaaaacaatatataaggccacaaagaagaaaagatccaagtgaacaagagatgcaacacttttcagaagatggaaaatgaatacagaagtagttataggatgagaaatagcagaggctacagaggggaagaccacacagaaacaaatttgctctgcaacccaggctccaggcttaggggagcaggacccaaccacaaagggaatagtagggtgggtgtagggctgagaacaggggagtgaatgaatgccagcatatgcaacacttggatccccagatcctgcacagacactttctcccctgacctgcagagacagtttctcccaggaaaagagctggcttgctcaagagcttccaatttgcttcctagtgactcactgggttttctggtggtaaaatacacataacataaaatttaccatgttagccattttaaaataaacagttcagcgacattaagtatactcacattgttgtgcaaccgtcacccccatccatctctgggactttttcatcttcccaaactgaaactctgtacttatcaaacactaactcctcactccctctttcccccaaacccctgccattctactttcttctctatgactctgtctactgtaggtacctcatgtaagaagaatcatccagtatttgtccttttatgactgactcacttcacgcagcataatgtcctcaaggtccatccatgttgtagcatgtgttagagtttccttcctttttaaagctgaataccactctatagtatgaatataccacattttatttatccattcatccatcagtgggcacctgggttgcttccaccttttggctattgcgaatatcgccgctatgaaattgggtgtacaaatacatctttatatccctgctttctagtgattcactcttacatgtgaacagataactaaggatcagaggactttttaggaaaacttcccaacgttaaagacagaaaccaaaataaataaggaggaagggctcttgaaaattaaaatggtataggccaggagcagtgactcacgcctgtaatccgagtactgtgggggaccaaggcgggtgggttgtttgagctcaggagtcccagaccagcctgggcaatgtggcgaaaccccatcattacaaaaaattacaaaaaaattagccaggtgtggcggcacatgcctgtagttccagctactcgggaggctgagatgggaggatcacctaagcctggggaggtcgaggctgcagtaagctgagattgtgccactgcactcctgcctgggtgacagagtgagaacatatctcaaaaaaaaaaagtataaataaaaaaggttagatgggttggaaaataaagtcatagaactttcccagcaaatagcgtaaaaagagagatcaaacatagtagagaaaagataataatcaatgaagatggtccaacagcaaatttataggatttctagagagaagaaaggtgtttatcaaataaactacgggagatatttcctcccaaaacgatattggtatccacattcaaagggccttccaagaggcttgcaaagatgaaaatagaccatacaaggcacatcgtggtgaaatgtcaccatgccgggaataaagacgctaaaaccttccagagcaaaaagcaggtcatgcaaaggtttgggacacagaatagtatcaaaggtctcaatagcaacattcagatgctagagtagaacaatgtttttcaaattcagagaacaataccttttaagctagaattctgtacctaagcaaatcatgaatcaaaaaagaggcaaacaaggtctccatcagaggagaggagcagaaaagtcccaggaacaggggcagcaggcccagagggcattaggttggtgggcacaagggcacaggagatgaaagcttctggcctcacactatgggtctgtagctttgtttctgattgattcatgcagtcatacaacagtgttttttgtctattatgtatcaggcactcttcccttctaagtgctgggaacagaggtgaaaaaaacaaaagttcctgtcctggtgcagttttcattctaaggcgggagagggacgataaacaaatataccttgttaggtaatgtcctatgaggaaaataagcagggaaaagggatagggtgtaaccaggtggagtgctagactggaaagaccagaggtgaccttggagacctgagtgcagtgagggagagagccctgggcattttgggggtctggagagagagctcttaggcagagggacttcaggaccagctgccctcatcagcctggcctcctgacaggcattctccaatggacaagattttctcttgctcccagcctgttcatttcttctggaccctctgggaaacaactctgcctggaggcagatggcagggctaagcagccccaattaccacatggctggggccctattgggccagtcctctttccccttcccagtgggggagatgacacaagactctgcaagagagatgggaccccagaagacagaaaggatgcaagtggttgagtgctaaggtggtaagtccaggccctgaagccatctaggcagacacaacatctgacacttacactgctctttctgtgcattttcacaagcaagagaggcagaacaggtaccaccatcatgcacagatgccgaaactggggcactgccaggtaaggaacctgcccagggtcacagagcctgttagttacagtacgaactctcactggggcctgcttcagagaccagtgctaggtcaaaaccaaacgtaaacatgtttttcttgttacttttcatgttttccatacaggtaaaaataaagcccaagttgtaagtggttcatgagaacagaagatctttttatttagcatttcacaaaatataaggctactcctcttgagacttcaccttgagctgtaattttctagctacccatgggtcagagacaggcactagaacttggttagacttactccacctcagattaggagcaattaccgtttgggaaaagaaaagcaaactgaaggatggaacagtctacctagaagatgtttcaatgatcggataactagcattatgactagttccccgccagaatatgccgcctcagccttcccttccaaacgctgcaatctcctttccgttacctatcttcggggttgcagttttgttctaagagcagaggagcatttgcatctgcggggcgaaggtgctgagtgggaggagcggccactgcatgcccacagaggaagctgctgtgacagccctgctgctcctgctgagcaagggaactagagtggcccagtctccacctgggtctggctccgttcccgaagctgattcaggaattgagtcatcattcgcaacctgaagtcaaggaacatcttaattagatttaaaacactgtatttcaataatatctaacagtttaaaaatacccccacatttaaccctcagcattcctgcgtgagggaaacacagtggtgcctgcaatttacttgaaatgagtaaaacatgtgaaatggacagatggatggatcggcagatacgtgataaaacaaagtaaaagaataaaggtagaattcaggtattggatatatgagcgttccctgtaaaattctttcagctttgttgtagttttgaaatcttcataataaaatgtcagggagagtgggagggagggactctcccatcatcctggattatttcaatatccatgtgaatgattaattcaacaacccagcctcaagcttcctggccctctgaatgccggcactctcccgtcacctcctggaccttacctcacttaaaacagtcctgccttgatcttaaactatctcttcagaccagattcctttcattccagctcactgcctcataggtgcttccgcttcaggaaggtatctacacctaaaccctccatttccccgtgacttctggtgcttctgtatccaacagagatttatcagccccctcagcaccttccctgcaaacctgcagggccagccactgtcagggaagaggaacacaggggcaggaaacaacctcacagcccctgcctgcagcaagctcatctggagctgagagtagggacggaggagatgtgtgggcacagctctcacggggctttgctgccatggttcctgtgggcttgcctgtgcttctctcccctgctggatcccctcttttccaccgctgcatcttcccggatagctcagtttactctcattttgatggatcatatttttcaacagcttaaacagtttttattatgaagtattttaaacataatcaaaagaagagagaatggtataatgaacccacatatacccattctcaacagtaacaagagtctggcatatttgcttcattatcccattttttttctttttctttctttcttttttttttctccatgacggagttttgctctcgttgcccaggctggagtacaatggcgcgatctcggctcattgcaacctccgcctcctgggttcaggtgattctcctgcctgagcctcccgagtagctgggattacaggcatgcaccaccccgcccagctaatttttccatgtttttagtagagacggggtttcaccatgttgatcaggccggtctcaaactcctgaccttagatgatccatccgccctaggctcccaaagtgtcgggattacaggtgtgagccaccgcacccggactttttcttttcattctttgctcaagtattttaaaggaactcagacttcttcagtgtgcctctcttaaactccaggcctgtaatcccagcactttgggaggctgaggtgagagaactgcttgagtctaggagtttgagaccagcctggtcaacatagtgaggtcatgtctctacagaaaatttttaatctgttttcaaatgtatttgcagagttgtgcaaattaaaatataagaaattaatgcaaaggtcagctaaagttgctgtctattaatttgatatttagtagttttcatttgtaaattaactaactcttagactgcaaataaacatttttgtaaagggctatgtttttaagtttctaagaaaatcttcagttagcagtttagagtcttctaaaattaaagtagaaagaaataattggtgtgaaaatgcaagggttagctgtgttagaaaatgtctaattgagggttgtaagtttcttctatcttgagaagaataaatattttgaagagtaacattgaaggtggcatgtttaaaagaaattaaatggttattataaaccacaggaaaaatagtagaaaggaaatggtaacagaacaatcaaagaaaagcataatgggataataaacaggttaacagtgtaataatgataattaacagtaacaagatattgttaaaattttaattaaacttaaagcagcagcaggaaatactgaaaaataaaatacttggctacataaaaatgtacacttctacttacttctaaccttataaattctaaaagaaaaaacacaaatggtaaaacacatatgaaaaaactgtttaatctgaacagtgcaaaaaatgctaacaataacactaatgaacaatttttcacactgcaaatcaccacagattaagaagactgacatttttagtgtgatgaagacaagttccttccagcttttgggaaggcagagtggcactctgtgtcaaaatgtaaactgaccataccccttcacccaccaaatctatttctagaaattcacccacaaaagacaatcacataaatgttcaaagatctatctattgaagcagttttcaaaagagtgaagattaggaaagacttatccactaataatggatagggtaaataaacaggtacattcacaaaaatgactactgctacagtcactgaaaatgtaaggatgctggagaaagtcacataataaagaaaatcagtgccactataattcatgatcactgctcccaaatgggtcctcaattccctttctctaaccgcagactcacaggcccttctgctgatgtgatataagctctcctatcagcaataaacaggaatgaagtattgatacatgctacaacatggatgaaccttaaaaacagcatgcaaagtcaaagaccagacacaaaggaccatatattatatgattctatttacatggaatatcccaaataggaaaatctataaagacagtagattagtggttgcagacttgggatggaggtagtagggggtgacagctggtaatgaaaatactctaaacatgactgtggtgatggatgcatattcaactctatgcatgtagtagtatattcaactctgtgaatataatacaagccactgaattgtacactttaaatgagtgcattgtatggcatttaaattctctcaataaagctgttaaaaaccaaaagctctcccatatgtggaatgtttgcgtgacccctgccacctgagtaccctcatgcttacagctaaacatgcctatgtgttattctaatgtgtgtgagtttcaccactggcatgcaacaaatcagctctatattcatttgttactccacctttctaaaaagctatctgacatattgacagtacataatgacagctaaaatttcttatcctttaattcagaggtgatctttttgaaacctttaataaggaaatacaaaaactaaatctgtcacccaaactggagttcagtggcacaatcactgctcacttcagcctcaacctctctgggctcaaatgatcctcccacctcagtctcccaagtagctgagactacaggcacacgccaccacacctagctaatttttgtagagacagggttttgccatgttcctcaggctggtctcaaaactctgagatgggctcaagtgatctgcccatctcggcctcccaacatgctgggattacacggatgagccaccatgctcagccaataatttttataattggaaaaaactgcaaaaaatctaaatgtttaacagtagaagaatcaataaaccataatatgcccatacaagagatagcaaaaagacattaaaatgttttcaaagaatatgaactatagagtgttcatgatgtataagtgaataaagcagaacataaaagtgtatatataatgtgatcccttttatgtatattatacatttctacaacaacatggatgtgggagcacctactgccttctctgaataccatccctttccttgagagccactgtcttggtgtaatgtgaccacactgcctagtctcaggagcaggggctaatctggggatggggtgggctaatgacaggctctttcccagaaatctcagccatgagattcaacttggttgctctcctaaacggagatcttaaccctagggccggtttgcaagtcggctgcagttagctgttatctaaggaatgctgggaatgctggtaggggctaggcccacggggcagctctgactcctccccatagtcccagtgcttaaattccaaggtacttagcttttgctgaaatgctggggcaggaagtctcccagaatgcagtggctgtgaacagcaaggctaatcccatgggaatggtggctgtgtctacctgtgccagcagttccctgtagcatcttcttgttgaacccactccagtcacaggaaataatcagagagctgattatgctatgcaaacaaccaggggttgtggcagtctacaatttccaaccacttgtctaaagcgtgattcagaggggcagcaaccagtcctggtcaccacaagctgttacactttctgcaggctgggtatgcaaaatttacctttctttcagaatatactgtataattttacttggaattcttattctactctcacagcatgttccagatgtcacacagcatgaggaagcaagtgctctccagcccaggatctgatagcacccacatctttgaggactgaggacagagggcatcaggaagccctgacaactctggcacatctgccaccaggtgtgtggtgaggtcatgagggcagacactcaggcgctactcctcttcttctcctggttactcaagaaagctactcagtacttccatacctgagtttcctcatcttcaaaagggaggttacaccctctaagccgtggcattcaccaagaggctgggacattattcttagaaatacacaaatacacgcacccttttttctagtatgggctgttcttaaaggtatgtgtcacactgagtcagcaggctcctgggtccataggcaggtcagcagtctctgacacattctccttcagctcttctgacaggtagaccttccatttttacagctttatggaaggatatttcacagaccataaaattcaacactgaaagggtaaagttcaacgcttttcattattgacacaagcagatcttgactgtcacagagagaaagataaaaaacatattagctcctttctctagtggcctgcatcctctgttccctgccatctcttaatctttccctccaataatgtttgcctgggcatcccctctaacccacagccactttcagacccctcagcagcacctcctggtggccagcaagccttggagggagggagccgccagctagtgcagcagttagctcaccatgccaggacccacactccccccagtggaataagctctatgctcagacaacagacttaatgaaaaccaaagaaacaaggataaaaatgaggtgaaagaaatagaagtgtttttgtgaacttttaaagtacagtaaataagtctagagtttataagcaaaagctgatatttttttaaaagagctttactgcataatctttatccttattcccacaagcagtcaaaaatcccacaaccacatgaacctatcaaatagtaaagaagcatttgggaacaagagctaggcgcagaagctcacacttgcaatcttagcactttgggagaccgaggcaggtggatcacctgaggtcaggagttcaagaccagtctggccgacatggtgaaaccgtctctacaaaaaaatgcaacaaattaaccggacatagtggagcatgcctgtaatctcagctactcgggaggctgaggcaggagaattgcttgaacccgggaggtggaggatgcagtgagccaagactgcgccattgcactccagcctgggtaacaagagcaaaactccatttcagaaaaaaaaaaaaaaaagtatttggggacaagaaatgaattaatatgtgtgacggacaatgacttaataatacctaatctggttctactttcttcatcttgatttctacttttgattgcttcttattgtaaggaatattttcaagacatattttctgtttctcatttatttttcactggtcatattttctaatcctgtcttcactttggtgtcttctctggattttagtagtgaaaatgactgacacgttttgaaataaatgttaaaaagataaaaagaaaaactcttgcctgaaaaattaccctagtattcaagctacttgtgtaaattacagaaatttaaaaaaactctagataatataattatcagatagaagttctacaatgagtacatttgaaattattaaagacccaaagaaataaaaatcccagggaacaaaaggtaaatacaaagcatagaaaaacatgatagtgaggtgggtgcatcacctgaggtcaagagttcaagaccagcttggccaacatggtgaaaccccatctgtactaaaaatacaaaaattagctaggcgtggtggcgcatgcctgtaatcccagctattcaggaggctgaggcaggagaatcgtttgaacctgggaggcagaggttgcagtgagctgagatcacagcactgcactccagcctgggtgacaaagcaagactctgcctcaaaaaaaggaaggaaagaaaaatatgatagaaatatatccaagtacatcataaatcacaagtataaataaataaaatgtgtccacttaactggatgaaaatttagaccatgtaaaaagaaaagtaaaccccacaaaatccatagagacacatgcagatacacagaggttaagagaaaaagaggaaaaaataaatatactggaggaatttagattctgagactgaaggatgagataattcagattaactccccctctgaacacaactggaaaaaatataaaggatattttcttgaaggcattatagaatcaagaagatggtaaagaatggccaagccaagatactggaagaatggaggtctgagaaggtgagccacgcatatggggccatcttccccttggggcaccttctgattctggagagcatcgctgagcaacaaggactccatccagggctgaaggcacataaattggaatccaaggcccccgaaagccagggagcttggttaatttggactgggatcctgaaggggtactctttaaaagcaaagaccaaccagaagttggcaggccctcataggcactgcagcttagttctgaatcatttcagtccttgaaatcggactgatgttaacccagattgctactgctgccaagtgcccaccagaaacaaacacaaacccatctcggaggagaaatatctatcatcctagacctcaatttatttttacattttttcaatctttagataactcaatcaaaaataaccaggcatacaaacaggcaagattatatagaaaaaaaaaaccactagtagacaccacaagcaacagaaacatacccacaattgctctagatttagagcaaaagaactatgtttactatattcaacaagataaaagatgagattgttttggcagagaactgtaaaccaaaagacgaaccaataaacatgcagagaggctcaatatcattagtagttagggagatgcatattaaaactaaaataaactactagtacatcccaactatgatggttaaaaatttttttaagtgacaacgacaagtgttgctaaatatattgagtaattctcataagctgctggtacaactataaattgtttaagccattttagaactgttcggcaatatctaataaaactgaacatatgtgtaacctatgatgcagtgactctatggcaaggttatacatccaacagaaactcatgcacatctacatcaagagacatagacaagataactcctactcgcaaaatctgatcactagaaggaaaaatagataatcttactctcacaatagtagagttaaaacacacacttgtcggccgggcacggtggctcacgcctgtaatcccagcactttgggaggccaaggcgggcagatcacgaggtcaggagatcgagaccatcctggctaacacggtgaaaccccgtctctactaaaaatacaaaaattagctgggcgtggtggtgggcgcctgtagtcccagctactcgggaggctgagacaggagaatggcgtgaacccaggaggcggagcttgcagtgagccgagatctcgccattgcactccagcctgggcgacagaatgagactccatctcaaaaaaaaaccaaaacaaaacacacacacacttgtctcaataaactaattgatcaagtagagagaagctgaataacaaccaataaacccaatctaaaggaaatatgtagatccaactagagaacccattattttcaactccacagtcattaaagaaaaagaaaaaatgcaaatttcaacaatgatcaaagaatctttatcatacaatttacattatttaaacccaataaaatcagaaatcaaggacaaaaaaaaatcttggaaatttatggacacagttttaaaaaatcataggtcagagatgaaaccataaaggatattaggaaatacttacaactttaatgacaatgaaagcactaactattgaaatatatgggattcagctaaaccactacttagagagaaatgtagagttttacgtgtgtattagaaaagaagaaagcctgaaaaccaataatttaaatgtatgactcgggctgagtgctgtggctcaggcctgtagtcccagctctttgggaggccgggggaagtggatgacatgaggtcagaagtttgataccagcctggccaacacggcaaaaccccatgtctactaaaaatacaaaagttagctgggtgtggcggtgaatgtctgtaattctagctactcaggaggctgaggcagaagaatcacttgaaccagggaggtggcggttgcagtgagctaagatggcgccactgcactccagcctgggtgacagggcgaaactctgtctcaaaataaaattaaaaataaataaataaataaatgtatgactcaagaagtcagaaaaagaacaagagtataagataacaggggcagaaattaatgaaacttgaaacaaaaaaaaaatcctgatttttaaaacagcagcaaaactgaaagctgcctttttgaaaagactacaggaaaatagagaaggcataaataggaatgaaaaaatgattacaactacagatacagctgacatttttgaaaaagaatactatgaacaactttatgcaatacaactgaaaatttagggaaaagtggacaattccaaaaataagtaacattaaaattcagtcaagaagaaatgtaaaacttgaacaaacctactaaagaaattgatccagtagttaaaaacctattccctcaaaataaactaaaaataaacaaataaaaccctggacacctgccctagatggtattatcagcaaatcatatcaaacattcaaaatgcagataatctctatttacacagactattacagatgacagaaaaagaaattattcccaactcatataatgaagctaagaaaacccaaaaaccaagccaaacaagtacagcatgaacatctcacttactaacagattttaaaaacctaaataaaatgttagaaaatacaattttacaaaatcttaggcaacaccattgtcaagtacaagttatccaagtaacacaaaacaatatcatactagaaaatactttagtatgattatttaattcatcacattgacagactaaaggagaaaaactgcattatcatcttaacaggtacaggaaaatcactctttaaaattcaacactcattcctgatacaaacacctggcaaaccaagaccaacagaggatttctctaacctgataaagactacctacaaaaacatacagcaaatatcatacttactgatgagacattagaagcagtccctttaaaatctggactaagataagggtgcccactatcaatcacagcctccattcaatactgtgctgaagtgcctgacatggaagtaagacaaaaaggactggcgtaaggattggaaaggaagaggcaagtctgtcataatgtgcagagaataggaaagtctacacagaataactaagaaaatctataagttattagaattaaaatgaaaggttcctggttataacctgaaaatacaatagtcagttacatgtctagacatgagcataaaaataaaaatatacagctgacacttgaacaatgtgagcgttaggagtgctgaccttcatgcagtcaaaaacccacctataactcctgactccccccagaacttaactactaatagcctcctgttgaccagaagccttaccaataacgtaaatagtcgattaacacatattttgtatgttatatgtatataccgtattcttacaataaactagaggaaagaaaatgttgttaaaaaaatcatatagaagagaaaatatagttactgttcattaagtggaagtggatcatataaaggtcttcattcttgttgacttcacattgagtaggctgcagaggaggaggaagaggaggggttgatcctgctgtctcaggggtggcagaggcagaagaaaatctgcatataagtggagccgcactgttcaaacccatatggttcaagggtcaactgtaagtcatgtacaacagcaaaaaaactatataacaaatcaaactagtcacacaacataaagttttattgaaagtaattttagaagaatagagagatgtactctattcacatataacgagtccaaattataaagttattaattttccccattctaattctatatgttcaatgtaattccaaactcctgctagggttttctgtgtggaatctgacagattgataattataaaatgtataaagaagatcaaagagccaagtacaaccaaggcaactttcaagaaccgcctaaggtgggaaagtacttgccctactgttagaggaaaggagtcccgatccagaccccaagagagggttcttggatctcacacaagaaagaattcaggtgagtccgtaaagtgaaaacaagtttattaggaaagtaaaggaataaaagaacggctactctatagacagagcagccccaagggctgctggttgcccatttttatggttacttcttgaatatatgctaaacaaggggtggattattcatgcctaccctttttacaccatgtagggtaacttcctgatgttgctatggcatctgtaaattgtcatggtgctggtgggagtgtagtagtgaggaccaccagaagtcactcttgtgaccatcttggttttggtgggatttagcggcttctttactgcaacctgttttatcagcaaggtctttatgacctgtatcttgtgctgtctcctgtctcatcctgtgacttagaatgctttaaccgtctgggaatgcagcccagtaaatctcagcctcattttacccagcctctattcaagatggagttgctctggttcacacgtctctgacaataccagctttcaagatttgttatacaattatagtaactaagacaggtttctacacagggagaggtaaacagaccaagggaaaataagagagaaacaaatccacacatatatggaaacctggcatttgacagacatggtattatagatcagtatggaaaggatgaaacacccaatatatggtgctgagacaactggtaatccacattgaaaataacaaagcaatctctacttcttgccacatccaaaaactaaatttcagaataaaagactcaaatgtaaaaagcaaactttaaaactttaaaaaaaatatgggagaacatctttatgacctggaaaaaaaagggttttttaaaacaagacattaaaataaaagaaaccataaaagactgataaaatgactacattaaaattatgagcgagaagcagaaaataaaaggtaaaattactgacaagaagacatttccagtgtatattaccatcaaaggactaataacagaatacacaaagaactcctacaaatcaacaatcttctctccaaacaactattttcaaaagtatgaaaagcctccatttttgttttcattttgaaaaatgaattatttaggctcactgaaaatattcttttccttattgtaatttctaacacagaattctaacactgattttgaatagtattagaactattgaaaacaatttaatgattaatacatttgaactgtttttatgattataaaataatgtgtaactatgaattttgtaaagatatcaaaatacacatttgaaatatttaattaaaatgttaaaattaaaaagaaacaaatgtaaagagcataaaaatcattaaaaatccctcatgcatcacacacacacattttgtcaatattttggattttttctttactttgtttctattaataaatacatatacatagatgcacaacaagctgggtccaaagtgagggtggcttattcaagtgatgacatccatcagtcagtagatgatgcaagctaatgcttaggaaagaggtgaggtctggggatgttgacttgggaggtcatgcttagagcaataaaagttaagactcagtcttggatgaagagattgtaggaagaaaataagagtgaggacacaatattagaataaggagcagaataatatgttgggaaaaataacttgaaaaaagagaaagtacaattagataggtaggaggagaatcaggatattgtggaagaatgtcaagaagaagataacattcaactgccaatcctgaaaagaagttaaggagaatgaatcctaagaaaaggccaacatatttaacaattgagagagacggctgtggagtaaacgtctgattacaggaatgcaaagaaaacagattgaagggatagggatatgtgcatatttacaccacacagtcaacaaatctggccagaaagaaaggtggcaaatcaagctttttttcaagatattagagatctgttatctgtctaccttctctgggcgagaagcccagtatactgaaagactaaagatgctgggaagagagaagtaaacaaaaacacaaatgcctgaaagcagagggagaggatggactttaaaagagttctggatcatgacttgtcatctgacacaggagaaaagaaccggggtcacaacagacatagttcaagctgaagaggacaggagaaacctctggctaggtaaacttagtaattttagtaccaaggtacgtcacgggacaaaactcaacttaaatcaagaagcatccacactaaactatacctaagggcttataagagacgaaaaaaaatccctcattatgtctttgcttcaactcacccatgacatgagaaccaatactggtatttgggtgaagcttcaaaacaactgaaactatggggaatgtttcaaaccagttaagcactgacataaatgactgagaaactccggtttccttaaaataagcaaaatattcatttgttttgatattattttttgatgatacaagtgtccatctgtagtagctagtcaataaatattggttcatgctacctgtactgaatgtttctgtgctacatggtcaattgcataattgccagtttaaggtacagcattaagagcaaaacaattcacggtgaaataccccacccatgttttcctacacatctgtgattcaacaaggaatgtaatgattcacagtattggcattaagtttatattgaggttgcccttttgtaactgagaagtagggctgggttgtcactgtgatcttcccaatcccttccacatccaaaccctcacttcccttctcagccccactttgaatgacgccaagttaaaacactaatgtagacatcctctgtcataaagccaacaaaccagagaaacaagaatgcttattgacctccttccttaactacttcttaaaaagggatctaaaatttatgagtaataaaattctaaaaagaacatttaccttctatgtgtatgcataactaaagcctacaactgaaatatttggaacttctaaagtagttttcaacttcaaatacaaacttatattagagacaaaagccattagctttgctatgagtagtgtgaagggttgatgtgacttgaggaagcaaagtttgcaaagattttcatttgactgtagatttacaaaatgtttaacaatttcagttcctgaaatagtcaatataggttaaaataaattagtaagttaaatgtggaagtctttaaggtaataacaaagcaaggccatcagagggaaactgagaattatctctctcaaatatctggagagtgactgtcaaaatcaagtcacaaagaaattactacattcacattattccgtgttccacagatgtttcttctattgctcacatgaactcttttctctttgctttcacactcaccagtaacacttgtagatctcctaggtcatttgaacatttagcattcaactctttgatcagttcaaactgcctccacagaacatctttttctttcaagcgttccttattctcaaaatgttccttgaatttcaaccaaatttaaattccttacatttaccttctaaactttgtattcacctcctctgttccaataaacaggaacaactctctaagcccttgtgtcttgtagcaaccattgccaggcattttcttaaaattcttacacctcccttgaggtgctggtagctttagaaatgtcgccggagcagcatgaaattagccatgactaggacaggacagtcaggaattgctgaagactctcatgcctgcttcaccacctatggtcattacaaaggacttcaaaattcctggcttttccagtcctggaatgaccctgatccctgccccattcctatagcacaatcccaaaaccatacatggtctttctcaccacagttcccctgccaatctcttaaatgctcacatctaatgcttaggccaaggctcttgtgttgcacaagaggtcccctacacccccgttcctgctgacttcacctccttgcatcaacaatctggtctcctgggccatcatttcaatcaccctctcacctttaatcacaactatttccttcctttgtctttctccacataccacccttcaaaaccagcagtgccagctctccactgccacccccaggcagatgtgctttgctggagagagtgacaccagactggccctggtacagtcctcaacatgttcctagccagggttccctctccttttctggtcctcagcagcaatcctacatcatcacctctctgtagcatccccaccttctccctcttcctcaactggcaatctcaatgcccactcagggaatgaaactacctcccaaccccaaactggtctctatatgagttccctcctcgctgggggtttcctccctcctatgcgctagagtccatccatctgtcccatccctacagcaccagggccctccattctccctttccctctggtatcttcgaagactctccacagccatctaaagatactcaacactctcccacttaaaaaaaatggcacatgttaaaaattaaagacttctatagagaacattaacacgccactaaatactgaatagagtcgtccagtcagtcttcatcatctagctcctctatgttgccagcacctgtcagtgcctgccttccccggtccagcctgttgtagacattgtgctcattccttgtttcttgtttcttcagccccagaaccttcctaagccatcctgaccaagcctttgggcttcctgtgtctgcatctacagggccacccgccggctctccaaactgaggctttcttccccacatctgcagttctgattgctcaactcttggcttggtttcagattagtactccaggtgctgcagtctgactaaactcccacttactgcactcatgtccaatcagtgtcctgacaagacaccagctccttttccctgggggtacaaaccttatctcaatcccgcaaattattaggggtccccgtgctcccaaattcatgtcactaccactaactagtggaatgaagtactgttattgcttacagaccgctctactgggttcataagatccaccttgggtttatcaagttcccttagaaaatatatttagaacgctggcagcccagtggagtccagctacacagctcggcgcgtttaccctgggatcccttgtttcttgtttcctttcatttccttctccaaccaatttcccatcatacctatgggcaaacacccatgttataacaagcaattcattaactacttattttaagttatggtgaagtgttataaccataatatttataagtgttatgaaatttataagttctgaaatttacacaattctttcagtggttagcaaaccatactactattatagactctattatatttcataaccacatattatacacaacatgagaagatctctgtttaagagtcccacctatggtatttgtaaaaccattcaatcaggcaaaaacaaattaaaaaagtaatatcagatagtaatacactagaaaaccaaaccttgaacaaacatttggggatccccaggcttacaaatgtattggtttctattgggtaaagtcttggctttctcattttatatcatttaaacaaaggaactgaaaattatattttaaaataaaaaccataatctaaaactaatctaagaaaatactgagaaaaaatagcagtaaatttatatattttatcttctgtaatgaaaactaaggggaaaaaggcatgctaaaagcaactagttctaaagtaacttcatgaatgtaccacacagaatacttaacagctttaaaaagcagttatgaaatgcccatttgaacatcagatgccacggacagaacaagtatccaacctaaagcagacaacacggacccactcaaagatatgcagtgacatgcagagtcgtacttcacacaatcctcatttggagaatgagtcaagaagggcagcagcgcgaccctccaggcttttccaaaatgaccctcctgataactgaggagctccagctgggctgttcttttgccctggttcaaaatatacctagatgtggaaaagtacaaaggcaagcatttcccatccactagaaaagaagttcaattatcaaatgctaaatctaggttacactaaaaaaaattagatgaattaaaatgtggcctgcctcaaagcaagagcatgtcttaccaatcttactgtatctcacttaacatactcaagaggaaaagaaattgaagcatttaagtagtccatcttcaacattctgctgtgaatacaggacctgtaatatgcttgttctacttgacatataaaaagaatcacatttatgtggaagcctaaggttaaaacaggtttttaaaatgtaaacagcagtaacatgaatgtattgaattacgtaaatcccaaaacttttcatgccacaatggtatgggaaggtcggtgactgactcacctaaataaaatgcagtaagtcaaagtatatagttagagcaaaaggaaaaagataaaaacattttaaaaactaatttatggttttaattctctataataaatcttttaaaaattaatacacagtagaaaatggagaaacaaagttaataaatgcttacaaagatggcttatgttatattaaacatgaaaatgatatcaaagcataattatgaaatcgtcaaaaatcacgtttgtagtacaagtttacagctagttttaaacaaagaattttgaccaattacttgcagaaagtaaacaagaaaaaaagcttgacttctttctgacagcacggaagtccttataaaacagagcactatgtcattcgactaccaccccccagttatcacagttcttggtatataaatcaccttcgaataagcacagggtgtctgaaatttccactctgccctaagtaacaccattcaaaatatcaattgcttccagcaattcgaacaatgaaaataactttaaattggaaagattatcccactttcatctccacattaaagtccatccatcataaatttaagtagagttatggtgggcaagacgtagcaagaatgaaataaagtattttaaccacaagagacccaaacaggacttggcaacgcttcctaactgcacacgctagaaagccctgcccccatgtggctgaaagtcttgcacagctggccagcttgccctggggcataagggagaaggttcatccccgaaattgccatgttaaatgcccacttctggctgttggaagatttaggataccatctactaagcagaaaggatacctttttcccaggctcagtgtcttggacaatgtgaacacacaactaataactgctggattatggagacaacagcttgtgtctgcataatgccttatgtaaggttccctcccacggatgcagcaaacacggaacattcaagttctgagatgatgctgaggctcaatttaaatggcatctttcctgctctcaactctactttcctggtaatgcttcatgacatacgatcttttagtcattattcctaaataatagtgccctgtcagtactgggggcaaaggacgcatcttggcacttggagcttttgctattctctctccacctggtacacactctgcagtctgtgaccctccatttccacctccagctgcctggagtctctctgcgaatgcttcaattccctctggttcacagcccaaaccagagcctacacctgatttaccattagccatttcccaagcctgtactctgctccccaacccctagcacaggctcagtgactctgaaggtgaaagctggcagcaatgctggtgagtcataagagaaggcaaggaaaaataccacccagctacacaccatgtgctatggtcagaatgtctgcatcctccaaaattcatttgttgaaatcctaaccacaaaagtgatggtattaggaggtggggcctttgggaggtgattaggtgctgggctggagccctcatgaatgggattagtgcccttacaaaaaaggcctaagagagcttgtttgccctttcaccatgtgaggactcaatgagatgatgtctgtctaccaggaagtgggcctccccagacaccaaatctgcgatggcctgatcttggtcatcccagactccagaaccatgagaaataaacttctgttgtttataaccccccaaccccccagtttatgatattatgttatagcaggcaaaaagcattaagacaccatgcacttgaataacaaactctggaaatagagccactgtcaagcctattagtgactctcattgtgagacttccagaataagcaggccgtaagatattctgggggaagactgggtggggtttatgacagcatccaagtcaggttcggaggaatgggccttcctctaacctacaaagtcataactagaaagaacttaactatagcattcacttctccacctgccataggaaagaaaagagtaaatcataggggagacaaagtgattcctttcctcttggtttataaagcctgcccagagccagcacacagagcgtgtgcccatgtcacaggtggccctccccttctgcaccaggtacacagtcaggcctcacgaaacattagctactacaaaatgtaggacttacccaaaaaagaacatgtgtagagatagaaaacaacatattctgaaatgtccatttttcattctaatgctcagcagtcatataataaccagatgaactaagctgctttcatttagacttttgggaacagaatggtatctgtttcaagacaaatacaaccaattttctatctatacttgaaattacgtgtgtgtgcatacagacagattcactatgttatttatatgttcctcagggatgatttactgttccataacaaacgtggtgatcaaatgattctaatcactgactgaaaagtaatgaaataatctaagatcatctctgaaaagctgaagcagatccatattagataaaaaagaatgacttccataaatcgactcattcaacacacaggaaagcattctatctttatatttctgtatttttcaacctcctctggcctgcttgccaccccactgcccatggcctatgtcaccaatcacctccaagtgacccccaccctcgcccctgccccgatgaccaccataaccacagcacccagagatgagtccactgcactgtgccactttcacagatgggggaggaagagagctgtaactgtcagaaatacatgaaaactgtcaaaaatacatgccatcagctctggagattttgaagcactgatgtctctctgttctgtgaatgtattaaaaaaaaattacattatccctcctttcaaggttagcaaaaataaaagatgaactctacttccacctctgcaaatgacctcctacgaccgcaggcaggcccacgctgcctttgccttccccacctgcttgaggccacacacatctccgtggaccactcctcccttccagaaactcccctgttcgcttcttcagcctctacccaggagtttcctttgctggcccctcgccttctgactgcctatgcactggtgaggttccctggccctgccttagtcctctctctgttcacaaaaccatcctagcagtaaaatcctttttcccaaataaaatggtctgtgctcctcaccctccagtagaacagataaaagcagagctactctggctgaaggggggaaggaggcttgaggccaccctcatggggcatctctacagacctctagggttgggaaccaccagcagtttccttcaaccagctggtgtgagctccatctccggtcccccctctgccccctcaacacctccccactttttgcccaacaaagtcatatgagtccttccagatccagtttcccagccaccttgtttgtgattctttatgtacaaagtagctttgagcacttcgttatcccccaaggcactctgcaccgcctccaccattgtacacgtatcacgtgtttgtttacatttttgccggctccactagattgtgaccattttaaaggcagacaagatgatgacaatggcgtgcatgcgtgtatgtgtttgcatgtgatgggacaggggagtctcagatgaacctaaagttaggcttaaactgctctgggtgtgaggctggtgcactggtctgcatgaagaggccgtgaggagggaagcgactggagaaatggggaggagaggtggctgcggtctccatgcccgcccaccagagctgcgtctcagccctagacagagagggtcaagcaaaatccaggaactgctttcatgagagacttcacaaaatatttgttaaaccagaatactgaacgcataatattctcttctttgaaataacattttctctattcttttcattaagacccaaatttctaaaaggcctatattttcttctcagttctgatgaataaaattctgcctaaagtcagagtcaataagctcccgaactagcagttgctaatgaaaagaaactctgaagagatgagagatgatggcacaggtcaactggaatggagacaaaatactgagctgcaaaaccgatccagaaagcccactaggtggagatgaaggccggtaccactcacaagaatggagtctttgcagcctttgtacttacaaccattttttaaaacaagagttcttgcaaggttgtctagaagactcctttagaaatatctgaacattcacagtttaatcaagaaagtatccattaagggcaaaaatctcctaccaattagttgtcaattggcaaactgcattcagactggcctctggaactcccaaagttataaaaatagctggattcctttttctgcaaaagagcctcaagtctctctgactcctctccgtttggaagattaataacggtgataattctggaagactcctttaccacacagcggtgcgtacctccgcagagggctggcagtgggccacagcacactctgatgtcccgtgcagttcactgacacccaggttagcaacacaggctgtatgctcagtgaactggggctggcaagggcaggcccggggggacctgcaagggaggggacttgttcataagcacctataagaaccaactcccaagtcatttttcttttcttccttttttttaagtgaatactctctgtattttggttaatcaacaatctttagcacccattatggacaaaacaatatgctgcacacataccaaggatacaagaaggaacaaactaccctggcctgtgctctgatggagcgcactttctcctggagacagatgaaagaataaataaaataactgcaagctgtgataagacactggtgaaaccaagaccaccagctcaccaagtaacactagaagatcgccacaagggattttatatgtgtaagagagagagcgggtgggcatcctcttttgacataaaagatgatggagaaggtcttttttaaaacatgcattcagtcaaatccatgaatttagctaatccttctttccctaagtgtgcaattagggaaaacctaatgactactttacaagttatagttttggcttcttttgctatttattaaaaacacagccaggcacagtggctcacgcctgtaatcccagcactttgggaggccgaggcgggtggatcatgaggtcaggagtttgagactagcctggccaacatggtgaaacctcgtctctactgaaaacacaaaaattagctgggcatggtggcgtgcgcctgtaatctcagctactcaggaggctgaggcaggagaattgctggaactgggaggtggatgttgcagtgagctgagattgtgccactgcattccagcccaggctgacaacagtgagactccatctcaaaaaaaaaaaaaaaaaaaaaaaaaggcaatattttcaggccaagcatggtggcttatgcctgtaatcctagcactttgggaggccaaggtgggcagatcatctgaggtcaggagtttgagaccagcctggccaaaatggtgaaaccccgtctctactaaaaatacaaaaattactgggtatggtggcgcgcgcctgtagtcctagctactcaggaggctgagggaggagaattgcttgaacccagcaggcagaggttgcagtgagccaagattgtgccactgcactccagcctaggtgacggagcgagactccatctaaaacaaaacacacacacaaaactaaataagactaaacaaaaattttctacctgttaaggtacttaaaggaaatattttgtatgtaaaaattaaaaatcgttagaaaacaggtacttgactttaaatttatttatttatttatttatttattttatttatttttgagacagagtcttgctcagttgcctaggctggagtgcagtggtgcaatcttggctcactgcaagctccgcctcccgggttcatgccactctcctgcctctgcctcccgactagctgggattacaggcgcccgccaccacacccggctaatttttttttgtatttttagtagagacggggtttcaccatgttacccaggatggtctcgacctcctgacctcgtgatccacccgccttggcctcccaaagtgctgggattacaggcgtgagccaccgcgcccggccttgactttttagtatcacaattttgacctagtgaatactgtgaccagcttttgttggtggggggacggggacgggggcaccaaggaatttatgaccctatgtttataaatacagatatctgaattggaattacaccaacactggcaacatcttattgacaaaatattttaatttcataaagccaatataatcccttgttcaattttctctaaagtacacgaaacagctaattttttccttcttcaactgatcttttcctgcaattattttcactgagataaggcttttctaagtaaattttaaatcaatcggattttacctacttcaaatatttaccaattatagcttctgtcattatgaattctctctactggcaactgctttttgtttattttataaagtccaataacctggatcaaagtctgaagattttaaatctgtcatgaatatttcattcttttgttgatctgaattcaaaaacaaattttactgtattaaatatcagcaaatgtcaattttaattttacttcttctgtcagcttttcaactgtatgaggtttgactatgccacttaacccagtgtctgtcttgttttatgttgactatttctaccaggaattgtcattatgaaatattctacaggactggtctactttaataaaaatccaaccctcccacatacttgtacacttgtgatcacttgggatctcatactaaccttcctcactggtgagtaactcccctctggtgtttcaagtatatggtcacggagacaagggccaggtcaaaatgtccccaagaccaaaaggtctaggccctaacactggagccaaatgttcagtgcatgtgtagacaacgtgtagcacaagtatgtgcctaagtaggaattatgttagctaggagaatctggaaaaagtaagaacttttattctaagaatcaccagctgatattcttttcactaatttccaaagagaaagacatagccaagtcagttggtgagatttcaacaagtacttatcgagaagctgaaactgccctacaaacttcattacttcaaaccattccatttgagataagagctcctctactctctctcactaaaacctcacttgccaagaattcccccaaagccacatggaggcccatggcagcacgaaacccaatgcccaggatactgggcactggtgggcagaggaggatcagtgtgcttgggagactacttacactgagccaagagtaagtttgacagcaacaaatgaagggatgaggacagggaaagctaggtttctcactactggaacacagaaagggaggaaagctagaaagaactatgaggcaaggaacggaaataggagtaccagtgagaacttaaggctattaaacacacacacacacacacacacacgcacacacacagaaggacacaggttacagatgataatgtatatgtgcttgcatgttcatttatattcactgtatcttttctgctgtctgctgagagggcctggaagaaatgtacagtacatcaaagaaataagcacactgaaccccctacatcacggtttctaaatactccatcaaagggaaccagagcctccttgaagaaaaggcttattccaggactggggcaacaaaagtataaactaaacctggaacacaatatgcagaaaacaaggaagtgttcaaagattgaaagggacatgtcacaacatcaggagagccaggctgaaggagctcccactgtctaaatcacaggtctccacgagttgacactgttacaaagaaatgaatgacaatgcaaattaatagacaagagaaagctttttactacagtggaatgccaactaataaatgcagaatgaatgaaaggaatatgaaatcactatttggcaatcagcatagacgtggctgatttgggcaggagtcatccgtggaggccagggctagtggatgaaagtctgatgagagacactggtgtaatcttgaaacatctcaccacaaaatactaatgaattaccaagaggaccacatggtgaattaagtgtgagagaatctggcagacgcaacatgcccaggccagcaaggttaacctcagggcatgcgccctgatgcgaggctctgagaagcacagcatcatttccgtggtatttcttcccaggatgcatggcctgaatctgctcatgaagaaacactcgatggacccaggctgaaaattctttaaatttgtcaaggccatgaaggacagggaaaggccgatttctgtttccattttcagtgcccctttcatggcctaactgccagcaaggccatttattcacttaatcatatctattcattcatttgacaaatatttatactgagctgcaccaaacccttaacattatgccaggtattataaagcaatctaattttatggcacataagctgtcagaaattggggaagcaatatgaacacacaaattctaacataagggatcctgtaaggttgcacagtaaaacaagacttcctgaatgagggataattcggggagcaatttgtcctagatagacaagttttcataagtctaactaaaaatgctactgcaggcactaaatctttttgtattttaaccatttggctgcatttttttgttgttctaaaatatattactcactttcctgccttcgtaaactgaacacaatgtggtcattattttatgcaaattttagttgtataaatctaaatcatgcaacataaaatattaataaagtctcacttcatgaacacacctgaaattatgcaaatgtcccaaattaaaactaagcacctagaattacataattttaaactggcaggctgagtgaattaacctgtgtgtctattactggtccatggcaaaccgatttatctgaaaacagaaataagccaccatacttgtagcttattgagagtcctatgggaaaaatagtctcagaatcataggaattttgaattatgcagacacctcagatacgtatctctgaaaatgccatgacagcaactataatttaacctatttatgagttggcttctactgtggcattaattttctggtctgtgagttaaagacttgctgggaggtctggcggagcagaccctgctagttacctacaaagtacccgtttcctccttcttccttactagcagaacccattttcatccctaggagcctgtgccaccaaaactccccattttccaccctcccttagaacagaaaatggcaatgtgatgcaattcttgccaaggagatgtagagagatgtccctggggagggcatctcccctgaaactaaagggcaaagcttcactaggagaaagttttctgaccctttactctgccccattatttttgttagaaatacagcatgtgagggcagagtcacagcagccacctagagactggacgaatgagggctgaggcctataaaacgagggcagcctggaacagtgcggaaggctggtctctgggaacatcacagcacagctgtgccaaccctgggctgccttcccccacactccttgctacaagagaaaaatgctcctgttactttactttaaatgacaatcatttgggtgggcacggtggctcacacctgtaatcccagcactttgggaggccaaggtgggcggatcacgaggtcaagagatcaagaccatcctggacaacatggtaaaaccccatctctactaaaaagacaagaattagctgggcatggtggtgcccgcctgtagtcccagtcactcctgctgaggcaggagaatcgcttgaacccagcaggcggaggttgcagtgaggcgagatcgtgccatcacactccagcctggcaacagagcaacactccatcacaaaaaaaaaaaaaaaaagacaatcattcaatcaaccaaaggcactgagtgatatttgaggattatttatttgctcctgtcctaaacagtcttaccttattaataccatgtcttttatcttttatattcttatggccattatttatggagtctcagacttttcctttggtcaaagaacccagctaagaaaatcaatacatgacattcaccaggccagagcctggtccagcataaggtccagtgagacagaaatgagaagtaggaaagagaactttaggggaagttttctatgcttgaaagagagccacagaaagagacactgcccctggcctttatccttgtggacgtgaggcctgaactgctgcccatggcatggcacaagcctaccgaggaagcctacgcagaggaggggagatgcaaagtatcccaggaaaatggaaccagacccacaggattcaattagccctgaagaacatcctactgcagaacttctagtatataacttaatatctttattatttagaccagtttgagttagtgttctgttatttgcaaacaggaacatttcaacgacctcagaacgtgaaagactcagcccactgtaagaagagaagaaggctcaatcactctctacctccacatctactactaataacacctccaccaccacctcctcctcttccaactccaccaccaccaccccctccaccacctctaccatcacaacctactccttcaccaccacctccaccacttctaccctcacaaacacccaccaccatcacctccgccacctccaccaccacctctaccaccacaacctactccttcaccaccacctccaccacttccacctctacaaccaccacctccacctccaccttcaccacctccactactacctccaccaccaccacctccatcacctccaccaccagcacctccaccaccaccacctccactttcaccaccactacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctctacctccacaaccaccacctccacctccaccttcaccaccacttccaccaccaccacctccacaaccaccacctccacctccacaaccaccacctccacctccaccaccaccacctccaccaccaccacctccacaaccaccacctccacttccacaaccaccacctccacctccacaaccaccacctccaccttcaccaccaccacctccacctccaccacctccaccaccaccacctccacctccacaaccaccacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctccacaaccaccacctccacctccacaaccaccacctccacctccacaaccaccacctccacctccaccttcaccaccaccaccacctccacaaccaccaccaccacctccaccacaaccatcttcaccaccacctccaccaccaccacctccacaaccaccacctccacctccaccttcaccaccacctccaccaccaccacctccaccaccaccacctccaccaccaccatcttcaccaccacctccaccaccaccacctccacaaccaccacctccaccaccaccacaaccaccacctccaccaccaccacaaccactacctccacctccaccaccaccaccacttccatctccacctttaccaccgctacctccaccaccaccacctccttcactaccacctctatgaccaccacctccacttccaccttcaccaccgctacctccaccaccaccacctccttcaccaccacttcctgtgccaccaccaccacctccattaccactactaccaccacctctacctccaccaccataaccaccaccacttctaccaccataagtacaccatcatcaccaccacctcctcttccaccaccaactccacctccaccatgacctccacctccaccactaccactacttctaccaccataaccactcaatcatcaccgtgtgcccagagcagaggagcccacgatgctccctgcagtttcttccaggctctcgtactggtgatgggagaactggtgataagagtgggagtgagaacgggggaaggggccagtcccttccacagaactgggaagcccagaagtggtgtccatgtccctccatggactttctttctaccgtgttctcaccatttcatgcccagctcccttctcaccagccaggcgcccatggtggagaaaaacttaggatgtgtttaaagtcaaaaggcagttttgtgtcaaaacaggtccctgaggcctctcagggtcccaccagtctcatagtaggaagtctcgaggttacattctgtaaccccatatccttatctgtaaaatgaggctgatggtaatagctgtatctatttgacaaagttgttatgaggaggaaatagctaatgtaattaaagtgcctagaacagtgcgtggcatttagtgagtgccacacatagaatcatttgttaaataagttaaattgatcaattacatgcatcaattacatcaattacatgaggggttgagggaggaggagaaatttttcatcttcgatatcttcacagggttacagatatttcctgttagtctgcatggatactctttttttcttttcctttttttttgagatggagtcttgctctgtcacccaggctggagtgcaatggcatgatttcggctcactgcaacctctgcctcctgggttcgagtgattcttctgcctcagcctcccaagtagctgggattataggtgcccgctaccatgcccagctaatttttggatttttagtagagacagggttttaccaggttgaccaggctggtctcgaactcctgacctcagaagatccacccgcctcggcctcccaaagtgctgggattacaggcatgaacctccgtgcctggccagatgcttttttatatcaggagaaagaagtgtcttttcaaatcgaaaaaaaatcactgctattaaaaaaacaaaacaattattcaaggagcagtgacatgtgatttattaacccaaaaatgtactcaaatgtaacattccaaataatatcttctcacatatttccccctctaatgacaaaaactcctctaaagtttttgaaacatgtatcccttttgcctaatgattatcagtgatgactgaatcccctgtcactcaaggttaagggaacatcaccataaactgttaattggatcattgtttctattcactgcacaaaactttttgtagtatttttctgttggcagagagataagcagcaatctagatttacacccacaaagcaggaaataaactgcctaagtttatgttctagaataccttcctcccaaacagaatgaacttcacccaactggctccattcccctattttaggaaggaggtttaataaaagaagctgcaaaatttcaagcaatttgttaaatttttaaattatcacttaaacttctttgactatacacttagaatccaacaccagagtgaaatggaacagctaggaatgtaaacatcattcactaaatctaaagacaaaaggtcacttttctttttcatattgattgttatatgtctatcacccccagggggaaaaaaaagaacctgccatctggtttatgtaccattttactcattacaacattgaagaagggctcaggttttctaggcaaaacacatacacagaacagaattgttgagtccaggctatgcctaagagaattttaccaagcatctctgggacactgcctcaaggaaccagggagactggatggattccaatccctgtcagtaaactaggatgccaatcaattatcctgcagggttacaaaatgaactagaatgcccatcccatttaatccccacagagaaagctgaaacaatcacttctccccaggagtgaaatggcatcattctgatgatgcccgggaccaaagccaacaggctcagctggaacctgaggcctctcagccagaaactgggaccaggaaactacagcaagtggatctcttgctccacttgctatgtttttctaaaagcaataaaagttgtatttttccttagacaaatttggaaaaattaaaagtaaaatataaaaataaaaatagaaatattattctgttagttatacaaatttgatatgtatatatgccaggagattattaactaagtctaagctttcctatttcaaggttctgtatttactttggcagtcatagggagtcatacatttaatcagaatttttaaataaatttgtaaaatagtgtgtaaagttttcagagttgtttgaactgtaagaacatttacaaagtggtatctatggtggctaaggtacttcctaaaggaaataaagatttctattcctatgtaattagaagtcattacagatcctttaccaaataccttcccttcagacttctgtggctaaggttttaaattggttctacatgattatattacaaagtcaacttccttagaaaaacaattctgaatacctttcatcttctaagaaacccttttcgaatccatgtttttttcaaatgtgtagcccccctcttccttctttcataaaagaagacagatttttttttttttttttttgcaacggagtctcgctctgtcgtccagactggagtgcggtggcaccatcttggctcactgcaacctccacctcccgagttcaagccattctcctgcctcaggctcccgagtagctgtgattacaggcacctgccaccacgcccagctaatttttgtctttttaatagagacggggttgtgccatgttggccaggctggtctcaaactcctgacctcaggtgatccacccaccttggcctcccaaagtgctgggattacagacgtgagccaccatgcctggccaaaaagacagaatttttaaagtgtagggaaaaaaatgtttttagccccatgccagaaatgctatatgcccctacatattttgggtattacagtattaattgccatatcttatggtagaaagtgggaggagccaagctgttaagctcttcttatttattttttttattgcttggaaaatcagttattgcttttctaaaaatgaaacatgcgcattgtgaaaatttctaacaatctaaaaacatgcagagtaagatacaggaaatgtaaattgttgctccaccacgcatgacctcaaaaacctgagtaagaaaatgaacacaagttgcaaaaaactcaaatgaattgcagaaattagacttcattaatacattcccattgctgaggaatgaaatgtcagcataccaaagtccatggcttttcaatgcactcttcagaagtagaaaaccaaaatttaaaacaacatcgtccatgaagccaagggaaccattacaccagaacatacagctcctccctggaataagccttctgtgaacctcaacttttcctctcttttaacatcaatgttaaaatgcctcccttcagggatactaagacatttcacttttgagacagagtcaaatagaaaaaccatcaaaaagaaagaaattaattctgcacctgggtagcattattttttccctgcttggagtgtgtactaacttcaaccagatcaattctttcatgaaatgagggagaaaataaactctccataattttaaaacatatttattatgataaaaacatggctctatttgtcatttctatttgtggaaaactgaaggccatctttttctctgtaaagctttttgtctgctacattctagaaacattataacctctccaccaaccagaatgattctgtttatgcaaataaatatattttatgacatgtaaaattaattagttatatgattatgcttcagtaatgacaatgttttgcacaatagaaaaaaagctgataaaatttaaatttccatttttatattccaacaaataatttaaatttgtttcttgattaattcaatgtttcacttttgaaaagcaattcacttcattttgaagtacatttatattttctttagtcaccttaactgttagttctactcagcaagaatttactgtctttttattctttttctgttcttggttaaatgtcttctggtaggtcacattttacctatttatgtcttgtgtcataaaagcattcaagaacattttaaggtaaaatgcttgaataaaattattttagtaaaaatgtaaaaatacatgtaaaataaatgtaaacaaattaaaataaatgtaaaaaaaatagagtattggccgggcacggtggctcacgcctgtaatcccagcaatttaggaggccgaggcgggtggatcacaaggtcagtagtttgagaccagcctggccaagatggtgaaaccctgtctctactaaaaatacaaaaaattacccaggcgtggtggcgggcgcctgtaatcccagctactcaggaggctgaggcaggagaattgcttgaacccgggaagcagaggttgcagtgagccgagatcgtgccactgcactctagcctgggcaacagagcaagactccatctcagaaaaaaaaaaataataataatagagtattcacatttactgagcttttattttcagtagttatagataagagatgaaaaagacagaatttagtttcatactttgatgtcattttttgaaacaatggccgatggtacctttatcattcaaaatttttcaaaactcaaaggacagaaatgaacatatcaggtctaccaaataacctaaacattcattaatttgccattgaaccttatgatacaccaattgaaataaaacctttttacagcaaagaaaattctagtatttgctttatggcattacagtatcttttttattcaagtggggcctgaaagtgccagtgttcctccaaaaacatgcatgaatttaccacatttccatatgagaaataagaacctgtcacttggccttgaaaaaaatatgaccattaatgtaatcacttagaataaaaagaaagtgccaggagttcaagaccagccagggcaacatagtgagaccccatatctacaaaatattaaaaaactagccaggcatagtggcacacgcctatagtcccaactacttgggaggctgatgtgggaggatcacatgagcccaggtgttcaaggctgcagtgagccatgattgcaccactgcactccagtcagggcaacagaaggagaccctggctctttaaaaaaaaaaaaaaaaaaaaaaaaaaaaaagaatagaaagaaagcaccatcattaactgaattgggatccgtactaataatatcagagtaattattgtctggcactaccaggaagctgggtgtttggggttaatcagacacttaagtctctacttatattaacatgtggatttgtgattttataagatattcacattaatactctatcgaacttaaatcaatttttcttgtagaggtcaggaagcatttctctatcttcatatttggatcagaatcatcattatgaaccattttaccaatgttatcatatccatgctagttaagaaaacattctggttggtaaactgttgggtgaaccatttctaaaattaaaaaatgcctgccacaaaataagtctgctgcatttttatgaaaataataaaataaaaactttcatactctttggaaaaatgagaaaagcattgatcagtccacttacagtgagctcacagaaatccatgctatcaaggcttttgcttctgtgtaatctccctttaattcgtcttaaagagggttttccttggctgacactagaagtagcaccattaggattttcagaggatggcgttaccctgcaagaaagaaaaaaattcttaaaaaggcaggtttacaggtgaacacatttctcaagtttgaggtaagcatttactcaaaggcagctttggaaatgtcacactcctttttccagccaaaaagctaagaaccacagcagagctacattctatcagataccctttctaactatttcttagctagttaagacatcttgacaggattcaaatagtacaacattaagatttattagactgtgggtggtggctcacaccttgtaatctcagtactttcagtggccaaggcaggaggatcacttgagcccaggggttcgagcccagcctgggcaatacagggagaccctgcctctacatatacacacacgaataaaaaaattagcctgtcctggtggtgcatgtctgtggtcccagctgcttggaaggctgaggtgggaggattgcttgagcctgggaggtcaaggctacagtgagccaccactgcactccagcctgagagataagagtaagaccctgtctcatttataaggtttttttttaaaaaaagattcattaaatatcaattctacaactattgaagaagccattaatattagactgaagttttctaggtaacttaggggcatctgcttccttctgggcagttatttattcaacactcagtccggtgcctagcacacccagtacaagtgagctatcattgtgtccatcacagatactgttcagcatggttttgttaagcatgaaaataacataaatctaaacatgatagcacacacttaattcagcataattatggaaacatgaaaacacagacaacaagaagtagcaaatagtataagccatctataaagtgcacactggaatacatgttcatacatatacatacagacacagtaaatatcataaaatagactagatatggctacagtttagaataaaagtaatacatccatagagttaaaacatttgaagggtataaaaagatataaaaatggaaagtaaaagctgcccttttctccctcatcccaaactccccttttccaaaatcaaccactattaacagttgtttgtattgtataatctcccagacaaatgctcatgcttatatacagatgtgtttatttccttttcaatttttttaccaaattgtgtgtattgtcctgcaccttacatttttcacttaatatatcttaacgttcttcccataataatccatacagaactatttcactctttttaatggctaaatggtatcccataacatagatgtaatataatttgttcaactattcccctactaatgggcatttagtttgttttcctatgtttgttaccaaaccatacagcaatgaacatccttggcaacatctttgggtacaaatgcattatttagttaggaaagattgctcaaagtagaaaggcagagtcagagatgggagtttcctacatgctgataggtaatacctttccaaaaagctttacaaatttacacttccatcaacagtatatgagaatacccatttgggggagtccttaaatacaagggcaactttatcactttattatttttatcactcaacttctccatgtccttcattatatttttgtctgttgaactgctgattctgtataaaggactattgtaggatttcccaccttgaacatggacttgtcaattaatctatgtcttttagtttttgctttttatatttcaattgttttttattagatgtcttgatgtttatgacacatatcttcttagggatttaatcttttatcatataaaaagactatgccaattaaatattttaccttaaatgccattttgtctgatgataattttcccatctacatttttatattaaccatttcctgatttatcttgtgtttgtattttcaagtgttcgaagtctctctctctttttagttttttttttttttaagttgtacctttaactctggataagtagcatgtagctggatttttttctttctttacccaatctgagggttaatgtcttttaagagaaacttaatccattcaaatttattgtttttactcatatgtttagatctattcctgccatcttgttttgtgtttaatgctttcttcttaagtttctgccttattaatatgattgagtttactttgtcctcaaccaccctaagacctttttccctttccattcagtagtttgaaagttatacatcttattagggaaactctaactctagttagctatatacacacatgtacattaacatctttatatatgtatccatcacacacgtatatgtacacacacacacacataaactcatattttcctatcaacacctagggctcatgagtatgctcacctcctcctaaacaagaagtggcattagcacgtcttcattccccctctttcccagcaactccacatccctacaaaaagccccaccttcccttagaaatagtgttcaggtttcctggcttcttgttcatacttttgatctctttgctcttttgtgattctttaacttacttctccagattgcaaacttgcttttttagttttgtgaattcagccattgtcttttctatgaatcagtaaattctaaatttctaaagtagctagttttttttttttgtttttttttgagtcggagtctcgctgtgcctcccaggctggagtgcagcggcgcgatctcacctcactgcaagctccgtctcctgggttcacgccattctcctgcctcagcctcccgggcagctgggactacaggcgctcatcaccacacctgactaattttctgtatttttagtagagacggggtttcaccatgttagccaggatggtctccatctcctgacctcgtgatctgcccaccatcagccttccaaagtgctgggattacaggtgtgagctaccacgcctggcctgtatctagtatttttttaattaatgcaatattctcatgcatctttccaaaaataacctttttttcttctgaaaatcaccatctaatgtttttctattttctcaggagttagttctgtgttttaatttggtaattctctgggtactggctttcttgaattgtttggtgatttttaatgtctacttacatttgtattggaaaacatccatttccccactgcgactactgtggcctgccttcaggaactctggcagagagatgggatacgctgccaggtctgtgaggcagcttctcttgcaagtcagtagctacctctaggacagccctgcctctctgaccccagtgctccggacaactgtaacgttttctctcaacagatctatccctacctactagttacatttcaaagagtcctcaaaattacgggtccactgatgacattctttattgtttactcagattattattaattttgtcgtagctttaaaaattaattttcttctttcattgaatttctagggcgtcttcctttcaattggcctcccaaagtaaaattttactgatgccactttcatgattcttaggataaaaagaaacattgtacagctttgttctcttctccacagggtaaaagcttccatgaaaacaatgaactttattcaaaagaggacatatgggaaagaaaaatagagttataaaactaaatacaaatcaacttctcatttctctctcactttattttgatagcgctggtaggtgtgatcatattttagaaaattaatgcaaacatttaatataaataaataaatctgtctagtgttcttcgtaagtttttctctcatctgacttagaaaggcatcactattctccctttatgccaaatctagaagcctaaaagagcctgtaataaaaatttatatctaccaaattttataaatggcagatagtcaagaaatttaccagggttaactcaatgtaatactaaatccagtgacaaagtaaaacagaaaaataaaatgatcataaacaaaactagaagaatagatccactgccctccctaccaggatcataataaaaacatgctgtaatatcagcactttgggaggccgagacatgaggatctcttgagcccagaagtttgagaccagcttgggcaacatagagagatcccgtctctacaaaaaatacaaaaaaactcgccaggcgggattgcacatgcctatgggtcccaactacttgggactctgaggtgggaagatcacctaaggccaggacgtcgaggttgcagcgaatggtgatcataccactgcactccagtctgggcaatggagtgagaccatgtctcaaaaaaaaaaaaaaaagtaataatcagtagcgctaaagtggtgtataccaggtgaaaatcagctctggacctaccctgcccacagactccacaggaagatggtaccttgtctaagaatttaaccaggcttctacagagtaacttcaggaactttaaagctttgaccagatctttgggaagctgaggtaaactgttaaaaggcatatggctcaataatgacccccctttgtttggtgtggaataaagaaaagaaaaaacactgatctagataataatgcagaatattaactctggtgtaagtagaagtgctcttgtaggaataggtgaattttagatgttgcttctcttttgtttattactgtctttaaaaatatttgtcttggggaggggcgtgtgtgtttcattgttttctggacactcacaagaacacagctgcgtacctgtaactcaggtgagaagagctatacaaagagtccaccaaggacagttccatttgacatggaatataaattcttttaatcccctggtactactcttccccagccctgatggtgcagatctgagctgagtaactcagacttcagggattattccccgcatatttaggggaatggccctttatgacagggaaataaagttgggaactgatgtagggaaatcaatatttagcttacaatgaggttttacttttcctaattctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagtttcctaattcttaattccattttatcctccctagagggaaggtggggagaaaacttctgcctctctccacctgctttgtaacttcccttgtgagagtgtactttacttgtgggcatggctgatatgcatcaaacgctgaagtccagggcccaccctctcgttccacttcctacccctaccggatgaacacagaccacaggcctggcccctggaggcagtcccccacttgatctgcccatttcccttctcttcacctgacactgctagaacaggtctggtctgcactgcagcctccaccatcatagctcccgaggtaagagaggaagcatcccctcagaggcttgcagaccagtgtggcctgctccagcacagcttcctagacagaccctcatttgggtgatagccagcacctgccccaatattattaacaacccagaaaactgttaacatttagttcttgttccttgaatgtatcttccctggtcaaggacatgcaggagaaagatatacaccaatccaactccacccattatgtcacacctacaaagctctgttgggcgctctgctggctacaggccaaatgtggactgctacatctttgacatgggactcggtccttagcaaagtcatttaaatctgacagagatacaaattttcactagtccaaaatacttgcaccacagtgcagcacaacttcttgacattctgcaaccatccctcccacacccttccctctgctggaatgcttttctactccccatccttgaaagcccaatgttcccaggaagcctcagatattcatgccttttgtttccaactcaggagctttggctacaaatatttctgaccattctaagacaaacaactcccaagctcatctacaccacccatttctaatttccagtggaaaagaactcaataataacacagaatcgggcaaaaataatcaagatggcaaaaacaaagcagtcacacaaggacaaatctatcaacaaagtaacatctaataatccttctacaagatatttgttttaagataccagcaactgacagccacagccaactcaagagaaggctaatgagtgacagcaaagctgtccccttcctccacttgaggggaattccaaacaacagtgtgagccaaggagctgtgagacactgctaagtacagaagggcagctggctttaaaaggatgctaaatccttctgaaggacacttcaggaaaagctagtaaaatgctaatttttgtttataagcattggacttcagaaagcttaataactcatgtaataggttaacagtaaatagtcatctgatgaacttagaaaaaataatgtgcacaactgccaataattaggtcatttaaaaaattgtgggctgggcacagtggctcacgcctgttatcccagcactttgggaggccaaggtgggtggatcacctgaaggtcaggagtttgagaccagcctggccaacatggtgaaaccccgtctctactaaaaatataaaaaattagccaggtgtggtggtgggcacctgtaatcccagctacttaggaggctgaggcagaagaatcacttgcacccgggaggcggaggttgcagtgagctgagatcgcgccattgcactccagcctgggtgacaagagtgaaacttcgtctcaaaaaaagaaaaaattatgaaaggacttgggtattggagcccttcacgtcccaacaggaggacctcagtgatccatgagtgggccgggggaccacccttggagaaacaaccttctatcgggcaattaccagtcattttagtatctgttttcagttattctctccttctagactgtcatctcactgatcaattgtcttttgaaccttgatcaattgtatgagtctgagcaagtcaatgacctaatttgtaaaaccgagaaaatacagcctcatggggtgctataagttaaataatgacaagatacttggaaagcactaatatagagtgcagcaagtaatagctcaatgaatagcaactcttattgtttttggaatctgattattagatgactacttgaatgaatatactgatagtgcatggccttaaataatcactgaatcaaataactggggaaatgtttttagagtataaagaaaatgaaatcacacccccttttctccctaagatcactgtaaatacttttttctttttgagactgagtctcgctctgttgccaggctggggtgcagtggcatgatctcggctcactgcaacctccacctcctgggttcaagcgattcttctgtctcagcctcccgagcagctgggactacaggtacgcgccatcacgcccagctaatttttgtatttttagtagagacagggtttcaccatgttggccaggatggtctcgatctcttgaccttgtaatctgcccgcctcagccttccaaagtgttgggattacaggtgtgagccactgtgcccagcccactgtaaatactcttaaagcacttagtgcaaaactcaagactgctgatagcaataaattatgaaaatatttttcacattttacattaaaaaggagtaactattatttgtgcctcatacctgcagaacagcagcataaatgtcaccttacttagaatgttaccatgtttagaaacaaagtctttgctgatgtaattaaagatctccagatgagatcatcctggatcatccaggtgggccctaaatccaatgacaagtgtccttataagagacagaggaataaggaagcaagactcaaggatgtcagaggagagctgttttagttgcagtggagattctaatatggcctgcagaagaatctgtctgcatatgtatacatcatattataaaatggagcatttattttatgagttcctagtttataatttgaaataaattaaaaattaaaagttttagtcttttaaaaaaagagagacaggagaagacacagagacacagagacacagagaaggtcatgtgaagacagaagcagagaatggattgatgcagccacaaagaatgttcgaaagaggcaaggaaggatcctcccctacagcatttgagggagtgtgaccctgccaacaccttgattttggacttctagcctccataactcagaaaataaatttctgctgttttcagccaccaagtttatgtgatctgttacagcagcccctgaaaacacaaagccccactgcttcttttcatcgctggcaattccagggtgtcccccaaaggaagccagcaggctctgcaaacttatacctacctcaggtagaggtaaccaggctttgttctgtgttcctaagtaatgattcagaaccaaacactgcaaacgcccctgctttctaaatttcttgaagaaggggatgaggaaaagagagttcctacaggctccactgatgtgggtctgactgtctgctttagtttccacctaagttggtctgcaaatataattctccttacgagatttgtagagccaatcagaaagacaggagatattgcacaaagaaaaactgacaggcacaaatgcccaagcgagatggaagtgtgggaataaggcatgcaaccctgccctttacactggcagaagcctttccatatagactgcagtaaagacagagaaacacagatatataaatatcttcatataaatcttcacatatgccttgaccagttttcataatacatcctcacatttatttatttatttatttatttatttatttatttattttgagatggagtcttgctctgtcacccaggctggagtgcaatggtacaatctcggctcactgcaacctccgcctcctaggttcaagcgattctcctgcctcagcctcttgagtagctggaattacaggcacacaccaccatgcctggctaatttttatatatttttagtagagacagggtttcaccatattgaccaggctggtatcgacctcctgacctcaagtggtccacccatcttggtctctcacagtgctgagattacaggtatgagccaccacgtcaggccctcacatttgtaaacaggcacaagctggtgcattccaaagtcttacaagcattgttgatgtctgctattggtttccacccaccactctagagtcaggacctacatcctactatcttctagacatatgatggtgccttatgtctccaatgctccatgtgcggttgctatgaaactagcaaaatgaaacattatctaaaaaataaatccaaagcgtataagagaaaaataaatctggcggcacaatgttctccaacttaagaatatgaagtattctacatctctgtttaaaagagccactcactccagagtcttcatagagcatacccttccctttgccgctgtagaatcagatgaatgtttgcaagttaacaatgagtggaaattaagaaatgattatctaagatcatggaaaagctcaacaaaagcctcttgccttttccaggccgcctcttagtaagatggtttttatccctggccctaactcactgcctacctcaaacatgaattgcttggatataaaagttacctggattttatttccttgtgtcctctcttcagaaattctgtgtttagagaatgtgttttcagaagcagaaccccaatgatggaaaataataaatatagtttcctaactttgtgaccaaatgctgctaatattgatgtctaataattcctcaaatattattcccacatcttgatttttaaactggcccgcgcgcagtggctcacacctgtaatcccagcactttggaaggccaaggcaggtggatcacctaacgtcaggagtttgagacgagcctgaccaacatggtaatgccccatctgtactaaaaatacaaaatattagccgggtgtggtggtaggcgcctgtaatcccagctactcaggaggctgaggcaggagaatcacttgaatcctggagtggaggttgcaatgagccgagatctgccattgcactccagcctgggcaagaagagcaaaactgtttcaaaataaataaataaataaataaataataaataattttaaactgaacattaagaaaacagatttcctaacatattatttcccaatcacaaattattaagaatccatttattcaacaaatatttattgagaagctttctggtacatttgtaccagacatccgttgcagggttttacagtaatggatgaaacaaacaaaagccctccctcatgcaacttacattttagtgaggagaaggggaatatatatgaaaaataagtaaaataaacaatgtgttagttattgataagggctcaggagaaaagcaaaatgggagatatgactgctggtgctgatatttcccatacccccacataccatcaatctgagaagcgatcttcaaatgttaccccttcttccttcactgtagtgacagtcttcatttatttgctaacatctcccacggacatgttttaattgaactgtggctaaccttgtcttctaagtgttgtcacttgctgttcatcacattaaaatatcttttttttttttttgaaataggagtctcactctcgcccaggctggagtgcagtggcatgaccttggctcactgcaacctctgcctcccgggttcaagcgattctcctgcctcagcctcccaagtagctgagattacagccacacaccaccatgcccgggtaattttgtatttttttggtttatttgtttgtttatttagtagagatggggtttcaccatgttggtcaggctggtcttgaactccagacctcaggcgatacgcctgcctcgacctcccatagtgctgggattacaggtgtgagccactatacccggcacattaaagtatcttttgcagaataaatttatttaaaaaaaaaaaaccaaactggtgggggcagaaagacactaacatttactaagcacctattattaagccaagcacagtggtagacacctttgtattcattatcagagttgatctgtgtatatccccatgagggagataacaagattctcactttacagaggaagaaacagacactccaggaacttaaggtcacacagtaagtggcacaactgaattctgaactttgctgtccatatttgtcttaccttcaaaattctccacttttaggattctttttcttaacccatctttttcttggctgatcacgctatatacttttttggtaaggatcactctttcacactgtcttatagagcaggaattactttcctcattacctaaaagcagcctcatctcctttctctacaaccttaggattaaattagactgtgctcaattgaattgaataaaacctttatgaactacactgaccactaattttaaaattaaaatgaccaatgccataactggcatcttttttctgtagtcatcttccctttactaggttatttcttttgcaaaagaatcttaatcctaaatctcaagccagtggcatacctaggtggctcctgggattccgcatggattacggattattattaataaaatgcaatatacaatcctgtagataatcagcaacgtaaaccagtaaggtccagacatttttctttaaggatgttttttcctcattacctcagtaacagtttccaggtcggaggaactggaacgcatgcaggtggaatacagtccctgacaatgcaataataatttcccaacttattccccttgccttgctcgtcctctactatgcactcagcagcagacgaatttttggaaaataactgaaaacgcacaccgtgataccaatgaattcttctgctgtctccgcgagagcctggctggaaattctgagccagaacccgccgtaatggagcagaaaggacagacagaggcgggaggccgacgcccgggtgcgggtgccaggcgtcccggccgctccccgtcgccctacgcgccgcgggcacagcgagggtctcggcgaaaccagtcagcgggcacgcggtacaaggcggcgctcggccctgggctcggccttggctgctgcgccccgcgcggcgcgccccgcgtcccgtcgggcccgacagtcgcggcctcgccccccgcccgaccgccccggccgccgctcgctctcccactccggcccccgccccgctccgcgcctagcccggctggggctccgcgcccgcgcggccgcctcaccacagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgcagctcccgccgccgccgccccttccacccctgcaggccgtggcccggcggcgcgctccggtgggcgggtgcgggtctcgcgggaggccgggctggcttggcccccgctccggagccgctgggcgaggccgggccacctgcgcgccggccgccctgcccaggccctgcgcccgcgtgccgcggtgttttcagcggctggcaggagctccttctcaaccgttagcacccaaagagaatcccaacagcacacttccagcgcggattaaaacaaacaaacaaacaacaacaacaacaaaaacgagacgctgcctgttggtttgtaactatcaattgatgtgttctatcccaaagtggttgacttcacattgacatataatgcatatggcgaatacgtactacacgcgcatgcagtcctcgcttgcacggtaattctggacgctggaaatgactgaaccatgcaaaactaccttaataatcactgggaaaaattaagattgtttcacgactttaaacagtttttctcaaaacattcaaagcagtccgggcacggtggctcacgcctgtaatcccagcactttgggaggcccagacgggaagatggcatgagcccaggagttcgagaccagccctgggcaacacagtgagacccggtctctacaaaataaaaaaaaaaaattagccaggcgtggtggtgtgcacctgtagtcccagcttctcaggagaatgaggggggagaatcacttgagccccggaagccgaggttgcagtgagccaaggtcgcaccacagcactccagcctgggtgacagagcaagtccttgtcttggaaagaacaaacaacaacaaaagaaccattcaaaactcgcttaactgatggttacaaataccctgtatatggaaatgaaaaaaaatcagtttaaaacattcaaacattgagaattaaagtattttttgtgtttgtaaaaataaagcttattaagaataacttgaacagtgcttgtcttcttctagtgtaactcttatataccaccttttctgtactttagcaaaacatcacatttggattacacgcaagtattttatcctttgcacttccaatgccatgcaatgtctcagagagttcctttaatgtaaaatgtttttgtggacctcatttcctccgggacatcctcatccttttagtcacagccattttcctcattcagtgtgctttgagtaagtttcactgactgcatatctagtctctggaaagtcagcactcccacagttgtctatttcttctatagtacttcatttgcattcaatttgaatttcacttcaattccatctttaccatttttttatttctttgctgcactttcatctttgttgaccaattccctttcaattattcatttttatacaatgctgtgtgagtttaacacttggagaaaaggaagcaacacaattgcacactttgctgccagtgcctaaactaacagtgcaatgacccgtcactgacagattttgaaagaactgctgtgattggtcactggttgttatggacatctattgtttacatagggttttgtggactaaagagctagaagcaaagattgtactatgtttgttcacagctaaaatagcatgataactaaaatttgttttttttgtttttgctttgttttgtttttgagacaggatctcatgctgttgcccaggctgcagtgcagtggcacaatcatggctcactagagcctctacctcccaggctcaagcgatcttcccacctgggcctcccaagtagctggaactacaggcatacaccactaagcctggctaatttttgtatttttattttttgaagagacgggatctcactatgttgcccaggctagtctcaaactcctgggctcaagcgatcctcccacctcagcctctcaaagtgctgcaattataggcatgagccaccatgccccatccagtaactaaaatttcaaccatattgttgagatactggtgttatttaactaaatagctgacatcagtcatatctgaacctgcaaagcaaaggatgcctatttggatatatgcatactatatatatgtgtgtatatatagtatatatgaagagtaccaataataagcacctatgcatccaccaggcagaagtgttaaccccctccctccacagtttatccctcctgcacctctatttaaatacttcatcttcaaattaattagcacataagattaaaacaacacaatcttcctggggtttgggttcccaacatgatttcacagtcacttaggtaggaaagcaggtctaaatatttcactttcatttacccagaaattttagctctcacataaaatgaggaattggcaggtttttgacacttcggttgtatactcccctggggagaggacatccttggagcagaacttttaagaaacatcaaggcctgtttttatatactcaccatgtcaaatatatgtttggccttttgcattactttgtcataataattgtaagatatttgatgaaaatactacactgtgctcaaagatttaggcacctggaagctgagggacctattcaggataataagcaataaaaataaatctgggagaagcacttctagagtggtagaaaatctgcttctccataaaagggagtacactggcaaaaatagttaaaaccaactccagaaattaaccaaacacaacaatccaaggagtatttattaaagaaaaattactgaatcttggtgagtacagtgagctttagggcattttgatctgcccaattctcaactacttctctccagctctacagtagcctagtaagccaacagcctcacaactacagtagctttgaaaaccatccagcagccactggatggggcagaataggtttagatcttctcaaaagccccatactaagtaaactgtcattatttgacctgtctggaagcaccttgaaaagttccattctcagggtttgtctttatttgacctggttcagaacttgctctgtgcaaacagccctatccctggtgcatttgttgaaaacaatcagttgcaactgtttaacatcacagatacctgcggtggtgaaactgtttggtactaacaagaagctaaccaaaaaagttaaaaaaaaatgggcaataagagtccatatagttccttgaaaagctctgacatatacctaggaatccagaatttcatgcaggacatgcatgtacatgcaggactgtgaacacacccaaaaaacacctaagaagactctaatctctcacctctgtctgaccttgagtttcagtacaatgcagaaaataaaggctaaggaagaatcgtaaactacctaccacaatgtgcaaggcatgccccagcacacacagcctctcagcaaaagctaggggatttattggctcaaagcatttaagaaaatatccattcaatcattagctaagcactaaactatccaagcagagactctaatggctgcacacaacaaacaatacagactttatagattagtccagcaaagtcactaaaccagcaacaaacctcagtggagaggaggggatatgatttctagagttgtcacattacattgttcaaaacatccagatctcaacaaaaaagttcacaacatccaaagaaacaaaattatggcctatatgcaggaaaaagcagttaatagaaaccattcctgaggaatcccaggcattggacttactgaacaaagactttaaatcagccattatgaatatgttcacagaactaaaggaaaccatgtctaatgaactaaaggaaaatgtgagaatgatgtcttactaaatagataatatcaataaacagaagttttaaaaaatagaaactctggagttgaaaagtacaaagagtgagatgaaaaaattctctagaggagctcaataacaacatatatgaactggtagaagcaaaaggcagtgaacttggagatagctcaattgaaattatccaggctgagaaacagaaagaaaaaagaatgaagaaaatgaacaaattctcagagacttatgggaaaccatgagtttatgtgtatattaacatgcacataaagtcccagaaggaaaggatagagagaaaggaatacaaagaatatttgaagaaatagcctgcccagactttatgaaaaacagtaatctgccatccaaggagctcaaaaaacttgaagtagtgacctagacacataatagtcaaactgttgaaagccaaagatgatgagaaaattttgaaagcagcaaaagaaaaacaactcatcacacacaaaggatcctcaataagcttaatagctgacttctcatcataaatcatgaaggtcagaaggtggtgggaagacatcatatttaaagggtggaaggaaaaatatccttcaaaaatgaaagagaaattatggcattccaggtaaacagaaagtgaatgaaatcatcactagcagacatgcactattaccaaagggaaccttgcaggctgaaatgaaagaatattagaaatttaaatccacataaagaaaataagagcagtgattctgataactacacaattgaatataaaaaattattttaatttttaaaattaaaaaattttaaattaaaaaatctgaacactctgatttaaaacacaactgcataaaacaatggctatgagctgtgtcgataggcttttaatgtataaacatacaatttgtttgacaatcatattacaaagataagagggacagagtggatgtatactggagcatagttttggcatgctattgaaattaaggcaagtcggctgggtgcggtggctcacgcttgtaatcccaggactttgggaggccaaggcaggtgggtcatgaggtcaggagatcaagaccatcctggctaacacaatgaaactgcgtctctactaaaaatacaaaaaattagccaggcctggtggtgggtgcctgtagtcccagctacttgggaggctgaggcaggagaatggtgtgaacccgggaggtggagcttgcagtgagctgagatctcaccactgcactccagcctgggcgacagagcaagactccatctcaaaaaaaaaaaaaaaaaaaagagagagattaaggcaaggcacggtagctcatgcctataatcccagcactttgggaggcctaggtgggagaattgcttgagcccaggaattcgagaccagcctgggcaacacagtgggacttcatctctagaaaaataaataaataaataaataaataaataaataaaaaattagccaggcatggtggcacgtgcctgtagtcccagctacttgggaggctgaggtaggaggatctcttgagcctgggagatggaggctgcagtgaaccatgattgtgccattgtactccaggctgggcaacagcaggagaccctgtcttgaaaaaaggaaaaaaaaaagaaattaagttagtattaatactacttaggttattttaagttaagaagctaattgtaatccccgggatgactattaagaaaatgattttttcaaaatgttatacaagaaataacaaggaaattaaaatgatacagtagagaatatatagcacaaaagaaaacagtaacagaagaatagaacaaaacaagatataagacatatagaaagcaaatagcaaaatggcagacataaattctaccttaccactaattacattaaaggtaaatgtactaagcattcccatcaaaagacagagattggtaaaatggatcttaaataaatgtataacctaatctttcactttgagcaactagaaagaggagcagaataaactcaaagcaaggaaaaggaaggaaataaggattaagagtagaaataaatgaaatgatgaataaaaaaacagagaaaatcagcaaaaccaaaagttggttcttaggaagtattaaatatcaataaagatgacaaaccttcagctagactgaccaagtgagagagagaactcaaattactaaatttggactgaaagaggggacattactaccaaccttgcagaaacaaaagtgattataaggagtatactaaattatgttgtcccagctactcggcaggctgaggtgggaagatcacttaagcccaggaggtggaggttgcagtgagttaagattgcaccactatactttagcctgggtgatagagcaagactctgtcaaaaaaaaaaagaaagagagagagaaagaaagaaagcaagaaagaaagaaaagaaaaaaggaagaaagaaaaaaaagagagaaaggaaggaaggagggaaagaaagaaaagaaagaagggagggagggagggaaggagggaaggacctacctacgtgaattagaaaactttctagaaagaccaacctactgaaattgactcaagaagaaacagaaaatcaaatagaagtataacaagcaaagagattaaattggtaagaaggaaaacttcccaccaagaaaaaatggctttatcagttttgttcattcctttatctcctgcacccagaacagtgcctggtgtatcataagcaaccaataaatatttgttgaacttgagacaggatgttaatataaagtgaaagacttcatgacttgtcataaggcatatcatttttctaaagaacagagttttgcatgcaatgtagataaatattacagctggaaaattgacatcattttatgtagtcaaagaaataaaaattcgctattagttctcagatgatagttaatgcttcaaaggaaaatgtgggagctgctactattggcactatgcaaggtccaaggtagtgtttttccaacctgcctcccagtgaatacaacctcaagggttatagcacctgagcctgttgctccaccttcctcaaaaacaagatcctttcacctattttgactaccacgcacagttagaagtatattttattttattttattttagatggagtcttgctctgtcaaccaggcttgagtgcagtggcgtgatcttggctcactgcaacctctgtttccttggctcaagcaattctcctgcctcagcctcccaagtagctgggattacaggggcccaccaccatgcccggctaatttttgtattattagtagaaacagggtttcaccatgttggccaggctggtctcgaactcctgacctcaagtgatgcacctgcctcggcctcccaaagtgctgggattacaggtgcgagccaccgtgtctggccagaagtacatgttaaatagtggcacagtacacacagacacatacaggcgtacacacagacacatacagacacacacacacacacacacatacacacacaactgaagcaaaagcttctgaaaacaatattttaccttactacctgggttgaacttttctgttctcttctacagcaagccactctacatccttagcattttgttggaacattctcatcagctcctatctttgcttgaagctggactgtcccccaattcagctgccctcggcagccctcagtgccccaatgctgccctcggcagccctcgacaggaggtgttttatctcttgcaccccacatgtctaaaggccagaggttggggtaagtttcttccttgttggtcctgccccttctaaaccattccttgctctttctcatgcccaaaccaaaccaaacaaccaaaaaaaactaaaaactggctgccctgaagtttatgcccttaaaggatattacctacccctttcccctcttctttattgtcgtttactgccttcctctccacttttattcctggcataattttttttttttttttttgatacggagtctcggtctgtcgcccaggccggactgcagtggcccgatctcggttcactgcaagctccgcctcccgagttcacgccattctcttgcctcagcctcccgagtagctgggattacaggcgcccaccaccacgcccggctaattttttgtatttttggtagagacggggtttcaccgtgttagccaggatggtctccatctcctgacatcgtgatccacctgcctcggcctcccaaagtgctgggattacaggcgtgagccaccgcacccggcccctggcataagtttgaatgatttcaacatccatgtgggtggaccatccaatgctcttgcctctcagttccttggtcccatctcttctagagatcttttccctattctacttcagccttgcacttgtgtggtcataccttaagcctgggctcacaaactcaaatgccagtagggtaaggcccttactaccaatgagtgaagaaggccagatgttagtcagcagaaaatagtggaagctgtgacctccctgcctggtgctacagttctcttttagaaaggagtgaccgccactcagctgcagccagctgtcatgtggaaatgctagaccaggatttccacatcttccaattcatggaaacacaggttgtcatgtgctatctcccaaattttacatattggcaataatatggactttcagtctaaatattgtgacattaaaaaacatttcccctcttaaaaatcagctcaaaagaagaaaaaaaaaagggaaaattaaattatatcttccttgaaacgtggagatattccagaagttagaaaacagtgaagatttggccggacgcagtggctcacgcctgtaatcccagcactttgggaggccgaggtgggcggatcacgaggtcaggagatcgagaccatcctggctaacacggtgaaaccccgtctctactaaaatacaaaaacaaaattagctggacgcggtggcgggcgcctgtagtcccagctactcgggaggctgaggagagagaatggcgtgaactcgggaggcggagcttgcagtgagccgagatcgcgccactgccctccagtctgggcgacagagcgagactctgtctcaaataaaaaaaagaaaagaaaacagtgaagatatggtaagtgacttagcagaagggaggggaccaacctcagtgactatccagggcaatgccatgaagaaacaagctcattgcattgcagaagcacggaaatattcaggaatgaattggaggctccaggtaccacaaaagatagatgggaatggaaggaggtggcaggcactgaaaataggagattgatctaaaatgtggaataggaaacacttattaccccggtatcctctctcatttcagcggaaatggaagtatattctcaggagaagaactagagagtggcattaggtacaatagactgaaaagaaaaggttacaggaaagttgtatatggagtgatgagatgctaagctcctttctgccacccagatgcagaatgctagcaacctcagacaagagatttacgtatcttcccatgtagaccgttacaattttttgttaaatccatagatttcattgttgtgactgtttaaacattgtttagtaccgaacctagtattgtcccgtgattatattttcctgccttatacaatttcttattttacctggagttaataattgccttgttttcaacttgttgttttcctaaaactcatgactaagtgttcccacatccgcaagagtaatgtcaaatgcctgcaatacagttttccacacactcaaaccagacagagagtctacccatttcagtttttcttggactcagccctctgaagccctccatcctgctgctcctatctgtacagatgtgctctccgggtttctgcccagttcagagagagagagagagagagagagagaggaaagagagagagagagagagaggaaagagagagagagaataagaaagagctgtttattttaaggaattggcacatgtgattatcctctctgtacagatgtgctctccggggcttgtgcccagttcagagagagagagaaagagagagagagaggaaagggggaggggggagagagagagaagaaagagagagagagaggaaagagagagagagagaataagaaagctgtttattttaagtaattggtgcatgtgatcatggaggcttgcgaaatacaaaacatgcagggtagctggcaggctggagacccagagaaaagttgtagtttgagtccaaaggcagtcggttggtgtcagaaattttcttgctcagaagacgttagtagttttattctattaaggtcttcaactgattggataaggcccacccacattatggatggtagtctgctttactcaaaatccaccaattaaatgttaatcacatctaaaaattgtcttcacagaaacatccagaataatgtttgatccaccaggtaggtttgagaaacaaggaatgaagagtaaagaaagtggtaaatatgtggatgaatctaagcaaatactgataaaaaaataataataacaatgtcttaatgggttaaaaagaataattaaaatacatagaataatagttcataagttgggaattaagtaaaaagaattaaagttttttttttttttttgtggtggggacaggttttcactcttgttgcccaggctggagtgcaatggcgtgatctcggctcattgcaacctcagcctcctgggtcaagtgattctcctgcctcagcctcccaagtagctgggattataggtacccaccacccctcccagctaatttttttgtatttttagtagagatagggtttcaccatgttgagcaggctggtcttgaaattctgacctcagctgatccacccgcctcggcatcccaaagagctgggattacaggtgtgagccaccacacccggtctagtgttctttcttttattatgaggagaaagttaaaggatctgttaactttagacttgattatattaagtgagcatattataatttctaaggcaactactaaaagaaatgaacaatgcatagcttttgaactatttaaaggggaaaacattgaaatgattaaaatactcagtatatcaaaaataaagtaaaaaaggagaaaagaaaaaacatggaatgggtgtgtcaaatagaaagcggtggctcacacctgtaatcccagcactttgggaggctgagatgggtggatcatgaggtcaggagatcaagaccatcctggctaacatggtgaaaccccatctctactaaaaatacaaaaaattagccaggtgtggtggtgtgtgcctgtaatcccagctactcgggaggctgaggcaggagaattgtttgatcccaggaggcagaggctgcagtgagccaagattgcgccactgcactccagcctgggcgacagagcaagactctgtatcaaaaaaaaaaaaaaaaaaaaaagcacaaaatatgtttgcagatttaaactcaaatatatataaaatgtgagttgtgcctttaggaatggtgcaatgtcatggccttaacaatgtagtgttaattacatttcatgtaaataaactaaacgctccagttaaaagattttcagacttgataaagacaaattctatctccatgttatgtacaagaaacatgttttagaattataaagatatagaaaagttaaaaggtaaaaggttatataagatataccaaaaaagcctaagccaaaggaaactagtatagctatattaagaaagatatggttttaaagaaaataaaattacaataaaaaatcagtgaagacacaaaaggtttgaataagataatatgattgacatagtgagatctccacctaactactgcagaatatatatatatcaaacatacagaaaaattattaaatacaaatgaacaaataaaagcaagtctcaatacatttcaaaggtttaaaatcatacaatgtgtgttcttagattataagacaagccagaaatcagcaaaaattcgaatgagaaaaattaatatgttagggattaaaagacaatcatgcttcaaaacaaaattgtaaaaatgttagaacatattttgaacagaattatagcaaaatattgcatataaaatttatgacataatttcaaaataagtatattcagagaatctaaaaattaattaagtaaacattcatctcaagaagttagatatgcatgagcaagaaggaaataatgaagataaaaggagaagtctttgaaatagaaagcaaatatataatagattcgacaaagccaaatgctgcttcattgattttaacaaaattaaaatatctgtcaagaagtattaaaaaaaaattagaaggcacaaatagtcaatatgtagaaacagaaaagagacacacttaggtatatttcagatatttaaaagataatacaaggttaatatgaactggaaaaatttagacaaaatggataatcttctaataaatatataacccaccaaagtttattcaggaagaaataggaaatctataataagagataggaaattttacaattatggtgcccatacaccccattttgcccaggacagtcccagtttatatctattatggattaatgtccattaattattttcataacccctttaattctcaaaagcgctccagtttggaggataagccatatggtcatcctgcctgtttataataattagagtaactaaatccgtagtcagaaatgttccgcaaatgttcctcctaaaaccattccaggcctcaattcaccaaccagttctaccaaacattcatggaagaaataatttcaatcttagccaaactctttcacaaaatagaaaaagaggaaatttttcctgactcttaagactagtgtaaccttattactaaaatgtggcaaagacagtacatgaaaagaagattacaggcaatgtcaagcacgaacacagacacaaaactcgtaatccaaatatttgcaaactgaatttagcagtatctaaagggataataaattatgaccaagttggcaatatcccaggaattcaaaattggttttatgttagaaaataaactaaaataggccgggcctggtggctaacacctgtaattccaatgctttgggaggccgagatgggaggaccacttgaagagtttgagaccaacttgggcaacataacaagattccctctttacaaaaataagaataataacaaaagctggatgcagtgtgtgtgcctatactcctagctactcaggagactgaggtgagaggactactagagcccaggagttcgaggctgcagtgagctattattgtgccactgcactccagcttgggcaacagagtgagaaactgtctctaaaaaaaaaaatcaactaaaataattcaccatgttaccacattaccacattagagaagaaaaatcataacatcttctcaatagatatggaaaaaagcatttcataaaattcagcatacattcatgatttaaaacctcttatcagagtgagaatacaaaggaacttccttgatagttatcttcaaaaatcatacagcacatctcactcttaatggtgatattaggtggagatcagggcaacacaagcttcctactatcattgcctctatttgatattgtgatggtggtcccagccaataaagtaagaaaaagattgtgtaagaactagaaaggaaggaacaaaactgccattattagtgacgaatatgcttatgtaatagaaaattttaattaaaactacatatattattattagaattaatgagagatgaacaacttttctggatatgaaaaatcaaaattgcctttctttacatcagcatcaaagcactggaaaatggaaaaaaaatatacatttacaatagtgtcaaaacatataatgtacctaggaagaaaatctaacaaaaatgttatggagaaaacaataaacctttattgagagatatcaaagaaactataatggacaaatatatagtagtccccccttgcccatagtggatacgttccaagacccccaatggatgcctgaaactgcagatagtactgaaccctatatacactgttttctcctatacacacaaacctaggattaatttgtaatttaggcacagcagagactaaaacaactaaaaataaaataaaacaattatgacaatgtgccagcattattactctttcactttagggccattattaaataagataaggattccttcaacacaagcactgcaatactgcgacagtcggtattgaaaactgagatggctgctaagtgactgatggatggggggcttgtatagccgtgggtgctctgggcaaagggatgactcatattctgggctatgcagagcaggacagtatgagatttcatcccccccagtcagaacggtgcacggtttaaaacttatgaattgtttatttctggtgaattttccatttaatattttgggactgtgactgaccaaaagtaacagaaactttggaagcaaaatagtggataaggggagactactgtaacaagtttctggattagaagattcaatattgtaagcatatcagaattttccaaatcaacccatagattcagtgcaaacacaccaaacacataatcgtttaagttattgagcttggcaaactgattctgacgttaaaatggactgatagctgataatttttttttttttttttgagacagagtctcaccctgtggcccaggctggagtgcagtggtgcgatcttggctcattgcaacctccgcctcctgggttcaagcaattctcctgcctcagcctcccgagtagctgggactacaggcatgcgccaccatgcctgctaatttttgtatttttagtggagacggggtttcaccatgttggccaggatggtctcaaactcctgacctcaagtgatccgcccgcctcggcctcccaaagttctcaggcgagagccaccatgcccgaccagctgagactttttttttttttttttttaagacacagtcttgctctgtcatccaggctggagtgcagtggcgcgatcttggctcactgcatgctctgcctcccgggttcatgccattctcctgcctcagcctcccaagtagctgggactacaggcgcccgccactacgcccggctaattttttgtgtttttagtagggacggggtttcaccgtgttagccaggatggtctcgatctcctgacctcgggatccgcccgtcttggcctcccaaagtgttgggattacaggcgtgagccactgcgcccggagctgagacattcttaaggaagaaaagcaaggtggaaataaatatttgtcctgtacgatgttgagacttaatacatcactagaatgattaagaaggtataaggttggctcagggatagacaaatagacccgtagtacagagagagagccccaaaatacacctagacacatatggatacttgatatacaacagagttggcattgccaataagtcatgaaacgatggctttttcatgaaaggtgctgagacaattgggatttcttataaaagaataaaacccaaaatggtcctataccttacattacactaaaaaatcatttataggtaaattatatgtgaaaagcaaacctgtaatgcttttagaggataatatagcagatatctttaagacttgggaatatggaactatttcttaaatattacattaaagcatctagccataaagtagaagattaataaataaggcaatattaaaactaagagcttctatcatcaaaagacacaagactgggagaatatattcacaatatatataattggtgaaagattaatctccgaatatatatatttatatagtttttaaaatgcctacttatcattgagaataaggcagacaactcagtagaaacatgcacacaggggccgggtgcggtggctcacgcccccagcactttgggaagctgaggagagcggatcacgagttcaggagttcaagaccagcccggctaacacggtgaaaccccgtctgtactaaaaatacaaaaaaattagccgggcgtggtgtcacgcccctgtagtcccagctactccggaggctgaggcaggagaatcgcttggaccaggaggcgaaggttgcagtaagccgagatgcgccactgcatttcagcctggtgacagagcgagactctgtctcaaaaaaaaaaaaaaaaaaaaagaacgaaagaaagaaaaaaagaaacatgcacataggagttgaatagacaactcaacaaagaggcattccagatgtctgataaacatatgaaaggtgtcatcttcatttgcattcacggaaatgcaccttgaaacaacagcgagataccctacaatcccaacaggctggctaaaattacgaaatctaaaataagtttgggaactcaaaagcattgctagtgtgagcacaaattggcaaaacaactttggaaaacagcatgacattatggcatagttgtcaacgtattgcttctcagctcaaattcacttttcaatacaagctttgagatgagggaatttctttaagcatttctcctctaaagtgagcacgatgttgagctttctcagtagagggcgctaggcaggtgttgcgggagggaggggcgcttctgcagtttctggcggaggctcagtggtcaaccgtgcgggtgggaaggggtcgggtggattctgcccttccatatgcccagagttccaagtccctcagcgacttcacagcccccttgtctgctcaacacggtcactatgtgtttcaggcgccctcaggcctgttgcacagtcacacgcaggccaccagctgcggctcccctgcccagcctgcactttggagggttgtttcctgttttttttttccaccactgcaaaccatcaaatttctctgccatccagtgggttcaactacaccttctccaacgaagtcagaaccacagttttggagagggagccccttgcaagtttattcttccttgggtaactctctcttggccccaaggcaccatgaaagttttcttattttctatagctactcctttatcccaacttaataattctttatattaaactctccctttgcggtaggagtttatattaaactaaaccctttgtgtttaaaataattgcgtggtttctatcttctgattggatccaccctgctaagtattgagaatgtgccatacaattccacagcaattccacttctaattatcttttctagaggagatttttgcacacgtgcattaattcacaggaaccaaaacgtttatagcagcaatttgcataaaagccaaattctgaaaataactcaaatgttcatgaagagagaacagataattaaattgttacagtcctacaaggaaatgaaaatcagtgaactacagctagacagaacaaaatggatgaatgtcacagacaatgttcagtgtgaaagaagcaggttacaggttggtgtttactatataatcccattgatcccatttaaagttcaactttatttaaaactaaactacattgtttggagatatatatatattaaaaccataaagaaaagcaaggaaatgaatattttaaaagttagaatagtggctacctttataaggttgcttttggggtgccctctttgtcatgcggatgtggttacataggtatttgaattacaattcctctttgacttatgcatatatgttctgtgcattctattaaagtctttgcaattatgtaaactaataaccacaacacaaagaaagacacagttcctgcctttatgaaacttacggggagaaagaacaaaacagaaaacgtggaatcacttaagatggagatagcatgattacattttctttctttctttctctctctttctctctctctctccttccttccttccttcttttcttttttgagacaaggtcttgctctgtcacccagggtgggatacagtggcacgatcatggttcactgcatctttgacctcctgggctcaagtgatgctcccacctcagcctcccgagtagctgggacaacaggggtgtaccaccacacctggctaatttttgtattttttgtagagatggggttttgtcatgttgcccaggctggtctcaaactcctgggctcaagggatccacctgcctcagcctcctaaagtgctgagattacaggcatgagccactgtgcctggcctgcgattcattttttaaacaagtatctttggactgcaatccggctagattagaccttggaacaatgaaatatgacaaacattttaaaaatgcattgttcagctggcaagaaagtatggtgaattccaagggtggaaaacaaagagataatcaacaagcagagatatggggagctgatgctgtagttgccttaggtgcagtagtgatgtactggtctcagtagccaggcagcttggattttaatggtcacctgctgtccaggacaggctttgggcctaagggagatgggaaggttgaagtgagaccctggataaagctataccacagggacatgatagactagaaaaaaaattacggacacagggagacaaaataaagcttttgtgttttggtttgcactccagttagaataaaatcaggggtgtaatcccagcactttgggaggctgaggtgggcagatcacctgaggtcaggagttcgagaccagcctggcaaacacgacaaaaactcatctctaataaaagtacaaaaaaattagccaggcatggtggtgtgtgcctgtaatcccagctgtccaggatgctgaggcaagagaatcacttgaaccctggaggtggaggttgcggtaagccaacattgcaccattgcattccagcctaggtgacagagtgggactccatctcaaaaaaaaaaaaaagaaagaaagaaagaaagaaaaaagaaaagaataaaatgcagggaaaaatgtgcccagagaagattgataatcttgataatccagggttggacctcatgttggtctgatattctaaattacattacccatgtgagccagtaatctctaggtagaaacattaacataagaattaatcactctaggatgatactactgctgggcacctggcagaagcaacataaaaccgctttagagaaatacacctgtacccaggtcacatggaacgtccaccaaatgggagctcatgaacctaaattacaataacatgatgaaataattcatcctgatgaaaagtcaacagacgcaatagtcagcaagattagactctcagaactttagaaaatataataaataaatattagtaaaatatcaagattataaaaccaggagtcacataacacaagaacatcttagtatcaagaaaaaattaatttgaaaaaactagactgaacttccagaaataaaatatgtggtcaatgaaattaaatatatcttcttgcataatagttcctaaggcattggcctcaaagtagtctttacaggaaattggagctgcctagagtcataatgtcaggtgagtgataatttacaagcaattatagatatagtgatatatttagaggtgagagcagccttatagatatactagtgacactccctttggtgaaagatataaaaatcttagccccaggatgtaaaccaagtcacagataacagtaaactcccatctagagcacacatgttctgacacctgttaagtgccttttcagatatgtcacattcccctatccatagacacaggcacctgctgagagaaagatcagggaagtttgatgacacttgttgcagtgaaaagctggtaaaaggagaaaggaaagaggctatctcagacctgaaaaggctgggagactatttttgtatataataacaggaaatagtcttcacattatataaacaggaatttaatggaggagagccacccagggactctggggaatgctggaatacatacttgcttacgtcctgcgagggtggatttgagtgaggagcagggcagtgaattctggcacttgtcagtgccagggctaaattattctgctcctgtttggtggaggtaacagctcttacatcactttaattgtttccttccattgacgtgaaatgaggaatttcttccatggagtgcttggttcaagcactgccaagagttggcaaagctcctagtggcatctttcacttttggtctctggtggctcttaaatacagatgaattgtgtaggaaacaaacaggaggaattatcaatcatatgtgtctcctctcaagaaaatgtgccattttcctcttatatatactgcgatggcatttgttttttcaagtttgctcagttcacaatctgcacacttcaccttcttcaagaagtctcctaggctgaaagctattgtcagctgttctgtgattctatcttgtgttaccattgcaggtgtacatgtcttacctccttcagtagacagtgacttcggaagacagatcctggtctgatccatttttgagttctctataatggctttcccagttcctcacacacatttggtgcttaataaatgtttgtcttatgagtgaaccgatctttgatttgttgtgtagtaaacatacaaaattctaggctgtatcagctagaaattatgttggtactagtgactgagaacctagcatagtggcttaaataaattaaagccttctttttctgtgatgtaaaaaaaaaattattagtcttgtcagtccaggatgggtaaggcagcttcaccacatcatgagggacccaagcacttccttccattctgcgttcttcagcatgttgcttgcatcttcgaggtcacaaaatatctgccagagctccagccagtaggtctgcattttaggagaatagaaagggaaagacaaggggcaagcaggctcttccctcattggcatgaaaaaaccccagtaaagagagttgcaggaaacaccaatcaaagacttatatttaaatttcattgaccagccccttaactgcaagggaggatggggagtaaagctttttagcttggcacactttccccctaagcaaaatctgagttatgtttctaaggcacaaagagagagaggatattgggtaagcagcctgcagtctttgccatgaaggatcttaatcattcatcagtaagtatgatcttttttttttttaaatgtcaattgtttctttaagatttttagtttctcttcaaagtctataggtaaatcactgaaatttatccagatcccagccttcacatccagggattttggtgtaccaccatctactcaatgctccccgtcctcctaccccatcaaatgagcttcgtttgtttttcctttatctctaagtggtatgacaccatctgctgttttctgcttttgacccagagccatgtctggcatcatcagactaatcaagaggtgggaagggacaaggtcaggcatgggttagtgacacaaaccacttggtaattaaaaaccccttggtgataacattttctccttgcacaacaaaatatccattgcaggattttgataaaattctgctctattaatcatcagcaattggaagctcagaatgtgaggctaattgtcagattgatgttgcggctgagaggaagtattaaaatttcgcaaagaccataagagaggcagttatagaaatagtgtgctaattcttagcttacatttccatatatgttaaatttctcttagaaattatttggattactgatgtacaagtgattactaaagataataattaatcaatttagtcctccattccattaatcaataattgttgagtatatactatttgccaggcattgtgctagctgcgagagctataaatgagagttttttaaatgtagacgtttctgagttaaagatacactgaaaggctaaaatgaacagcaggaaaatgagatgataatctgaaatcagcttccatagaccaataatcccagaaaggctgcgagaaaattaatagcagaaactaagcttgggtattttgcaattctcttttagccacacaaaattaaattagaaattctgagaagactcaagcagggactgttaatatggggttttgacatgtattaactagacaatctttatgaataaagaaaagagaacaagtcgcttccatggcataatattaaaataaggcctcctggatagccactattctgaataagataagaaagacgatgccattacagctaagcagctcaaaattccattagaatattttaagcgttagtataggaatttacacaagagttagagaaaatgaaatttaaaaccaagacctgaaaggcactcatgaatttaagggcaggtcattttgcaggggttgggtggggcaggagaatcactggattgtgaaattgaaattgaaattgaaattggttaatttcaacggactacttgatacaattgatagccatggatttggcaactgtggatgccagggcagacagagtttgctcctaagaagatgcccaactcagagacgctgggtcctgtgtcccatggtctccagtgcctttcatttggagatcatatcactgtcctgtgcttttgaccttgttagttggtctgacatacttgttttcttccctttagctgaatgaataatttataatctctggaaagtataaaaacccaatgtactcttatgtaatttgtgtttaaatgtaaccattatgatgtcctgtgcatactatgttaatgttttaaatgatttttgaaaggcttaaaaagatttctctctacaaaatttataaggctgatgtagtagattgttaagaggaaggtttcttacatttgtaactctccctttgtatatttcgaatgtttgagagggggagttatattaaaataaaactttcaaatagccaagggaatttgattggttaaatatgcaaatgatgtttaacatgaaacattactcctggccaggtgcggtggctcacacctgtaatcccagcactttgggaggctgaggcgggtggatcacaaggtcaggagattgagaccatcctgactaacacggtgaaaccccgtctctactaaaaatgcaaaaaattagccaggcgtggtgacgggcacctgtagtcccagctactcgggaggctgaggcaggagaatggcgtgaacccaggaggcggaggttgcagtgagccgagatcgcgccactgcactccagcctgggcgacagaatgagactccgtctcaaaaaaacaaaaaaaagaaacatcactcctgtaatcccagcactttgggaggccaaggttggcggatcacctgaggtcaagagttcgagaccggcctggccaacatagtgaaaccccatctctactaaaaatacaaaaattagctgggcttggtggcgcaagactgtaatcccaggcactcgggaggctgtggcagaagaatcgcttgaacctgggaggcagagtttgcagttagctgagatagcgccattgtactgcagcctgggcaacaagaatgaaactccacctcaaaaaaaaaacacaaaaagttaatgattatactttaaaaaaaattttactgaagtatgaattttatcaggttaaaaagagccttagctctagatttaagagcataattgctgggtcatatgtgtatggctccagcttggatggaaagttctgaattgttctccaacactcccactgcaaccccaccacacattattccatagtctgccaacacttgatggtgtgaggctctctgcttgttcccaacctgacgactataaaatgatatctcgaccaggcgcggtggctcatgcctgtaatcccagcactttggaaggccgaggtgggtggatcacctgaggtcaggagttcgcgaccagcctggccaacatggcaaaaccccgtctctactaaaaatacaaaaattagccaggcatggtggttcattcctgtaatctgagctacttgagggggctgaggcaggagaattgcttgaacctgggaggcggaggttgcagtgagctgagatcacgccactgcactctagcctgggcaacagagcaagactccatctaaaacaaaaaataaataaataaaatgatatcttatgatggttttaacttgacttttcctgattattagtgaaatttccatttgtcttttatgataatttttatgttgtctttttcttatacatatatattctggattagtcccttaggagagttagatgtgttgcaaatagcttctcctagtttatgcagattttttacttttcttttttttttttagtatgtcttttgatcagtagaagttttatattttaatctcgttcagtttattagtcttctcctttatagttggtgcttaggttttgaaatatcaagtaccttttggtaatttttcaacagcttagcttatatggcacaatgcatttcatatgtacatatacaaatgtcaaaattataaatatgcctaaattatacatctgtaactagccttaaatattgtaattaaaactgtataattaaactaagcatgcaagccaatagtttaaaaaagagtttcactccagtttggtactgatttagctcttgagctattgaaatcaatggccagcatatgaagcaattatctgacgcttgtgggtggtgaccttgcagcagctcagcctcttctttcatttcatcctatttttgtccttaatagcagatatttatctcagtttaaaattttattattttctttataactacaatcttaacagtttaaaatagtactaaatttcatgtggaaagaaacttcagattctcagcaccttatcttccttagcgatttccactctagccctcaatgttattaggtaaactcttatctcaattgttgttttcactgagtgctatctaaccataatgaaaaagggaaaaaaaatagagtccgaattatccataactgcctctgctttctgagaaaggcaacgtgattctttttcagtggaggaaaaacctctctatggacttttttcaccccataacagagagattagtgggagaaagagaagagcttgagattcctgtctatcagggcctttggaaattcaaattgtgtcccagagctgaattctccaaaagaatgtacagagatttggaggtgcgggggagagagggctaaatagtttggcgggaggctggaagctgagctggtagatagggtcagaagactttttaagaacaaagactggagacttgaggtgactccatcttcactattacttcagatctttcttataatgtgcttcataaacacacaccttgtgtgaaagctgcttttgagaaaaagaaacgtattttatgcgacgcagggtgcaacaggagcggcgcatgtggggcagtgagaaattccttcccctgacccgattcagcagtgaaggtgatcagagcaaataggaactggactgcttcacgctcctcaaggactttaaggagtgtgtcttccaccacccacagcaaagggctcagaaaattttatctgaacctcctgacatctgagttatacaaactaagacaaagaatgggaagcacatagcagccactggtccattacagttctaaagtccagccaggcgcgtatttacccgagatagaaaatgttccttagtcagggtctagtactgctcactggaagtaattccccgatccactctttttttgaggctctttagttcatcctctgtgctcttggctctgccctccaagttgtccttcattttcattagaagtagctttcacaatctgctgcttgcccctaaaaactggggacccagagagttcatttcattttgaaataatgtccctgctccatttagttagagctggctttagcaagtatgcagcaggggactaatatccagaatttagaaggaattcaaatgactcaacgacaacaacaaaccaataattccattaaaaagtgggcaaaggacatgaatagacatttttactttcttttttgtttgtttgcttttgagacagagtctcactctgtcacccaggctggagtgcagtcgggtgatcttggctcactgcaacctctgcctcccggactcaagcaattctcctgcctcagcctcccatgtagctgggaccagaggtgtgtgccaccacgcttggctaatttttgtattttcttcttagttagagatggggttccgctgtattggccaggctgatctcgaactcctagttaagtggtccacccgcctcggcctaaagtgctgggattacaggagtgagccatcgtggccggccaaatagacatttttcaaaagaagacacacaaatgaccaacaagcatatgaaaacatgcttaacatcactagttatcagagaaatgcaaattaaaaccaaatgagatatcatcttacaccaatcaaaatggctattattattattattttgagatggagtcttgctctgttgcccaggctggagtgcaatggtgcaatctcagctcactgcaacccacgcctccccggttcaagcaaatcccctccttcagcctccctagtagctgagattacaggagtgccccaccacgcctggctaatttttgtatttttagtagagacggggtttcaccatgctggccaggctggtcttgaactcctgaccttgtgatccaccagcctcggcctcccaaagtgctaggattacaggtgtgagccatggcgcccagcccagaatggctattattaaaaagacaaaaagtggcagatgttggtgaggatgtggagaaaagggaatggcttacacattgctggcagaaatgttaattagtacaacctctatggaaaacatcatggagatttctcaaagaaataaaaatagaactacaattcgatccagcagtttcgctactgggtatctacacagagtaaagaaatcattttataaaaaaagatacctgtactcatgtatatcacagcactcttcacaatagcatagatatcagcctaagtgtccatcaacaaatgataggtaaaagaaaatatttgtctatatacacaatggaatgctattcagccataaaaaagaatgaaatgatgtcttttgcagcaacgtggatggaactggaggctatgatcttaagtgaaacaactcagaaacagaaagtcaagtactgcatgttttctctcataagtgggagctaaccggtgggtaaacatggatattgagtatggatgatagacagtggagattaggaagggtggtgagatagggagagagaatgataaatcacttggtggtacaacctatgttatttgggtgatgggtaacctaaaagctccgactccaccactacacaatgtattcatctaacaaaattgtaccacataaatatatacacattttaaaaatttaaaaaaaagttctgagttcttgttgagtcttattgaggatcacaccatagcagaaggactacatccataattctttctaagatgcgcttttctgtactttgggccacatgtgaggctgctatggtaaatgctcttaagattcttagaagtccaactgtctagttgagaaagtctactaggtgctgccttaaatcttatagaagttttaataagggatcttggctgggcacagtggctcacacctgtgatcccaacactttgggaggccgaggcgggtggatcacctgaggtcaggggttcgaaaccagcctggccaacatggcgaaaccccgtgtctactaaaaatacaaaaattagctgggcatggtggcacatgcctataatcccaggactcaggaaactgaggcaggagaatcgcttgaacccaggaggcaaagttttcagtgagccaagttcatgccactgcactccagcctgggcaacagagtgagactccatctcaaaaaaaaaaaaaaaaaagatgggcattttaccttattaaaatagtaatcataagggagcttatagacaaaccttttttttaatgtttacttaccttggccatttcttactttgagaatgttttgctggccggagatgctgtcctgggccctctgtttcttcttactgctgcctaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttattctgcactttcttcctgcactttgtaactttcttcctgcacttcatcactttcttcctgcacttcctgcactctccattcatctctttcttcctgcacttttaacacaggtaaaagaagccaattgtactttcaatattttacctaaaaatctccttattcagatcaagttcattagctatattttatttctgtctttcatgacattacaggtgacaatgtggccaaaaatctcactactatgtaacatcttttgtcacgcttccaaaagcaattttctcactgctattgcaggcttcctaacaatttcctcactgcccttctagcctctgctgcctcccaatatcagagccaatgacaaatgttttagggtttggttatggcagtatcccacttccagatagcaatttctgtttcaattatctactgctgtgtcataaacccgcccagcatttagtggcttaaatcaatatccattttattgctcacaattctgtgggtcaggaatttgggtgagggctgatggcaacagctcatctcagctccagtggggctaactgggaaagatccaagctgtcggccggctcgggcaccttgattctcctgtctgtggcctctcatcatccagaccctgttcctttccatgtagcgtctccaacaggacacgctggacttctttacacaccagctggcttccaagaaggcagaaacagaaactgctaggcctcttatggcctaggcccagaagtcacaatgccacttccagagctttctgttggttagatcaagtcatgaagccaatctatattcaagggaaggggaaagatatttcatttctttgctgggaatgatacatcacaaaacagcatgcaggataggatggattggggtgaccatttttagaaaggacctacctctcagaaagaggcaaaaattcatgaactgaaatactctctgagacaatctctattttatagtctagcaataaaccagaagttcaagctctgctctctggctatgtaagcaaactgaggtcagaaaggagttcaagcaacaacgaattgatacaaggctgctgttacaagattctcatctatagtggtttggtctttgctcgagcattttgagagacaaactgcctccaaaggagacctgttccacaattgaataattctaaagtctataacaatcttccatttgcaaagttcaacattgcctttctgtgactcctcccatggtcagatatctgccctccaaggccactgaaagaaaggctactccctcctcaatatggcattcatttaaatctaaatattttcagacacttttcttgactcaagacttcctaacttctttacctgtctatcatgttaagtcattatttcccagaaacatgtgtttatgtataacacatacaatccatagaataaaatttgcccagaatagtatgtttaagaggaaagaaaagtatgtaatagattattgaaagtttcaaaatatctggtggtacaatgagtgagttaaacatttatctggcttaaccattcagtttgatcttgtggaaatccagtgcttggaacttatcttgtcctaactttttcataacatagtcactgtttacctgaataattgtctaaatgtagtgtcctttatggttggttagtattcactgggtgatggggaaaagaaatacataaatcctgagaaaagctgaaagcaaagtttattcttacaaatgacaaaaaatgcccagatacaacagactctctgtttgatgtgtgtgtgccagaatgaaaactatgggtctgaggcaccttctttttaaaaaaaaaaaaatttttatttgcataggtttttggggaacaagtgatatttgagtacatgagtaaattctttagtggtgatttgtgagcttttggtgcacccatcatctgagcagtatatactgcgcccagcgtgtagtcttttatccctcaccccctttccacactttgtccctgagtccccaaagtccaatgtatcattcttatgcctttgcatcctgaggcaccttcttccataagcaccatccagaaggagaagtggttcttcaactatggctgatgggagcaaagtgctgaagcaactatgactggttgaaagaccatttctcctgtgaatggtgcttatggaagaaggtgccttagacccaaaactagagtgaggcttttattggttggggaaggtggctataaaaagataagaataatgaaaagctatgaccaattaaaaaaaatgagaacttaatcacagccttatcgacccacaaccaggggtccacaaatagccttaattatgacttatgttattaagataacaaccccaaattttccgggcagcaattttttggtgccaatattttggtcttttgcttccaaagactagccttttgataaagtcagacagctctaaaatgtatgtgtttaagttctataaatagacatacatttgaggatatatgaaaggagcaaagtatttatctcaccacacagttaagaattttaaaaacattcattgttggatagtgatttttaaaacattaaaataagtggaacgattgctttgaatttatgaagaataacacatataattaatgacttttctatttgtattatacttgcttagatggttcaggcttagtaagaaagctattgatagtagaaaacaatgtgtatatgtaataataaagaaataacgtggattgttagtgaatagaaaatagtccttttggccaggtgtggtggcttatgcctgtaatcccagtactttggaaggccaaggcaggaggatcacttgagccaagcagttcgagaccagtctggttagcatagtgataccctgtctctacacaaaattaaagtaaaaaaattatctgggggtggtggcgcacacctgtggtcccagctacttgggaggctgaagtgggaggatcccttgagcccaagaggttgaggctgtagtgagccttgattgtaccactgcactccagcctgggtaacagagtgaaatcctgtctcagaaagaaagaatgaaaaaaagaaagaaagagagagagagagagagaaagaaagaaaggaaagaaagaaagaaagaaagaaagaaagggaaagaaagagagagagagaaggagggagggaaggagggaaggaaggaaggaaagaaagaaggaaggaagggaggaagggaggaagggaggaagggagggagggaggagggaaggaaggaagaaagaaagaagtggatatgttttggatgtttatcccctccaaatctcatgttgaactgtaatcccccatactggaggtgggacctggtgggatgtgttggatcgtgggagcagatccctcgtgaatgacttagtgccatccccttgataatgagtgagttcttgttcagttggttcacgtgagatctggttgtttaaaagagtctgggacctcccccttctctctctctctcactctctctctcaccgcgtgaccctgcgtgccctgatttaaagcttcctgaggcctcaccagaagctgagcagatgctggtgctgtgcttgtacagcctgcagaaactgaaccaaaaaaacctcttttctttagaaattacccaccctcaggtattcctttatagcaatgaaaatggcctaacacaatagtcttttgactatatttagtttgaagatagttccagatatttccctacattactttctcatctttagtgagcaaatggtatactgaaactagatagtgatggtggtgcgacaatgtgcgtgtactaaatgtctctggattgtacacttaaaatggttaaagtggtaaattttatgttatgtatattttaccaccacaacaaaaaaaacctttcttttttttttttttctttttttttttatttgagatggagtcttgctctgtcgcccaggctggagtgcagtggcacgatctcagctcactgcaacctttgcctcccaggttcaagtgattctcctgccttagcctccccagtacctgggattacaggcacacaccaccatgcccggtttatttttgtatttttttagtagagtcggggtttcaccatgttggccaggctagtcttgaactcctgaccttatgatctgcccgcctctgcctcccaaagtgctgggattacaggtgtgagccaccacacctgaccaaaaataacctttcaaaacaaacaaaccaacaaaaaacacccatagttcacctaaatatgcctgaaaatgtactttgcagggaacctaaaatctgggatttgaagtaaaaaaggataaccccaagttgaatttgttaagattgcccaccttttctttgctgacaactggcaaatggtttgctaacttctgggcagatgagagttcagtcagcacaatcaacaaagaagtgacgttcactcgggcccaggcaggcctatgtgctgggagcttttggaccttaaattggtctgagttcactgttgctccagttgcagacaggagcaggcaggttcaagagtttctgatgctttgctgtccagcagtcagctgaccatgagcacagccggcacaagcagccctttatgctggtgagaatcctgccagcagtgctgaggcacaatccctcctttatgtgttccctttgcacatttgtattcttggggcctttgggatttttgttgctgcagataatgggaaatgggtgtcggtgggtgttacgagcagggttttcagtagactaggaagaacaactggttaaaaataaaataacaatagtgacaaataggaaaggtgggcaacctcaggcagtacagctcctgagcaaatgcttccagcttttaccctaaaacataagcaactgggcacaactccaggccttgactgtctcattggctgataggaataactactaggaactattaagattacctgatattctggccttttcataattacagtgcagcctagttgatgttgttggaacatgatggttctttgatagaaaagtctctactttcattacaaatggaaagtgcaaatcagaagggtttgtaccatttggggttaggatccaaaacatttgttccaccaagggggaaaaggtccaactacaacaagttatcttgagattgtccagggtgttctctaaagccctaaatccaaaacttttccttttttgaggcagactctcactctgttacccaggctggagtgcagtggttccatctcggctcactgcagcctccgcctcccaggttcaggtgattcccctgcctcagcctcccgagcagctgggattacagacgtgtgccaccacgcctggctaattttttgtatttttattagagacgcggtttcaccatgttgtccaggctagtctcgaactcctgatctcaagtgatctgctggtcttggcctcccaaagtgttgggattccaggcgtgagccatcatgcatggcccctgcatctgaaactttaatgtgcatgcggattcaaatggggatcttgtcaaaatacagtttctgattttgaagattttgcatttcttttttttatttttatttttattttattttttatctttgagatggagtctcgctctgtcgcccaggctggagtgcagtggaacaatcttggctcactgcaagctctgcctcctgggttcacgccattctcctgcctcagcctcccaagtagctgggactacaggcgcccgccaccacatctggctaattttgtgtatttttagtagagacggggttttacagtgttagccaggatggtctcgatctcctgacatcgtgatccgcccgccttggcctcccaaagtgctgggattacaggcgtgaaccaccacgcccggccgaaaattttgcatttctaacaaggtttcagggagtactgatgctgcaggtctgaggaccacacttcaagttgcaaggctgtcaggaagtgagagctagctagggggaaactagcatcatttcagttaggtctagtattgctgctaatttactgaaagttttaaaatgtagcttttctgtaaagaaacaaacaggacattctaactaaacaaagtgctgtgaaatcagtcattcacactgggtagctagagctactgtgtctcaactggaggaggcaccatctccagtggatcatttagaaacgtagagggtggctactggtatttggtgcctgggggcccagggcactaaatgtctggtaatgtgtggaagagttctgcacaaataattgtcccactcaaaacgccaagagagcccccctgccccgccccattcaggtacccgagctacaccagtggagatggaggctgcacccatacctgagacctcagccaatcaattctatggccatctccttgagtgtgtcatctggaatagaagatcctgcccatgtattgtagctcatctctttagaactttgactgcccttggaattctccagtgggaagagtggcctctgtctagtgtaccacatgtggttccatagcttgatgtattctctcagcaaaggatgagatcgacaggaaaggcttcaggaagccctacggaatttggattcatcaacattttgaatcaaaaatcagaaaagggaacatccagtgttccccttgagacgataccctcaagtgctgctggtgctcacctcctaaactcctaaacggggctgtgaccagcttgcctagtgccaacgacaacagctccaaggcatctgggcctatcaaacttccactgcgttcttttccacaaaagaaagaatcccacagcgctagatttgctggccatcatgtcaaacaaactctgacctctgatcccaacacagtgttgaacattacaatgaggatgttagaaattctgctggagactgagttgaggtaaaaatagatacaggggctgggcatggtggctcacacctgtaatcccagcgtgttgggaggctgaggtggaaggattacttgaggccaggagtttaagaccagcctgggcagcatagcaagaccctgtctctaaaaaaaaaaaatttttttttttaattagctgtgtgtgtttccacgtgcctgtaatcccaactactcgagaggctgaggcgggaggattgcttggtcccagaagttggaggagtgcaatgagctgtgatcccgccactgcactccagcttggtcaacagagcaagaccacatctctaaaaacaaagacacagatatgagaaataaaatagggatgaaaggaatgagttaagacaatgttagagaaggatgacgtagtaagaaacctgaagataacgaaaacccacattaacctaatgttgcagaaaagagggcttcatcattgttgtctgagaaacttgtgagtaaaagacaaaaataatacatattgtgagaaatacattcaatacaatataaggaaaatattctttagcttcttgagactccatgaagttcaagagttaggaaattctgaaaagggtttggcagggtcatagtgattccgtctggaaagggtttgtttgtgcttggtctcagggctgctaggaagatgggaaatgtctctggcactccaggagagcaattactctgtgccatgacttcatgtgccccctcaccatgatgcagtgccccatgggagatgttctgtcactgatcccactgtctcactacattccaacagtccaaaagacaggcaaaaatttagactgataactttttttattagtctgatttaaaaattagttacacaagtaaaataatgtctgtatcacactcataatcacgtgtgcacatgaaaatgttagctcagaggaggttgaatgcttctccagtgcagacttcctggaaagctggaaagctgggcaatggctcaggggcccctgggcacagcactgtcttctcctgaatgagaatcagctgtgctgatgcctacgttagttcaagaaccaggagctgcataaacaagcttttgagaagtatgccagaagaagctcagattgatgatggtgtgtttgacaaaattaatgaagccatgcttattagactgaaagataagattccaaatgtgagaatacaggcagttctggcgctttcacgacttcaggatccaaaggatgatgaatgcccagtggttaatgcatatgctactttgatcgaaaatgattgatttgaatccagaacttagacaggcagtgttatcatgtattgcaccatcagcaaagactttgccaaaaattgtagggtgcaccaaggatgtgaaagaggctgtcagaaagctggcttatccggtgttagctgaaaaggttcgtatgagagctatgtccattgctcagacagtaatgctccctcaacaaggttttaatgagagatgagatgctgtgaaacaagctatgtggaagcatcttctccaaagctggttatggttctctgagggaaatatcttcgagtggcttcagcagttggatgtagaaaattctgaagtggcagtctctgtcctcaatgccatgttttcaatgactcctctcagtgaactggtggcaatctgtaaaaacaatgatggcaggtacataaaggattcattctttgaaatgtaatactgattaacttctacaattaatttgttttttttcctccccatagcttaagattatattaatatctttaatcttacctcccttttgttttcttttagtctgatgaatatcttctttcccttcttttttcccctcctggtgtaagaactcattactttatcttagactatctactttagctgtggttttctacccctcggtttcttactttgatttttgaattagcctaccatgagaaaatccagcaacatgcacccctagtatatgtttgcttatttggttcttttttgttctaagttccttcattcctttctgtgttaatgactctaattaaaaggatagtggttttaaagcaaatcttcttattcttatttatgttctcttcaatttgtaatgatataaagatcatgctttctcttacactctttcttttaagtgaaggaaattgattctagtggaaacgttaactcctgaaattgctttgtattggtgtgccctttgtgaatatttgaaatcaaaaggagatgaaggtgaagaatttttagagcggatttcgccagagcctgtagtatatatagactatttactgaggtaaatttttttttcttttagtttggagaatgcttgtgttgctgcaactgttaacctcccagcccccttcctcgaggtcatgcttgattgtgaatatgttaaaaatcctttttttttttttgtacatgccgggatagttatatacattgagtctttttgaatatcttgtatatcttgtgctggtctgtataatgaaagagcaaatcatgtttaggatcatttcttcaaaactattaagatatgattatgaacatttctgcatatacagttgataatgatgatgtattatttctgaaattggttggcacattttctgttaagtgccagataataagtatcttagggtcttgtgggccataccatctgtcaaaaacaaaaacaaaaaacaaaaaagaccaggagctggttggacatttgtgaatgttctcttgccctacttcgactctcacttctcttaagttctgtacctcgactacacaaatcagaggctgccagcagatggatgtgtgcacgtgtgtgtatgaatgtacttcctgtccacctggaacttacctgcaaaaatccttgccacaatttggatgtgcagagaaagtgttgtttcttattttctttatatcctttcttgccttcctcaggtactacctattaccagcaggaaaacaaagcaaacaaaccaacagaacccaggaaaatggaaatggcccacctgatttaagctttagacatacacaatactttattgtacataagtgtcaaatgaaattaaaaacgaggaaaaaaagacatacacaagactttaaatggctccgtgggcactgtccagccctcagcttggatccgtctggctatccttgtatgtggtggcattgctttgggtgtcagggacgcccttggctgcttggcttctggactccctgcttacttatgagctcaggcctggggctggggggttcatggtgggacccgtgggcacaggaaccactcttgtggggcatagcccccaatggacccagattagacccctctaagtgcctgtagtgccatccatgcaaccacctccagccctgcctcagcctgacctcgctctagcaccatggacttggggcccacccagcggctctcagccacccctttcatgctgggactttgtgagggacactcagcacctacatcaggctgatcgcctcgccagactcttcctgctctttttttatccaccacgctgtagactgccgaggtagacttttctttacatttcctctgtgacatcttccccctaccacttcagagaaagccctgaggcccagcaggtccagcagatggatggaaggactctcttcatctccactgtaagaaatggtttaagctgcaaggcatacctagaccattcaaatagcagctgaaagaatccaccaaatccacaaagcacggatttcaagcctagcctcttgacaagagagaacatacctgctctcggccccaggcaataaaccccttgacttgattttgagatgaaagaggctagaaggaaatgtggcataaggacaaaaggcactggttaaatatttgtagactattctttccattaccactgttctatagagtcttgaggagaaaacaagacaaagcaacaaataattatataattcagtagctgcaatagataaagagaaccattaaaagaataggttttctcaattataaaatgaggcattaaccaaattttgaatattaactatatatttgactattcctggacaactagaaggctggcgattgtacatgcatttgtatttgccagttgtgtgtcttcctcctttcaacctcacacagctaatttatgttgaccctcaaaaaagaaaatgagtacttgaatgtcaaggcatgtgactttcattctaggacatatagtaacttccagagcactgagtcagcagtctaaaggtttagccttcatactcctgacagctgtttatttctttcagtgtaatttcagagaaacatatccagaagggatttgctgccctagatctatcagaaaacatatttaagatattctgtagttttatagcacaaaaatctaacactaaataatcacatcataacagggtttcaatttctgtaataatttatcttaaatcaggcacaagggtatttaaagcacacaactaatactttgtagagatttaatgagatgatgtatgggagcagtaggggctgagacatttgtttccagtactattttaaagcaataagagaataatagcatttgaaataacctttccaatctattggattcaggcttctgccttctgtatctaaaaagaagcttagtcactggcttctggtagatgagtaggacttctcaaagatcaggaaggcttggggtcatagctggtgatgcataaagggccccaggtcaagaagtctaagcccatcaggctcagattgaaaccaggaacctgagcgacaggccaaattgggacttaggaggtcctctaggcaaaatcagtccctgaaaaggaagattggagcagaaaccagtggctccagcaggtgggagagagcagacagcagttttcatccacaaggtaactggttgctttgatagcagctctgcctccctaagtgcttcagatatgaagcaactcctaagaaaagaactagaattaaaactatcaaaaattacaagaattaaaataatagagtagaaagtatctatttattacaaaagaaagcaatgaaaaggaatagtcacgagactaacaaaatgaagtcatgagcatgacaaataaatattgaaatggcagatataatttcaaccatacaaataataacattaaatgtgaatggattagacaccccaatcaaacgacagagattgttaagactggatttttttttttttttttgagatggaatcttgctctgtcgcccaggctggagtgcagtggtgcgatctcggctcactgccagctctgcctcccgagttcaagcaattctctgcctcagcctcctgagtagctgggattataggcgccccaccaccacgcccggctaatcttttgtatttttagtagagacagagtttcaccatcttggccaggctggtcttgaactcctgacctcgtgatccacccgcctcggccccccaaagtgctgggattaccggcgtgagccaccgcgtctggccaaggctggattttttaaaacaagacccacctagcagggtgtggtggctcacgcctgtcatcctagcactttggaaggccgaggcgggtggattgcctgagctcaggacttcgagaccagcctgggcaacacggtgaaaccccatctctaataaaatacaaaaaattagcccggcatggcggcgggcgcctgtagttccagctacttgggaggctgaggcaggagaatcacttgaaccctagaggtggaagttgcagtgagctaggatcgcaccactgcactccaggctgggcgacagagcaaggctctgtctccaaaaaaaaaaaaaggccgggtgtggtggctcacgcctgtagttccagcactttgcgaggccaaagagggtggatcacgaggtcaggagatcgagaccatcctggctaacacggtgaaaccccgtctctactaaaaaaattagccgggtgtggtggcgggcgcctgtggtcccagctactctggaggctgaggcaggagaatggcgtgaacccgggaggcggagcttgcagtgagcccagatggagccactgcacttcggcctggatgacagagcaagactccgtctcaaaaaaaaaaaaaaaaaaatcaaaaaacaagacccacctagtatgtgctctttaaaagagacgtgactttgattcaaagagtttcgagataaaaggatggtaaagatatctcatgcaagcattaactttgggagagccaaagtggctgtactaatatcagagaaaatttaaacacaaaggaattacttaatttaaaaaaaatttaagtgcatagtttagattaggaaatcaatctttgtggtgcgcagtactatgggttttggcaagtgcatagtgtcatgtatccaccattacagtactgtacacagtcgttttaccatgccccaaatgccttctggtacaactattcattcttcccgttccccagtccctgagcttctggcaaccactgatctttttcactgtctatgattttgcgttttccagactgtcaaacagtattgttgccttttcagactggcttcttttacttagcaatatacatttaaggttccttcatgttttcgtaatagctattgacagctcatttatctttatcactgaataatattccattatatgaatataccacagtttttatccattcacttgttgaaggacatcttggttgtttccaagttttggcaattatgaataaagctgctataaacatttgtgtgcaggttttggtgtaggcatatgttttcagttcatttgggtaaataccaagtagcatgatggctggatcatatggtaagagtatgttagcgtttgtaagaaactgtcaaactgtcttccaaaatagctgtaccattttacattcccaccagcaacgaaagagagttcccattgttccacatacttgctatcatttgatgttgttagtgttttggattttgggcattctaataggtgtgtagtggtagctcattgttgttttaatttgcagttgtcttatgacatattatgtcgagcatcttttcattgcttatttgctgtctgtatatcttcttaggtgaggcgtctgtttagatcttttgtctatttaaaaattaggttgttcattttcttattgttgagttttaagagttctttgtatattttagatacagtcctttattcaatatgtcttttgtaaatattttatcccagtttctcattctcttgacagtgtctttcacagagtagaagtttgtaattttagtgaagtccagtttattaatttgttccttcatggatcatgcctttgtgttctaaccaaagagttattaccattccgaaggtcacctaggtctgctcctaagttttgcattttacatttaggcctatgattcactttggggtaatttttgtgaaggatataaagtccgtgtctagatgcacttttttttgcatttggatgtgtagttgttaagcaccttttgttaaaaagatggcccggtgtggtggctcacacctgtaatcccagcactttgggaggccgaggtgggcagatcacaaggtcaggagttcgagaccagcctggccaatatggtgaaaccccatctctattaaaaatacgaaaattagctgggtgtggtggtgcatgcctgtaatcccagctactggggaggctgaggcaggaggatggcttgaacccaggaggcagaggttgcagtgactgagatcgcaccactgcactgcagtctgggtgacagagcgagactctgtctcaagagaaaaaaaaaagagagagagagagaaagagaggacattggggcctataggcacaggccaccatgcctggctaatttttgtattttttgcagagatgaggtgtcgccatgttgtccaggctggtctcaaacttctaggctcaagtgacttgcctgcctcggcctcccaaagtgctaggattacaggtgtgagccaccacacccagactgttgagaatttttgtgtttatgtctgtgaaaaacattggtgtgtgattttgattttttgtaatgcctgtgtctggtttttatactagggttatgctggccacatggaatgatttaggaactattccctctgtttctattttctagaagagattgtaatgaattggtatatttattccttaaatgtttgatagaattcactaacgaacccatctgggcttggcgcttactgatttgaaggttatttgttgttgttgtttttccaactttgttgagatataattggcattaaaaaaactgcatatggcctggcatgagggctcatgcctgtaatcccagcaatttgggaggccgaggcaggaggattgcttgaggcttggagtttgtgaccagtgtgggtagcatagtgagatcctgtctttattaaaaaaatttcaagataaattagctgggtgtgatggcacgcgcctgtagtcccagctactgaggagattgaggcaggaagattgcttgagaccaggcatttgaggctgcagtaagctatgatcaaaccactgcagtccagcctaggtgacagagagagacactgtctctaaaaacaaaaaaatccaaaacaaaaatctcccccaaaaaactgcatataaatttatgcatacaatttgatgattctggacatatgtatatattcatgttgctattgctgtaatccaggtaatacacgtatctgcaactttccccgtgtcccctcttttttttcttcataagaacacttaacatgagatctaccctgttaacaattgtttttacgacacaatatcttgttgttagctatggacagtctattgtacagcagatctctggaactcaccgatcttgtttaactataactttatacccactggataacaactccttttttctccttcatgccatccccaggtaaccctcgttctgttgtctaattcaacacctttgactattttagatgctcatattagaggaatcattagtatttctctctctgtgactgaattatttcacttagcgtcatgtcttccgggtccttccacgttgtgacaaatggtaagatttccttctttttaaaggttgagtaacgttgtgttgtatgtctatgtcacattttctttatccattcagctgtctatgaacatttgggttgtttctacatcttggctattgtaaataatgctgcagtgaacacaggaatgcataaatattttctcccattctgcggggttgcttttcaccccgcggattgtctcctttgctgtgaaaaagctgtttagtttgatgtaatcaaacttttctatttttgcttttgttgcttgtgcttttgatgtcatatccaagaagattattgccctgaacaatgtccaaaagcttttccttgggtttattctagtagttttacagtttcaggtcttacgtttaaatctttaatctattttgagttgattctcatatatggtgtgagataaggtccaatttcattattctgcatgttgctattcacttttcctggtaccacttattgaggagactatctttttctgcattgtgggttcttggcacacttgtcaaagatcagttgaccatagatgtgtggatttatttctaggctctctattctgttccattggtctgtctgcctgatttttattccagtacaacactgattactgtagctttataatatattttgaaatcagtaagtacgatgcctccagctgtgttcttcttgcttaatattgcttcagctatttgggatttcttgtggttctatattttttgagatttttttcctctttctgtaaaaaaatgtttaccgtattttgatagggcttgcactgaatctgtagattgctttgagtagtatggacatcttaccaatattaagtcttctaatccatgaacaagagatgtcttcccatttatttgtatctgtcttaatttctttaatcattgcttcatagatttcagtgtgcagtctttcacctctttggttagggttattcctaatattttatctttttggtgccattataattaggattgtcttctttttttaatatactagttggccacatagatatcttcttttgagaaatgtctattcatgtcctttgccaattttttaacggagttttttgttttctgcctaatttaagttccctacagaatctggatattagacctttcccagatgcataatttgcaaatattttctcccactatttactctgttgatagtttcttttgctgcaggatgctctttagtttaattaggtccccatttgtctatttttggttttgtttcaattgcttttggcatctttgtcatgaaatcttagccagggcctatgtccacaatggtatatctcaggttttcttccagggattttatatttttaggtttttcattcaaatttttaattcatcttgagttgatttttgtgtatggtgaaaggaaggagtccagtttcaatcttttgcctatgcctaaccagttatcccagcatcatttattgaatagggagtcctttccctattacttgtttttgctaattttgttaaagatcagacggttgtagctgtgccgctttatctctgggtcctttgttctgctctttttttcttcgagtctatttttgtaccagtatcatggtgttttggtttctacaaccttgtagtaaagtgtgaagtcaggtaataggatgcctccagctttgttctttttgcttaggattgctttggctattcgggctcattttggttccatatgagtttttaaatagttttgtataattctgtgaataatgtcattggtagtttgataggaatagcattgagtctgcaaattgctttgggcaatatgacaattttgacaatatttattcttcctatccttgagcatggcatgtttttctatttgtttgtgtcatctctgatttctttcagcaattattcagtaattcagtaattattattgtagagacctttcacctctgtggttagctgtattctgaggtattttactttttgtgtgtctattgtaaatggcattgcattcttgatttggtgttactggtgtaaagaaatgctactgatatttatacattgattttatatccttaaactttggtgaagtagtttatcagttctgggagctttggggcgaagactatggggtttgctaagtataaaatcatattgtttgcaaggagagatggtttgactacctcttttgctgtatggatgctttttatttctttctcttgcctgattgctctggctaggaatttcagtactatgttgaataggagtggtgggagtgggcatccttgtctcgttctggttcccaaggggaaggcttgcagctttggcccattcagtatgatgttggctgtgggtttgtcatagacagctcttactattttgaggtatgttccttcaatgcctagtttgttgagggcttttaacatgaagggaggtttaattttgtcaaaagacttttctgcatctattgagatgatcatgtggtttttgtctttagttctgtttatgtaatgaattacatttattgatttgtgtatgttgaaccaaacttgcatcccagggataaagcctactttatagtgctggatttgttttttgatgtgctgctgaattcagtttaccattattttattgagggattttgcatctatgttcatcagggatattggcctgaagtttcccctttttgttgtgcctccaccaggttttggtatcggaatgatgccagcttcatagaatgagctaaggaggtgtctctcctcctcaattttttggaatagttttagtagaattggtaccagctcttctttatacatctggtagaatctttctggcccaggaccctctctggttggtaggctttttattactgattcagtttcagaacttgttactgatctgttctggttttaatttcttctggattaaatcttgggaagttgtttccgagaaatttatccatttttctaggttttctagtttgtgtggtaatgtcccctttgtcatttctgactgtgtttatttggatcttttctcttctttcctttattagtttaggctagtggtctatcgatcttatttattcttgcaaaaaaaccaacttttggtatcgttgaccttttgtgtgttttattgtgtctcaatttctttcagtttggctttgatttttgttttcttttcttctgctagctttacggttagtttgctcttgtttttctagttcctctaggtgtgttaagttgttcatttgaggtctttctaactttttgatgtgggcacttagcactataaagtttcttcttcacactgcattagctgtttcccagagattctagtatgttgtatctctgtcttcattcgtttccaagaatttcttgatttctgccttaatttcattgtttacccaaagtcattcaggagtagattgtttaatttccatgtaattgtatagttttgagcaatcttctaagtattgatttctatttttattgtgctgtggtctgagagtgtggttggtatgattttgtgttttatgaatttgttgagcattgttttatggtcgagcgtgtggttggtttttcagtatgtgccacctgcagatgagaagaatgtaatgtatagtctgttgttggctggagtgttccgtagatgtctgttaggcccatttggtcaagtgtcgagttcaggtcttgaaaatctttgtcagttttctgccttgatgatctaatactgtcagtggagtgttgaagtcttccactatttttgtgaggttatctaacaaaataggtctctaagagcttgttttatgaatccagtgctccagtgttggatgcatgtgtatttaggatagtaaagtcttgtggaaattaaaccctttatcattaagtaatgcctatctttgtcttattttattgttattgatttaaaatctgtgttgtctaaaattagaaaaggaacccctgctcttttttctttccatttacttggtaggtttttctctatccctttactttaagcctatgggtctcattgcatgtgaggtggatcctctgaagacagcataaagttaggtcttgtttctttatccattttgccactctgtgtcttttaagtggaggatttagcctatttacattcaaggttaatattgatatgtgcgatttgatcctgctgttgtgttgttagctggttgattgtatagttgttttatagcatcaatggtctatgtacttaagtgtgtttttgtggtggccagtaacagtgtttcatttccatgtttcgcactcccttaagggcctcttgtaaggcaggtctggtggcaatgaattcccttagcatttgcttgtctacaaaggatcttatttctccttcactcatgaagcttagtctggctggatatgaaattcttcgttggaacttcttttctttaagaatgccaaatataggaccccaatctcttctggcttaagggtttctgctgaaaggcccactgtcaacctgatggggttccctttgcaggtgtcctgccccttttctctagctgcttttaatattttttctttcatattgatcttggagaatctgttgactatgtgatttggggatgattgacttgtatactatctcacaggaattctgtgcatttcctgaattctaatgttaacctttctagtgagttttgggaattttttaaaaatttatttaagttctcagatacatgtggagaacgtgcagatttgttacataggtacgcatgtgccatggtagtttgctgcacctatcaacccctcatctaagttttaggccccgcatgcattaggtatttctcctaatgctctctctcctcttccccgccgcccccgacaggtcccggtgtgtgatgctcccttccctctgtccatgtgttctcattgttcaactcccatttatgagtgagaacatgcagtgtttggttttctgttcctgtgctagtttgctgagaatgatggtttccagctgcatgcatgtacctgcaaaggacatgaactcattcttcttcatggctgcatgatagtccatggtgtgtatgtgccagattttctttatccagtctatcattgatgggcatttgggttggttccatgtctttgcaattgtaaatagtgctgcaataaacatacgtgtgcatgtgtctttatagtagaatgatttatattcctttgggtaaatatccagtaatgtgactgctgggtcaaatggtatttctcgttctagatcctcatggaattgccacactgtcttccacagtggttgaactaatttacactctcaccaacagtgcaaaaggtttcctatttctccacatcctctccagcatctgttgtttcctgaatttttaataatcaccattctaactggcatgagatggtatctcattgtggcatcaaatttgatggtatcaaaaagatttgcatcaaaacttgatgatagcaaaagatttgcatttctctaatgactagtgatgatgagtttttttcatatgtttgttagctgcataaatgtcttcttctttagagaactgtctgtacatatcctttgcttactttttgatgggattgtttgtttttttcttatacatttgtttaaattccttgtagattctgggtattggacctttgtcagatgggtagtttgcaaaaattttctcccattctgtaggttgcctgttcactctgatgatagtttctttcactgtgcagaaactctttagtttgattagatcccatttgtcaattttggcttttgtgcaattgcttttggtgttttagtcatgaagtctttgcccatgcctatgtcctgaatggtattgcctaggttttcttctagggtttttatggtttggggttttacatttaagtctttaatccatcttgagttaatttttgtataagttgtaagaatttgcatatgttgaaccagccttgcatcccagggatgaagctgacttgattgtggtggataagatttttgatgtgctgttggatttttttgccagtgttttattaaggattttctcattgatgttcatcagggatattggcctgaaattttgttttttttgttgtgtttctgacagcgtttggtatcaggatgatgctggcctcataaaataagttaggaggattccctcttttttgattgtttggaatagtttcagaaggaatggtactagctcctctttgtacctctggtagaattcggcagtgaatccatctcctgggctttttttggttggtaggctattaagtactgcttcaatttcagaacttgttattggtttattcagggattcgacttcttcctggtttagtcttgggagggtgtatgtgtccaggaatttatccatttcttctagattttctagtttatttgtgtagaagtgtttatagtattctctgatgatagtttgtatttttgtgggatcagtagtgatatcctctttatcattttttattgtgtctatttgacacaataaaatttatagataaatccatgaagatgagggaaaaacagcacaaaaaagctgaaaattccaaaaaccagaatgcctcttctcctccaaatgactgcaactcctctccaacaagggcacaaaactggatggagaatgacattgatgaattgacagaagtaggcttcagaaggtgggtaataacaaacacctctgagctaaaggagcatgttctaacccaatgcaaggaagctgagaaccttgacaaaaggctacaggaactgctaactagaatagccagtttagagaggaggataaatgacctgatggagccgaaaaacacagcacaagaacttcatgaagcatacacaaatatcaatagccaaattgatcaagcagaagaaaggattcagaaatcaaagatcaacttagtgaaatagtcatgaagacaagattagagaatgaagaatgaaaaggaatgaacaaagcctccaagaaatatgggacaatgtgaaaagaccgaatagactagtattgattgggggtccctgaaagtgatggggagaatggaaccacattggaaaacacacttcaggagaacttacccaacctagcaagacaggccaacatttaaattcaggaaatacagagaagtattgaggatactcctcaagaagtgcaaccccaagacacataatcatcaggttctccaaggttcaaactaaggaaaaaatgttaagggcagccagaaagaaaggtcaagttacctacaaagttaagcccatcagactaacagtggatctttctgcagaaaccctacaagccagaaaagagtgggggccaatattcaacactcttaaagaaaagaattttcaacccagcatttaatttaatagtcagccaaactaagcttcataagtgaaggagaaataaaatcctttacagacaagcaaatgctgagggattttgtcaccaccaggcctgccttacaagagctcctgaaggaagcactaaatatagaaaggaaaaactagtaccagccactgcaaaaacacaccaaatataaaaccaatgacactatgaagaaactgcatcaactaatgtgtgaaataaccagctagcatcataatgacaggatcaaatgcacacataacaatattaaccttaaatgtaaatgggctaaatgtcccaattaaaagacacagactggcaagctggataaagagtcaagacccatcggtgtgctgtattcaggagacccatttcacatgcaaagacacgcataggttcaaaataaagggatgggggaatatttaccaagcaaatggaaaggaaaaaaaaagcaggggttgcaatcctagtctctgataaaacagactttaaaccaaccaagataaaaaaagacaaagaagggcattacataatggtaaaaggatcaatgcaacaagaagagcttactatcctaaatatatgtgtgctcaatataggagcacccagattcataaaacaagttcctaaagacctataaagagacttagacccccaaatagtaatagtgggagactttaacaccccactgtcaatattagacagatcaatgagacagaaaattaacaaggatattcaggacttgaactcagatctggaccaagcagacctaatcaacatctacagaactctccaccccaaatcaacagagtataaattttctcagctgcacataacatgttttctaaaatcgactacataattggaagtaaaacactcctcagcaaatgcaaaagaatggaaatcataacaaacagtctctcataccacaatgcaatcaaattagaattcagaattaagaaactcactcaaaatggcacaactacatggaaattgaacaacctgctcctgaatgactactgggtaaataattaagttaagggagaagtaaagaagttctttgaaaccaatgggaacaaagagacaaagtaccagaatctctgggacacagctaaagcagtattaagagagaaatttataccactaaatgcccacaagagaaagctggaaagatctaaaactgacaccctaacatcacaattaaaagaactagagaggcaagagcaaacaaattcaaaagctagcaaaagacaagaaataactaagatcagagcagagctaaagaaatagagacatgaaaaacccttcaaaaaatcaattactccaggagctgattttttgaaaagattaacaaaatagatggaccactagctagactaataaagaagaaaagagagaaaaatcaagtagacacaataaaaaaatgatagtctttaatctttgaggctgatgacctttggatggggtttctgtgtgcagcttctttttgttgatgttgatgttgttgctttctgattgttagtttttctcttctaacaggcccctcttctgcaggtctgctgcagtttgctggaggtctactccagaccctgtttgcctgggtatcaccagtggaggctgcagaacagcaaagattgctgcctgctccttcctctggaagcttcgtcccagaggggcaccagcctgatgccagccggagctctcctgtatgtggtgtctgtcagcctctactgggaggtgtctcccagtcagaatacacaggggtcagggacccacttgaggaggcagtctgttctttagtagagcttgagcactgtgctgggagaatcctccttgtcaggatctgctgctctcatcagagccagcaggcaggaacgtttaagtccactgaagctgtgcccctgacagccgccccttcccccaggtgctctgtaccagggagatgggagctttatctatagccccctggctggggctgctgcctttctttcagagatgccctgcccagtgaggaggaatctagagaagcagtctggccacagctgctttgccatactgtggtgagttctgcccagtccaaacttcctggcctccttagcactgtcaggggaaaactgcctactcaaacctcagtaatggtggatgccccaccctctaccaagctcaatcatcccaggtcaacttcagactgctgtgctggcagcaagaatttcaagccagtggttcttagcttgctggggtccgtgggggtgggagctgctgagcaagacctcttggcttcctagcttcaggcccctttctggaggagtgaacggttctgtctctctggggttccaggcaccactggggtatggaaaacaacaacaacaaaaaaactcctgcagctagctctgtgtctgccctaacaaccatccagttttgtgcttgaaacccagggccctggtagtgtaggcacatgagggaatctcctgttctgtggattgcaaagaccgtgggaaaagcatagtacctgggctggatagcacagtccctcacagcttcccttggctggggagggaggtccccggctgcttgcacttcctgggggaggtgatgccccaccctgattctgctcaccctctgtgggctgcacccactgcctaaacagtctcaatgagatgaagtgggtacctcagctattcctattcagccatcttgccaaatctctctattatcttttataggaaaaaactttctgaagatgacatcagactcaagaagccaagtaggaaaagactgataaatctgaagatgtaaaaattaagatcctttactcagaaaaagaaaagtacaataaaaaaataaaaaataatttgagcaaaatatttgtgatacatgatgaacaatggttaagtgttcctagtaaacaaagaagtcatcaatctgaaacaatcaacagcagtaaaaaataggataagcatctcacggaaaaaagaaatactaagagcaaataaacacatgaaaacatgcacaacctcattctgaggaaatgaaaaacagaactaatggctgactacaagatttaaaaactggtgatacacaatgttgatgaggatgtgtaaaacagtcactcccatggatcattcattggaaaatatatcagagtaatcctgttggaggacaattttgcaatatctacacttagtaatttattgttctcaccaaagtacatggaggtgtattatggcttgagtatatggaggctgtagagccctcggagtatggagcccgatgccagggatcagataatagctcagcaacttctgaggtatgtgactgtggcaagctaagagccttacctgggaagtggagataagtatgtttttacctcaaaatgctggtgtgaggatctgatatatttatacactttagagaaatgcttggcactttggaacattaatctaaagaaaacatccaactgctcacgagtagagtgctaagaaggaagagcttggcctcatagttggatggctgccacgttccctgaaagtgaatgaagcaaacctctctctgactgggaggctgatgtctttacttcattaagtcctggggcatctcatgttccaggatagcatcactttccacgtttcttcctttttcatgcataagaattttagctagcggagagtaaggcaagtgaccatttcaaagacaggcattttactaaatggtggccactgaaagcttgattcctgtgctgttttctggtactttttgtcttaaagcaggatttctcaacactggcactattgacattttgggctggataattctttgttgagggggctgtgctgtccattgtaggatgtttagcagcattcctgatcttgatccactaaatgccccaagttctgacaaccaaaagtgttttcagatattgtcaaatgtcccttgggagtgaaatcacccttggttgaggatcactgggttttagaggtttggaatgaaaaaaaaaaatgattctcccgttggaagcagagactgtagttcagattatgaaccagttagatgatttcccttcttaagcatgaattcagactgcattgcctttgaaaattaatgtttggggtgtgtgtgtgtgtgtgtgtgtgtgtgtgtgtgtgtgtgtaaatattacggttaacagttatccactgggccctaggatgaataaggaagcatagcttcaccttattctcgacaaagtccttaagagggtccagattatgttccatcacactttcatgcttctgaattccacttaaaaaaaatagacttattggccaggtgcggtggctcacacctataatcccagcactttgggaggccaaggtgggcagatcacaaggtcaggagttcgagaccagcctggctaatatggtgaaaccccatctctactacaaatacaaaaattagctagtcggggcggtaatcccagctactcgggaggctgacgcaggagaatagcttgaacccaggaggcggaggttgcagtgagccgagattgcatcactgcactccagcctgggtgacagagcaagactccatctcaaaaaaaaaaattgacttattaattattttgaattagcaatatattcccatggttcaaaattgaagcaatataaatgagtgtagagtgaaaagtttctctctcatccctgtctccagatatctgggtcctgcccatgagaaagccacatgaacaggttctttgtttatccttccaaatatattttttgcatacacaaatatgtatatttgtatttataacatatttgtatatttcccttgtatatttgtatatttccctatctcatcccccccttttttaacaaaaacaggtcatacactgaacatacatgtgttcacccagactcttctatgtgcatatgttatctcttcaccactgcttcctttctaagagaactccgattttgtgcagttcttcagcaccataccctttcccctacctacccacaaacacacttcatggaatccatgtgactcaggggaagtggattccacccccagatctgggagtagctggtcaaagggtgacccattctctttgccagaggtcagttcagaaaggggcatgaaacccaactcaggccaatggacatgctgagaattttgctgggctttccagggaatttttttttttctcctgagagagctgtggaagaagtctcttttgcctcctctggacaccactatggggagaagtaaagatggggcagacacttgagggatggcccggaagaaactggagcgcctggattaagccaatcctgaagtctgcacgactgctgtcctttcaggcagaggaaagatgggtgatgtcactattagcagtctagggtgaggtgacaagtcagtgaagccatttcaaatccaagtctggtgtggcttgaaggcttttggtttacaacggtaaaatcagttctccgatgtgtagcattttacagtacaaacggtgctcccacattcaggtttcattgagagtaaatacgccaggcaaggcctctgtgcccactgcacagatgaggaaaaggagacatggaggggaaagtcttgtttaaggacacatatcctgtaagaggcagaactggaatccaaccccaagtttgtttctgttaccgaaacaccgggagtttggtctgggtcctgcggctcacagaacagaaagccaatgactgagacgatgagtattgccaaggacgaaggctttagtcgggttctgcagcagaggagatgggaactcagtctcaaatgcatctccctgactaactaaaactaggggtttatatggcagggaagcaatgtaaccgtgtgtaagaaaacgggaactagggaggggcaaggaagcaatcatggtgaatgaggggtcccacatcttattgtctgatgtgacggtctggtgaatttcagttctttggtactttttttgagatctgaagctcctttcctgaggaaggaactcggataaaacaaatataagtttcaagctttaagactagaagggtgaatttctatgtttatcaaaagaaaaaaaaactgtctatgggacaattgcattggttttatttaaacatcaaggttattttctcccaaaccaccagatactctggctggaggcattcatacccacagatgcatgccaagtgttgactctaccctcaggagcagcaggaccaggaagctctgggaggtcaggacacaggagagaggcaggaagagcccccgcaggacctactgtggtggccgagactgctacagccatatgacctccgactgtgcccagttccttttagcatgtcctcaagagtcagtgcctcggagcaaatgggctgacctctggactacactggggaagagagaaaaggaggtcctccctgttgcccaatggaagattcctcaagatggagattgagctgctcttctagggcaccccaagggcaaatgtccccatcgtctctaaggctccagccagctccaaacactctgggtggtaaatagactgaatcccctttagtgacctctctcactggcaatgttttttttctcttttttcttacaatagttgaattgatcaaaaaagaactcaatctcaaaggtgagagtagagttgatgatggggtcagggagctgacctcaatcgaaagttgagaagaaaagcatgtgtgaataacaacatccttggtttagaatttacttacaaagcttcagctgagcttatgaatgtgtcatttggatatttgctgggcttcgcacacaccccttcagtttctacacagggccaggcatatcacaatggtgtggttgcattttgtttttaatgttaggttcattttttatagatcctaaaacacaaaacgggattcgggagtgtgaatttacttgaaccaaactgaaaaaaggttttctcaacctctgcaaaatgaagctgcagaattcacaacagttttaattataacacactaaatagatacaataagtggctctttgctctgacgttgaaatctctacctatttttatctccaggcaaataacaggcggctggggaaagttactacattatgagtgggttattgaatctctgagcatcaacaacctctatgtcattacactgcattgtatgctaaagaaaatcattgtatccaggctgggcacagtggctcatgcctataatcgcaatattttgggagactgaggtgagcagatcacctgaggtcaggagttcaagaccagcctggccaacatggtgaaaccctgtctttactgaaaaaaaaaaaaaaaatacaaaaattagccaggcatggtggcgcacacctgtaatcccagctactccagaggctgagacaggagaatcgcttgaagccgggaggtggaggtggtagtgagctaagatcgtgccattgcagtccagcctgggcaacaagaatgaaactccatctaaaaaagaaagaaagaaaaaaaaaaaaaagcaaaacaaagaaaatcattgtattcaaaaataccaagatgagcaaaaatatttcaagatttcttagaagaaatttgcttcccataggcaaaggaaaactaagcacattaaaactactgctctaaagtaactttaaagcataattctccccttgagtttcaggaaagacctggaaagaggggcaagactttccctttctcaccttgccatgacctccagggccttgtagctcaggctttgaaaatgaaggtcaccataattactattacaacccagatctggaggaaggtggagaaccttgaacagagcccaccagaagtggctggctggggtcccagtgggctgcagggccagggaaggccctgcggttgctgccccacctgcctgctcttggcctcacttctttgcttctcctctggaagattctatcagaattgctttgtgctcaggaatgggcctatgatgaagagtctggctcactttttcctctgtactttgggattacatcatggaacccaatatcctgagcaagcataagaaagggaggggaaagtggatgaatctgatgtaagaagaaaacagacactcatattttcactcaattttcaaagcaatccacactacagatgaggaaactgagatttatggacgtgaagagacttgctgaaaaccacagtttggtggctgaagctggtttgaattttattctaacacaaatctttatttattttagacagggtctcactctattccttaggctggagtgcaatggcgtgatcatggctcattaaaacctcttcctccagggctcaagccatcttcccacctcagcctcctaagtagttggaaccacaggcatgcaccaccacccctggctaatttttgtatttcttgtacagatgaagttttaccatattgcccaggctggttgtgaactcctgagctcaagtgatccacctgccttggcctcccaaagtgctgggatgacaggtgtgagccactgcacctggcctcaaatatttttactgtattttattttttatttttgttggtacatagtaggtgtatatatatatggggtacatgagatattctgatacaggcatgcaatccataataatcacatcagggaacatgacatagccattatgtcaagcatttatcattgctttgtggtacaaaaattccaataatactactttagatatttttatatgtacaataaatgattgttaactatagtcaccctgttgtgctatcaaatatgcgatcttattaattctatctaaccatatttttgtagctattaaccatcttccctctcctccttcccagcctctggtaaccatcattctactatctccatgaatttaattgttttaatttttagctcccacaaatgagtgagagcaggtcaagtttgtctttctgtgcctggcttgtttcatttaacataatgacctccagtttcatccacagtgttgcaaatgacagaatctcactcttttttatggctgaatagagtactccactgtgtatgtgtacgacattttctttatccatttgtctgttgatggacacttaggttgcttccaaatcttggctattgtgaataacacttcaataaatgagaatgcagatatatcttcaatatactgatttcctttctttggggtatatactggcagtgggattgctggatcatatggtagttctgtttttagtcttttttgaggaacctccatacttttccccatagtggctgtattaatttacattcccaccaactaactcaaatctgtaaattataccatgaggatgtctaaatcaagggggcgatttttgcagtttctacaagaaaatcattgagtagttcacctaacttgattggcaaattcagtcaaatgactgtacaagttttatataaatgtagtctcatgttaaacatttaaatcatgtgttaccataaacaattattaaatcacttgaagatgtttgagaactaaataggatatttcttcatgatatatgctttaaaaagttttaattgcggtaaaatacacatgacaaaactttaccattttaacaattttaagtgtacagttctctagtgttaagtatatccacattaatgggtaaccagtctctaggacttatctcataaaactgaaactatacctattaaacaacaacccctcattttcccttctccccagcttctggcaaacacaattccaccttctgtttctatagctgactactctagagaggtcatatgaatgggatcattcggtatttgtccttttggattggcgtatttcacttagcataatgtccttaaggttcatccacgttgtagcacgtgtcagaattgtcctcctttttaaggctgaataatattccgttgtatgcatagaccacattttgcttagccattcttctgtcgatagacaggtgagttgttgccatcttttggcgattgtgaacattgctgctatgaacatgattgtacaaatatctctttgcaatcttttcaattatttggttatatacccagaagtggagttgctgtatcatatggtaattctgtatttaattttttaagaagctgccatagcgttgttcaaaactgctgcaccattttacattgccaacaacagggcacaaaaaattgaatttctctgcattctctacaacacttgctattttctgggttttttttgcaagcagttattctaatgggtatgaggtggtatctcacggtggttttaatttgcatttctttattgatcagtgatgttgagcatctttgactatgcttgttgtacacttacatacattatttggatagctgtctgttcaagtccattgcccatttctaagctgggttatctttttgttgttgttgagttgtaggaggtcattatatattccggatactaaccctttgtcagatgtatgatttgcaaatattatctcccattccataggttgccttttcattctgttgactgtttcattctgttgacttttgtcttttgacagacaaaagtttttaattttgatataatttatctatttttacttttgttgcctgtgcttttggtgtcatagccaagaaatcattgccaaactcagtatcaagaagattttcctctatgttttcttctcaggcttatatagttttggctcttacatttgggtctttgatcgattttgtgttaatttttgtatatagtataaggaaagcatccaattcattattttttgcatgtggctatccagttttcctagcatcatttgtggaaaagactgttctccccctttgaatgatcttggcactcttgttgaaaatcatttaaccatatatgggagggagggtttatttctgggctctctattcaattccactgattcatatgtgtgtctttatgccataaaggtactatggctttgtaataaatttggaaatcaagaaatatgagacctccaactttgttattctttttcaagactgttttggctattcaagatcctttgaaataccatacgaattttaggatgaattttttttttaatttctgtgaaacatccatgagattttgacaaggattgcacaaaatgtgtagattgctctggttagtatggacttcttaactatattcagtctttaaatataagaacatgtactgtatttccatttatttgtatcttctttaatttctttcagaaacactttgtagttttcagtgtacaagtcttttgcctcttggttaattctgagtattttattctttttgattctattagaaatggaattgttttcttagtttcctcttctgactgttcattttagtgtatgataatgcaactgatttttatatgttgattttatattctgtatattctgcatctttgctgaatttgtttattagttctaatagtttgtggaatctttaggggtttctacatataagatcatgtctgtgaacagacataattttacttcttcctttctggtttggatgcctttatgattttttttttttttttttttgagacagggtcccactctgtcacctggctagagtgcaacggctcaaacacggcccacttcagctttgaacttctgggcttaagtcgtcctcccacctcagcctcccaagtagctgggactacaggcacttgccaccatgtccagttaatttttttaaaaattttttatagagatgggggtcttgctatgttgcccaggctggtcttgaactcctgggctcaagcaatctccctgccttggcctcctaaagtgttgggattacaggctgagccaccgtacctggcctatgatgcatttttattgaaagaaaaacagacaccattattttgcattacaaaatataaaacagaagaaatttcacagccaatcaaacgggagtttagaattggatcctcctgcactttcccctacacttctttcaaagctgccttcctctgcaaggcttctgcctcacctctgatcacccacaacctgagctctgagcacccacacctcacctctgagcactatgacccatctggatggagctactgcacggtcagtgtgggaacatctctgaggaagatgcattgtcttctgtggagttacctaaaaacactggggcatgttctcctaactgccttcacttagtctaaagatgaagcaattcaacaaaagtacatgtaaacctcaaaactggacttggagttttaaagatcaatggactctattgtctattgtctggatggtttgggggtttcctagctcatttttttttcttttatggtatagacacctgaaggctctttgctcagtactcctcactgtgtggctgccttccactgcagacgctgtgctgaaggttgggttctggccactctgtttacacccttttggacttgaggcttgcctgttggttccctgaaacgtggactctggatctgggtgctaaccaattccctttctttccaggccggggtcctgagacctcactgtaatgagagactgtgacctcttttctcatgtctcaggcaggctatgatgccttttctagttaaggaccgtgttgaaccaggtgaaatcgccatttttgttggctgtttttgtcctgcaaaactgacaatttcatgtccttaaatttaatacctttggagtagaaactacctattgttgtccaatagaggaaacaaagtttcttcctgaaagcatttgtctgaacaaaacagtatttgttttatctgcatttccccttcattcacttgtatcattcagggacttgcacatctcagtcacatgtgtgacgcactcacatgtatggctccaatcccatcttcacggcacagagaactaaattctctcccaccttcccgtggagagccctctgtcctcatcatcactggttcctttcttctggatccttccacctcaattatgtttctctgagggtgcaatgacaagaataaaatgaaattttgttcttgttcagttaagtaataaattgtcatttcttccattttctctttgactaaagatgtattagctttattattattttttaaatagagacaatgtctcaatatgttgcccaggctggccttgaactcctgagcttcagtgatcctctcgcctcggcctcccaaagtgctaggtttacaggtgtgagccaccacgcccggtaaaagatgtattagctttaaacaaagttaaaatttcttctcagttgtgtaaaaatcacagaagaatgcagcatgtcctctaagtgtcagcctgtgtggggctgaaaaaacagtggagtcctttgttcactgtcttaggagtctttgggatttctgttgatccacagacttgcataaagagtttgtcatgatgacagggcctctgcacatgatgtgaggatgtggaccccctttcctccccacagccagtgccggcccgactcataaaagctcaaagatccagtgagaccagcctcagtcagatcagcccatccatgagtgggggttgttgttatatatatttatgctccatctcactgccaaagagggatttggggtggattatagaaatgcatacaacaggggccgggcgcggtggctcatgcctgtaatcccagcactttgggagagccaggtgggtggatcacaaggttaggagatcaacaccatcctggctaacatggtgaaaccccatctctactaaaaatacaaaaactagctgggtgtggtggcgcgtgcctgtaatcccagctactgggaaggctgaggcaggagaattgcttgaacctgggaggtggaagttgcagtgagccgagatcacgccacagcactccagcctagtgacagagcaagactctgtctcaaaaaaaataaataaataaatagataaaaataaagaaagaaatacatacgacaaaataaaaataaaataagcaaagaagtggaggaagaagaggagaattaaggtaagaaattaagatgaagtcatttgtttctttttgcctattcatattttgagttttctcttttcttattgatttgtaggagttacttgtatattctagatctgtgctaatacgttagccaccagtcctatgtggctattgaaattaattaggctgggagtggtggctcacacctgtaatcccagcactttgggaggccaaggtaggtggatcacttgagctcaggagttcacgaccagcgtgggagacatggcaagaccccatctctactaaaaatacaaaaattagccaggtgtggtggcacacctgtaattccagctacttaggaggctgaggtgggagaatcacctgagcccaggaggtaaaggctgcagtgagctgtaatcacaccactgcactccagcctgtgtgacagagaccctatctaaaacaataataataattattattaaagttaaatagaattaaaaatttagctcctcagtcaccctcctcccatttcaagtgctcagtaaccacaactatccagtggccagcatagacctacaccatttccatcatcacagccaattctcttggatagtgttggtctgtatattaatcccttgtcaattttattcatttcaaatatcttcttcgagaaaattgttctctgctaactttgattaagatgtcttcactgaacagaaatgtttaggcttttttgagacagggtcttgctctgttgcccaggctgtagtgcagtggtacaaccatagcttactgtaaccttgaattcctgggctcaagcaatcctcttgcttcagcctcccaagtagctagaagtataggcatgcaccacaatgcctggtcaatttaaaaattttgtagagatggtgtttcactgtgttgccagtcttcctacctcagctcacgagttctcacgagatctgatggtttaaaagtgtgtggcacttccccctttgctgtctctcctgctccaccatggtaacacgtgcctgcttccccttcgttttccaccatgattgtaaatttcctgaggcctctgaaccatgcttcctgtacagcctgtaggactatgagtcaattaaatctcttttcttcataaattacctagcctcagttagttctttatagcagtgtgacaatggactaatacaccttaaatgtttagtttttatatggttgtgttcatcatattttgccctgtaatatgtgcatttggagtcttgtttaagaaatctcctccctgaggtctcagagatatttcccctcaccttttggtatctgggttgtggatttccttttcatatgtgggtagtgaatccaataggactttgcctttgctacacagcgtgaggcagggatccaaccctatgctctccatctagtgaggggttttccccatcattgctgttaacagattcatctacacatccatcgtctccccacaggtcttgtgtgccactgctttcctgtgcccatccaaggtccatgagggcaattttgggctcttgcaggctgcatccatctctttatgtttcctctgccaggaccaaattgtcttatcactctgactttgtgcaacgacttcacgcagggagagtgctctattctccctcactcttgtgttgccaaatgttcatagctcttctaggaccttgctcatctagattcactttaaaatctatctttttgagtttctcaaaatgtgtatagaaaatcagcagtcactcactaatgaaatactctcttttaagtgaaaaataatatatgtgctgtgaagctccgtgatctactttaaacctaggaatgaagttccaagtgttaacggtgatttaaaatccattccattgagtttcggtttgtctggggcatcagtaaatgctcatttccaaaagtgctttgcctttgaaggctactaatgcatgcagtgtgttgccatggcaacggttacttttagttagtactttttatagattaaagtgctacaccctggagtctattcatataaatgcataaatcttaagacagtatggtacttcatttaatgtagatatttaatggaacagagtcagacttaactgaccagaaatggaaaattttcaacacttatatttgatacggacatgcagtgttaccaaaaatataacattttcattactttgttttacaaaatataaattaaccttgctatccatttaacttggtcaatatttaataaattgtggttgaaatgtatgtgtctgtcagaaatttgcacatatcactttgttttctaccctagagtaaaatccccaattattgtagggattcagaagacttggggaacaaggtgtttcccaggcaaatggaggggaagtcagtggagccctgggtgggaaagagtatatgggcctgggcttggattttggcagtgatttttattagctgtgtggccttgaacttcagtttccccagtcataaaatggagatcatcacatctactttgcacagcagttgtgaagattaattgtatcttcagtgagtgatatctatgatttaaaaatgactagataatgatttcaagtcaatatttaagacagaaagagagggtggaaatatcaagtacaaaagtgctgcggaaagtcaatagtcaacgatcctggtggatgggaggtctcagagacaggggaattgggcaccgcttccacgcacacgagaggagaaggacacagaggcagagatcagcagagcagtgggcatggaagagggaccatggggttggctgggtgaggcttggtcaggaaagacaaaggggtggcggtaggagcccccaagggtgggttgagagctctgtgccttacacaaagagtgaccctgaactgtgccttatacagaggtgacaagaagtgttttagaagggagatctggtaaacaaaggggcacatggagacaagcatgagggctggatgtgcccctggcctgaggacagcaaggcctgaacccaggaggggtgtggagagtgagatgaagatgagaatctcacagtcacaaagaagacgatatagggattagctctactggaaacaggagtggaaagagccaaaatggtctccgaagctttgatctcttccgatgaacaattgtttaaagcaacaataatgacaataacaaaacagtcatcccttggcatctggggggtattggttccaggactcagtttcttgccacgtgaatctctccagtttgctttgtcagagcaagcacgtgaaaagaatctgaacaagatggaagtcactgtcttttataatctgatttccaaagtggcatccatcacccttgctgtgtttattcattaaaaccaagtcacgagtccagcccatatacacaaggagaaggaactacacatgggcatgaagacaaggagacaggggtcgctgggagccatgctggaagctgcctaccatactaggggactggagaagtggaaatactcttgaccaaaataggacaggaggatggaaataatttaggacccagatgatgaattcagttgtaatcatggtgtatgagctaatggcatggcatcagaaccagaatccacagccatttgagccatgggagagctctagaaagaaggcaagccacggacatggattaggaagcatcctgttttgaccatgttcaggacatgtattcttagcttcattgcacatgtctgcaaaacaaatgagtctgctacagggctgtcagacagggctgtggtttcatctgaaggttcaacaagaaaaggatttacttccaacctcactcacatggttgttggcaggattcagttctttgcaagatgttaggatgaggttcttgattctttacgaacagtggcctcgtgagaagtcttgagttggataatccaactcaactgtggctggatacctgacccacagaaactatgaaataataaacgtgcttttcaagccactaagttttggtgtgatttgttatgccgcaacagataattaatacacccagtttccaactctttgatcctatcagttaccataaggcacctagaagttttcccacccttccaagtcctcaaaatttatgcttttctggaatttgagagaaggtaatggtccacttagggaggaagctattgtttggtacatgcctccaggcaccctttctcctgctggacaactgcttctccagtctaatcctgctctagctttttgctgggaaataacactccactcactctttcaccttggacttcctgtgctcccaaacttggcttgggtccagactgtagtcttctgtgtccctgacctggatttctattccagaacctaaatgctgcatgtctaagctgatctggtcagcaaattttttatcgctcttgcatttgatagttggattgtggcattcctgaccttgcattgcacccgcacaaatcaaaacagccttggcagccctgtaagataatttgattccattccctagcaatacagggccaggtccaaagttaccaaatcagggccctgactgctcctggcacccagccctggcccatggcttcctgactgatcttcctgacctttgcctttccagctccaccacctcaaggaggcatgaacgatctttcagaggcatgtgccaagttctgagcttggtcttcccatccttccagggggtgtgggatgggacttggagttatgccagctcttcagaaggggatgtgcatgcaccagctccaagtagagttggcaataggcaccgctactcagtggcacagtggtgactcatgaaagcagtggggagtaggacatggtggcagagaatcagttcccaggccctgctcagcaattatgaaaaaggctgttaacttggcaccaggaaaatagagtaaaggtcgcttttcctgacttccaaggacttccacagactgaggccaacctgctcgcccaatgtgttctctactgtgagccctctgctctcactgtcactttctagtctggaagtcaaaaaattcttctccttcttcttctctttcttcttctcctccttctcctcctccttctccttctccttcttctttctcttcttcctcttcctctcctttccttctcattctcattcttcttttttttttttttgagacagggtctgactccatcacccagggtggagtgcagtggtgtggtgtcagctcactgcaacctctacctcccaggttcaagcaattcttgtgcctcagcctcccaagtagctggaattatagccgtttgccaccatgcctggctaattttttatttttagtagagatggggtttcaccatgttggccaggctggtctcaaactcctggcctcaagtgatccacccacctcagcctcccaagtggcctgctaggattacaggccactgtgcccagccaaaaatatttattattaataaatggatgagccttgtagaaattatgtggaacaaaagaatctggacacagaagagtaaagactgtatgctccacttagatgactttttagaataggcaaaattcatctaaagtggataaaataaaggtcatacttgttgccctggttagttacctggaaagggacatgagggagctttctggagtgatggaaatgctctatatcgtgataggggtgtgagttacagaggtgtgtgtttgttaaaataaggccgggtgcggtggctcacacctataatcccagcactttgggaggccaaggtgggtggattacttgaggtcaggagtttgagaccagcctggccaatatggtgaaactccatctctactaaaaatacaaaaattagccgggcttggtggtgcatgactgtaatcctagccacttgggaggctgaggcaggagagtcgcttgaacctgggaagtggagtttgcagtgagctgagatggtgccactgcactctagcctgggtgtcgcagggagactccatctcaaaaataaataaattaataaaaaatcggctgggcacggtggctcatgcctgtaatcccagcactttgggaggccaaggtgggtgaatcacgaggtcaggagatggagaccatcctggctaacatggtgaaaccccgtctctactaaaaatacaaaaaaaattagctgggtgaggtggcgcgtgcctgtagtcccagctactcgggaggctgaggcaggaaaatggcgtgaacccgggaggctgagcttgcagtgagcccagtatatatatatatatatatatatatatatatatatatatatatacacttaatttttgttactttgtcattatggcattttgatatatgtcaattttaccttcaataaaactgtaaaaatattaatggttgagtaagggcaggggagtggggtgagctacagaagaccctggaatggcagaatgctgaatgtcgaagctgggtatttgccgcataggggtttattacgctattctgtttactttgtacatgtttgaaaatttccacaataaagagtcaaaaaaaattttatggtgcacatattctgcaccatgtcctatgctaaagggcatgcacaggcagacaaggctgcagaatacagaaagaacaaaactgaagatggaatttatttttttacatttatttttagagatggggtcttgctatgttgctcaagctggtcttgaactcttgggctcaagcgaccctcccacctcagccacccaagttactgggattacagcattattcaacctgaagattggaagattttttttttttttttttttttttgagatggagtcttgctctgtcgcccaggctggaatgcagtggcacaatctcggctcactacaagctccgccttctgggttcatgccattctcctgcctcagcctcctgagtagctgggactataggcgcccgccaccgcgcccagctagttttttgtatttttagtagtgacgtggttttcaccgtgttagccaggatggtctcgatttcctgacctcatgatccgcctgcctcggcctcccaaagtgctgagatttcatgcgtgagccaccgcgcccagccaagatggattttttacttacaaacataaagtgcattgaaaagggggaaaggtggactaaacggaaagtcatgccagccccaacatgtggctccaagaagagaaccctgcaccagaagggaagtcatccaactgcttctttcatggctcacaacatgtcacgagaccatcgccagcagaactaaacactgggcgaagcgatgtggttgatttacattctggctcaggctctattcttgaaccatcagccagaaatgtgaccaacactaaggcaatgatttattagattcacctgggagcacccagataaactaaatcagaatcccttgtggcagggctcggcatcagtgtattttgatgttccagatgcaattccaatacacagccagggcaagaaccagcgatctgtgagctgctcaagtcacattgcttccaggaagtctctcttcatgctcgctcacaaagagccttcttttatccaacaccctaaacattgctgactgacagtctgctatctaggtatatggggccttgtactgttttgaacaattcatgcttgtcttctttaatgaggatgtctgcacatgtgttcttgagggtaagaattaccttttacatttttgcattccccacaacactttgcactatgatgttcaataaacattcaattttcaaatttttatttagacaatgaaatatttccttattataaattggctgcattctttaattctcagagtactgaactaaatgattaatcattactggaacatgttctttcataatgaaaatactaaaagatttataaacttaaacataacttttcagttatttaatttggggattttccaagtcaacgtatttcctattgaacagatttttgtctatattatttttgctctctgacctgatgtgaatctttcagacgctgggttggttgaaggggaaacagtttttctaatgcagctactgtgagctgagctgacttaggccttggagaattaccattcttaccaattgaccacaaaagcagataggaacagtatctacgtattacaaaccagaatcaaaatgaccttcacacatgattagtgtggaattcttttcagtggaaaatggcaacatttagcagcacagggtgcagttggcttcaaatactctctgaagtgaaaccattgtgttttcctgggtgactgagcccagggctaatgcccatcggagaagctgctgggaactgcaatgctttgattaaacagagtattaaccacaggctggctgtttgaaccatatcgataaagacaaaattcaccctatctaccaaaacattctttcatgtaagacttaacaatgaaaataaacaaaagctttagctgtcaactatatataccatgaagaatggcaaaactggtttttgttaatgctattttgtcttttaatcgctcagttggctatgaaaactcttgtttacattcctttacatattgttgagcttcaaggtaattgtgaaagaaaacggggaattaatatcacttcccagaagccacattttatttaacctcaaaaactttatgtaaaagattttgttatgaatcaaaggctggcagttcttcccactggggtgatttaggaaattaaagttaggagtagatggtgctaatgggaatggtaagactagtaagagtgatttattccttgcagaaaaaaatcactgtcgatgctcagttgaaataatgtggaatttaataattacctcatagtaccatctagtggtgctatatttctacccttgtgttaagtgaggactgtagttttctgtagcccgaagccagcaaagccaggtcagtggtctattacaaacactttaactgtaagctgttagaagggtgagttcacagagaaaatgtaaacaaagtattagtagctcatatgacaatattaaattttaaaatgttcccagaactcagacatgttcaatatggattctcaataaattgtgtttttaaatattgaacaaatactgtgattacttttttcacaataattacagcaatttgggtagttttgggtactaccgtaagattctaagcactattttatatttttcctattctgaacaattgtggtttgtgcatttcttccagtaaatgcggtctggaaaataaatacctttcacatggtacgtgttattggaaaacaattgtctttagtgagatttatggaatgtggagaaaaaaaattttttaaggaactattgctcctatgaaagcttgagagtgttacgggcaatgtaggcacttttagatcaaattcaaacataaaaaggcacttacacacattttaagaatacttgtaattataagcacattttcagatttacaggactaagtctagtttaagcataaaccagattcaatgtgaatctctatatatttttcttgcttcaagtattattttacagaagggacactgatttgtttggcctgtgtaaacctaagaatctaggtttgatctagtagatatcatatctagtagatgtcatatctcaacaataaagggtctgaagaataaatattaatatttaggcctaagttattttttaaaattcataatgtgtctgtcctgttttgcttactgaattaacaaatctttaaagaaaaccttcatatattatagcgatatatttataccacagtgatatgatttattgaatgtgagagaaattctcacactcaattttaattttcttaaaaagaaaagatgggaaaatgttacagtatttaaatagtgaatgctgggcggcgacggcgacatggagagcggggcctacggcgtggccgaggcgggcggctccttcgacctgcggcccttcctgacgcagccgcaggtggtggcgcgcgccctgtgcttggtgagcccggggagggcgggccgggggcaccccgaggaccccccccgccgccaggcccggcgggacccctaacccacgagcgtgacaggtggaggcggccgcgtccgggccctggcggcgagcggggcgggcatttagcgtcccgggccccgccttcccgccctccacagtcttcgccttgatcgtgttctcctgcatctatggcgagggctacagcaacacccataagtctaagcagatgtactgcgtgttcaaccacaacgaggatgcctgccgctatggcagtgccatcggggtgctggccttcctggcctcggccttcttggtggtcgacgcgtatttcccccagatcagcaacgccactgaccgcaagtacctcgtcattggtgacctgctcttttcagctctctggaccttcctgtggtttgttggtttctgcttcctcaccaaccagtgggcggtcaccgacccggaggacgtgctggtgggggccgactctgcgagggcagccatcaccttcagcttcttttccatcttctcctggggtgtgctggcctccctgacctaccagcgctacaaggctggcgtggacgacttcatccagaactacgtcgaccccagtccggaccccaacactgcctacgcctcctacccaggtgcatctgtggacaactaccaacagccacccttcacccagaatgcggagaccaccgagggctaccagccgccccctgtgtactgagtggcggttagggtgggaagggggacagagagggccctcccctctgccctggactttcccatgagcctcctggaactgccaaaccccctctttcacctgttccatcctgtgcagctgacacacagctaaggagccttacagcccggcgggggctggccgagccacaccccacgtgcctgtgcccagagggcttcagtcagccgctcactcctccagggcacttttaggaaagggtttttagctagtgtttttccttgcttttaatgaccccatccccgcctggagtggctagaagccagcaggcacccatgtgctactgacaagtgcctcagcttccccccggcccgggtccggccgtgggagccgctgttacctgcgttctctgccaaagactcgtgggggccgtcacacctaccctgtgcagcggagccggaccaggctcttgtgtcctcactcaggtttgcttcccctgtgtccactgctgtatgatctgggggccaccaccctgtgccggtggcctctgggctgcctcccacggtgtgaaggcggggctggtgctcatggcacttccttcttgctcccacccctggcagcagggaatggctttgcctgacaacacccagctttatgtaaatattctgcagttgttacttaggaagcctggggagggcagaggtgtcccatggctcccaaactctgtctgtgccgagtgtattataaagtcgtaggggagatgcccggccctgggatgctgtttggagatggaataaatgttttctcattcaaaaaaaaaaaaaaattagtgaatgcttttgtaaaatagcagccaaaccaagaccaaaatgtttctttagtgtactttcatgcttaatgctgacagatagcattgtttgaactcacaatcaattttttatatataccttttcattacaaaacaaataatattcatggcagaaaatgaagaaaaccaaaaaacaaaaataagataagaaatttcacctgaaatcccaacacttaaaatgccatttaaaatattttcccaagtagccccattttttaaaatgagcaaattagcttcccacttaacttctttcacttaatactaaactgtgaataactttcacagtgtgattttcatttctgaaattgcccagcttctaaggcccactgcatgcaaggaatttagctaaaacacatagtccttgaggagatgacagtctagaagcagagacaatatacactgtagttaatgacagttaaaatgtccttaacaagattaaaaactcgtgggaaaagaatgaaatcctgtcattcacagcaacatggatgagcctggaggacataaggctaagtgaaataaaccaggcacagaaaggcagataccacatgatctctctcatgtagcgtcaaaaaggttgatcacatagaagtagagagcaaaacagtgattaccagagcctggggaggggaaacagggatgggaagaggttggtcaatgggcacaaagttacagttagacaggaagaataaatgctggtgttcccgtccatagtacgatgactacagctaataacaatgtagagtatatttcaagtgagctaataaagaggatcctgaaagttatcaccagaaataaatgtaaattttgtggtgaatgatatgctaactacccagatttggtcattatacaatgtatacatgtagtgaaacatcacactgtaccccataaatgtgtacaattattatatgtcaaatataaacactttttttttttgagacggagtcttgctctgttgcccaggctggagtgcagtggcgcaatctccgctcactgcaagctccgcctcctgggttcacgccattctcctgcctcagcctcctgagtagctgggactacaggcgcccaccaccacgcccagctaatttttttttgtattttcagtagacacggggtttcaccgtgttagccaggatggtctctatctcctgacctcgtgatctgcctgccttggcctcccaaagtgctgggattacagacatgagccacagtgcccgtcctaaacatgttttttaaaagaacacacaaaaaagaataaaattccctgagaactagctttatttcttccatttctgtggtctcctggtctcagactggaattgttttgttattaagtaaaaaccagccctcaactggccaaagcacaaaggtaagtcactgactcatgtaactaaactccctaggaacagacccagcttcagacagagctggatacaggctgctcatctgcctaatttggtctgggtgctgctccttggctcttggttagcttcctttctgttggttcctttctcctttgcagaggcaaaaacagcacacgcttttagttggagtcttgctgcctcctgggatgttcttcaccaccatcctggggattcactttgactcaatcttgggttgggttctttgtctccttatcccatatattcctcttctttgatttgctctcttattttggtggaggctccactctactagtttcctgagagaagctgccttggaatgaaatgttttgagactttgtatgaccaaaatgtttctttagtttacccttgtggttaatagttttgctggtgtgaaagagactgccagtgttacatatatcttgtcctcctttctttcctgggtacatgacgggattacctttgcaaaggactaacagtatctttgcagttaggtagtcttgtgatgagtgtagccaataaaatgaaaaaagaagtgtgtgacctccaggcccagggaattaatagcttgggtgctactccaggctctcttcccctgctgcaggagctttggaggccccttgtttcagagcaacatctcaaggtgaaaagaacctggatacctgaatcacaggatggaggggatcacctgccaacttgcctttgcatgaacaagaaggaagcgttgttaggctggcctactgagatgctagggtttctttctttccttcattttaaaattgcaacgttatctcagtggaatagattattcttaggtgcatcgttcatataaagaaaaattcatgtaatcccagcactttgggaggccgaggcaggcggatcacgaggtcaggagatcgagaccatctggctaacacagtgaaatcccatctctactaaaaatacaaaaaattagccgggcatggtggctggcgcctgtagtcccagctgctcaggaggctgaggcaggagaatggcgtgaacccgggaggcggagcttgcagcgagctgagattgtgccactgcactccagcctgggcgacagagcgagactctgtctcaaaaaaaaaaaaaaaaaaaaaaaaattcaaaacactcctgagggatacaaagaaaagtcaaagaggtggaaatctgtaatcttggaaaggaagattcaccaccaaaacagtaaccatagtggagagtgtgttaataataaagttgatgcaattccaataaatatcccaacaggattttcttttttgagggagagcgaaacaatctgattctaaagttaatgtggaaagaaaaactctaaggaaatataaagttaaattcggatctcacacctgactccaggataaattctagttgattaaaaaattaaatgtaaaaaaaagataccataaaatattagaataaacaatcatacttgttttgaatcaaatgctggggagggcatttctaggtacaacataaaactggggagccatcacagaagagtttgatagattcaattattctaaaatcaaaaagaaaaaatccacatgtaaaaaccctccccaggcaaagtcacaagacaaacagtaaactggcgagcatttgcaactcaaatcacatataaagaataatttcattgctgtatgttttagtccatttgtgctgccataacctgagatgggtaatttgcaataaatagaaatgtattaacccacagttctggaggctgggaattcctgagaggtcagtgtctgacaaggaccttcttgctgcatcatcccatggtggaaggcagagggcaagagagagggcaaggggctgaactcactcttttataataacatcaatcccacccatgagggcagagcccccatggcttaattacctcttaaaggtcccatctcttaataatgttacaatggcaatttaatttcaagggtatgtgccaccacacccagcaaattttttttggtattttttgcagagatggggttttgccatgtttcccaggctggtctcaaactcctgggctcaagcgatccacctgcctgggcctcccaaactgctagtattacagatgtgagccactgcacctggccttgtctcattttaatgtctctctggacctgataattaaaaagacttgcatttctcagataaaagtgattttctttttctcaaaaggatatgaacagagagaaaagaaaatgcatatggatcttcaaagatgaaatgatgttcagtctcactcataataagtaatttcacacaaactacaatgggatataatttttcacccactagaccaacaaatacttcaaaatttgataacacattgtattactgaggatacagggaaacaaggacaatcacaaattacttgtgggagtctaaattgtttgtaacccttacagggcacaatttgacaacatctaggaaaattttgcatgcaaataccctttgaaccagcaattctcttttaggaattcatttatatttatagatatgtgacatgatgtgtgcacaagtctcttcatggtgacactgtaacagcaaagacgagataagctaaacagtagtcaacaggggattgcttaaataaataacagtacagccacacaaagaaatattctgtagctctaaaaatgaataaagaagctctttatgaacagacatggattcatctccactgcatattgctcagtgaaaacagtgagttgtagagtatgtctacattatactactatttgtggttttcttaaatgaggaaaatatgtatagcttttgcatgaaaaaaatatctctagaatgaagtatgtacaaaaatctgttaatcatgactgttcatgggaaggggactggataggagagaaggtggaagggagaattttcaccattgatactttgaacccattgattttgggaccaagtgaatacactgcttatctaaaaattagaaatagttaaaatttaaaaagaaaatgtgcagtggctcacgcccgtaatcccagcactttgggaggccaaggcaggcagaacatctgaggtcaggagtttgagactagcctggccaacatggtgaaaccccgtctctactaaaaatgcaaaaattagccaggcatggtggtgggcgcctgtaatcccagctactcgggaggctgatgtaggagaattgcttgaaccccggaggtggagcttgcagtgagctgagatcgcgccactgcactccagcctgggcaacagagtaagtctccgtctcaaaaaaaaaaaaaaaaaaagaaaaaaagaaaaaaaatgtgaagagaacagtttgggcacttgaaacctacctttcagcatcattggtgatgtaacccttggggtggtcagtttataggccacacgtgtgagagtgccactctgctgtctagtctatcttagcaattttagggacactattgctgtgaggagtgacactgtccctgtccaccatatgagaagaatgtgggttttggtttccatttgctaagatgacattcagctgatatagtccagaggaaagaaaggaaaacagagcaactcccttttgatatcttagttgatgacagccataattagtgagtaagaaaaaatgaaaagatttccagtcgaagatgactgactaaacatgagaatttacccttcctccctgtttaaatcctatttcagggaccaaagggatataaaatggagagtaattctgtagcagcattggaaatttagaaaaggtgctttttgtgttttaaaaatagatttagggggtacaagtgaagttgtgttacatggatatattgcatagtggtgaagtcggggacttttattgcaactgtcacacaaatagtgtacatgacactcattaggtaatttctcatccctgagccccttctcaccctcccaccttttggagtctccaatgtctattgttttattctcaatgtccatgtgtacacattgtttagctccacttataagtgagaacatacactatttgactttctgtttctgagttatttcactgaagataatggcctccagttccatccatgttgctacaaaagacatggtttcattttttttaatggctgagcagtagtccatgatgtacatatatacaccacattttctttattcagtcatccattgatggacacttacgtttattccatgactttgctattgtgaataatgctgcaatgaacatacaagtgcaggtatctttttcatataatgatttcttttcctttgggcagatatccacgagtgagattcctatatcaaatggtagtactacttttatttctttgagaaatctccataccgttttccatagaaattgtactaatttatatttctaccaacagtctataagtgtttccttttctccacatccttgccaacatctgttgtttttttgacttttcatagccattctgactggtgtaagatttttgtttgtttttttgagatggagtcttgctctgttgcccgtgctggagtgcagtggtgtgatctcagctcactgcaagttctgcctcccgggttcactccattctcccacctcagcctcccgagtagctgggactacaggcgcccaccaccacgcccggctaatttctcttttctttttgtatttttagtagagacggggtttcaccgtgttagccaggatggtctcgatcttcttgtgatctgcctgcctcagcctcccaaagtcctgggattacaggtgtgagccaccgcgcccggccaagattttatctctttgtggttttagtttgcatttctctgatgattagtaatgttgaacattttttcatatgttcgttggtcacttgtatatatccttttgaaaaatgtttattcatgtcctttgcccactttttaatggggttatttttttcttgtacagttgtttgagttccttgtacattctgaatattagtcctttgttggatgcagagtctgcaaatattttctccctagacttcataaattacttcagtaaagtttcaggatacaaaatcaatggtacaaaaatcagtagcatttctatacacctataacaaccaagctgagaaccaaaccaagaactcaatcccatttacaatagctatgaaaaaaatacctaggaaaatatttaaccaaggaagtgaaagatctctacaaggagaactacaaaacactgatgaaagaaattgtagatgacacaaacaaatggaaaaatatcccatgctcctggattggaagaatcaatactgttaaaatgatcatactgcccaaagcaatctatggattcaatgcaattcctaccaaactactgtgttagtctgttctcaaattgctacagatacatgaaactgggtaatttttaaacaaaaaaggtttaattggctcacagttctgctggctgtacaggaggcatgactctggcatcttctcagtttctggggaggcctcaggacacttacaatcatagtggaaggcaaagggagagtgaggagtctcacatggtgggagcaggaacaagagagagaccggcaaggtgctacacccttttaaacaaccagatctcatgagcactcactcactatacagtaccaaaagggcatggtactaaaccattcatgagaaactgccctcatgatccaaccacctcccacgaggccccacctccaacactggggattacaatttcacatgagatttggtggggacacagatccaaataatatcaattaccaatgtcatttttcacaaaattaaaaaaaaatcctaaaattgatatggaaccaggaaagagtctgaatagccaaagcaatcttaagcaaaaagaacaaagctggaggcatcacattacctgactttaaactactctacaagtctatagtaaccaaaacagcatggtactagtaaaaaatagacacatagatcaatggaatggaatagggaacctagaaataaagccacatacctacaaccaacagatctttaacaacataaacaaaaatatacagtggggaaaggacaccctattcaataaatagtgttgagaaaattggccagtcatatgcagaagaatgaaactggaccaatatacaaaaattaactcaagataggattaaaaacttaaatgtaagacctgaaactataaaaatcctagaagaaaacctaagaaaaactcttctggacattggcctacacaaagaatttatgattaagacctcaaaagcaaatgcaacaaaaatgaacaaagaaaaacaggacttaaactaaaaggcttctgcacagcaaaagaaataatcagcagagtaaaacgacaacctacagaatgggaaaaatatttggaagggatgtttttaagagatcagaagagacaaaacattcttgaagatataaagtagatggaatcagattggtggcagttctagaatttgggtgcagaataaacctgctagcattgctccaaaataaaacaagaaattgtactaaaggtttaggtagtgctaaagagaaagagagggctgggcgcggtggctcacgcctgtaatcccagcactttggaaggccaaggtggacagatcaccagagatcaggagtttgagacaagcctgtccaatgtggtgaaaccccatctctactaaaaatacacacacacacacacacacacacacacacacacacacacaattagctgggtatggtggcacacacctgtaatcccagctactcgggaggcttaggcaggagaaggcggaggttgcagtgagctgagatcgcaccactgcactgcagtctgggtgacagagcgatactgtctcaaaaaaaaaaaagagagagagagagaaagagaggatgttggggctggagaatagaatcagtactctcaggtaacagatgcatggagtggggacaaggaggatacctactaagaagtcaagcaactcggagaatctaaatgtcagtctgtctagtcacaggtcaactcgttgctatgtcagaaaagcaatcagttctagaaaattaaaaacacattctaaaataaaaaatcgaatgactgtttcacaaagaatgggcctaaccgaagatcttatcagagagctgaaagactgaatagaggaattctcttagaatacagtgcaaaacaagatgacagggataaagccgaataagtcagcaattataattaatatgaccaatgtgtagtgctcatagagtacttgggttcaaatcctgcccaatcctttctgatcttgggtaggtcatggaatcactcaaatcctcagtttcttcagctgttaactggggacaaccagaagaactacctataggctaggtctgagcactgtataaaataacgcgggtaaagtgctcagtagaatacctgaattgagaggactcaatactgcttagctacgttcctatcactattaatattactaatgggccatcagacatgctaaaaataaatacctacaacagagtggagaccctgtcactaaaaacataaataaataagtaaataaaatatacaaccacactaacattcacaaaagtattctaaaataaaattattcaggaatgttgaaaattaaatgacaaaggtagtcacttatttacaaaatctgtgaaagatgagaaatgtgaaattaaaaaaatggaatttaaagccaaaaatattcaataggacagattttatatttacacataagaatacgaagacactagaagagcaatgaatctttatgcctgaacaacatgctatcagaatatataaagaaaaatgaattgataagttaacagtcaaaatgagaggatttagtaactttctcaggaaagaactgatttaatagacaaaaagcagttttagattttgagatcacaaggctgactctgtagtaatatacagaaatttgaactcagtatagaatatacactctttgtaagtacacgtatactatctacaaaaattgacatagtaataaaccaaaaagtctcaatgaatttcaaaaagcggaaaacatttaggctaattttctaactaccatgcaataaaaccagaaattagaaataacaaagaaaagaatatccccaatcaaaaaaaaaaaaagaaaaagaaagaaaaagttatatgtatttggagataaaaacaaagcaaaacagagaggctttctgttatttatgcgtaaaccaggaaatcatggttgcgattgccaacagtttatgctgggacaagggctcagtgtagtaaagccagcaggatgtggccaaaaaatgtaagaagacaagggaaaataaatgaactctaaatattaggagacaaagcatagaaagtagaaattttaaaataaaaaagcagaaattaatgaaacaaacaaacagggcaaacaacaaaatttgttaagccccaaatcgagttctttgaaaaatagctaatacaactgtgaaactactggcagacctgacccagaaaaaaaaaaggaagaattagaaaagaaatataactataaatagggaagagatttaaaacttgtaatcaactctatagaaataaattggaaaatgtgtaagaaatgaatatttttataaaaatgtaaactaccacaattaacgaaagagtcagaagacccaaatccttgctggttctgttgaagaaatggaaaaggtagtcagaggtccggccctgaaacaggcggcagatataggtagtgttatgggggatgctagtgaaccttcaaggagcatgtgattccagttattcaaactgtcagagcacaggaacagatggaaagttttccttctccttccaagtctagcaaaatcttgataacaaaactcatttgaacgataagtatatgaagtaatgcatatgttaattagcttgatttagccattccacagtgtctacatatatcaaaacatcatgttgtacaccacaaatatatacaatttttatttgtcaattaaaaaaataaagtcaaaacaaaacaaatttgcactcaaggggtacagaggtttgcatggaaatgcttcaaaaaggcctggaaataatccagatgctagcaggctacctcctagtggctggagaaagagggctgtcactttttaccctacacacttctgtacaattttatcttttttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgacatcacgcccggctaattttttgtatttttagtagagacagggtttcaccgtgttagccgggatggtctcgatctcctgacctcgtgatccgcccgcctcggcctcccaaagtgctgggattacaggctcttttttcaataagtatgtatgagtggattaacaatggaatgattgtttaatgcattcattattttattactttttaaaccataagaagaggtaggaagtattatctacataaggggttggcaaatttttttctgtagagagcaagatagtaaatattttagtctttgggggccatgcggtctgttgcaactactcaaccttggtggctagcatggaagaaaccacagactatatgtaaatgaatggatgtggctgtgttccgttaaaattttatttcaaaaacaggctgcaggttggatttggtccactgccatactttgctaaatctgatttctatatcagtggggaaattggtattttgatatattttattaagcctcagtccaatattttattcatttatttaaaaatatttactaaagacctttatgttccaggcactgctgtaggaactaggagtactgggaacataccagtgaataacacaaagccactatcgtcatggtggttgcattctattctgagaaaacagacaacaagcacatgcagaacaaaaacaacaaaacaaaacaaaacaaaaaacatgctcaagagtgatcaatgctataaagaaaacaaagcaggataagagatagagggcgctggagtgggggttggtacagttttagaggggatggtaagaaaagcctctgggccgggcgcggtggctcacgcctgtaatcccagcactctgggaggccgaggcgggcggatcacaaggtcaggagatgagaccattctggctaacacggcgaaaccccgtctttactaaaaatacaaaaaattagccgggcgtggtggcgcgagcctatagtcccagctactccggaggctgaggcaggaaaatcgcttgaacctggcatgcggaggttgcagtgagccgagatcgcaccactgcactccagcctgggcgacagagccagactccgtctcaaaaaaagaaaagaaaagaaaagtctctctgaacgatatgtgaccatcagggagtgtgaagtcctgagccagaaccaggagaaggctgatgtgtctacagggggctgagaggcgggtgatggggtgacggtggtgcagggaatccagggtctgggcagtgactcggaggaagacaacatggtgagcagttgtaagatcctgaacacagtttgaaggtggagctggcaggaatactggtggctgggatgtggagtgagggaaagagaagggcggagaatgattcaagtctttggacagaatggccatttgctaagacctgagcaagtaatgggtttggtggggcgctagttctgagttgttgttgttgttgttgttgttgttttgaagacggtgtctcactcttgttgcccaggctggagtgcgatggcgctatctctgctcactgcaacctccgccttcccggttcaagcgattctcctgcctcacccttccaaatagctggaattacaggcgcccaccaccacacccggctaattttttgtatttttttaggagagacggggtttcgccatgttggccaggctggtcttgaactcctgacctcaggtgatccaccctcctcggcctcccaaagtgctgggattacaggcgtgagccaccgcctggttttgcatgtgttgttggggctgcctgttagactgcaagtggcttctgtgaataagcagtgaattggagggtctggggttcagggaggggtcaggctggagaggcaaatatggtacttatagggtagaggcccatgagatcatcaggaaaacactcggagagtgtgcaatgaagaagacctggggccccggagcaatataaggatacaggatccaggattcagaaaaagagaggaaaagctgggcaagagagcaaggaggaacagggggaagtgtgagcctcagaacccaagagaaatgttaatgaaaggccaaaagatgagaaccaagaaggttctcactggcaaccttaacggaagagtggggtacagaataggttcaagaaggaatgtgatgtgaggaagtcaaatccagcgcttggaggccccggctttgggacagagaattggtccctgcagagcacggtctgaggccagtgtgactttcacctctgctcactgcaggacaaccagagagctccatcccaggctgagctgggctctgaaattaaaaggtggattgaaaaggttccttccccttttgtgtgtatgtcggggtaggagggggtggagggtgagggctgctggaagaaggtgaggaatgaaacaaaaatgggcaatacattctgataagcatgtaaacaggggccaatgcaagggtgtatggaaacagaggaggctcccatcccatttgtccaggtctgttcagtggaggacaaggggagtttgaaaataaaatgcccaaggatttaatcaaccaaagagccaggaccctccatacgtacgatgttgccatgatgaccatgcccgtgtgggtggtagtttggccgtttcctatccaaggcggacgccccggtgggcaggggtaggtgggaggcctgtgtttccatcctgaagcttaagaaccaggccggcccatctcgggtttgtgtctgggcacatgcaccctgtgggtgagatgcaccaggtcattgtaggccacaggctctggaaagggcacagaacacggggcctgaagcaagtcacttcagctcagaacctcagtttccaagcctgccattttggggaactggggttcatgataccagggagtgaaaaattctaggtataatacatgaccagcatttctttctacttctcccacacgattcccttttcagcagattaaatgtttgtgagccaaagcacaacgtgggcttcgcttctctctgcatgcttcagccttgtccagacatggcgtgtcacctgtgtctccggcagtcaccagctgtcctccaggctgctgctgtgggcttctcattggtggatccgaggtcctggatactgtcgccttggtgaatgcacagtgatgcgtgtggggaggtgcagaagctcttccgagttattctctgcacttacagattgagtttatcccgtgatgaagctcaaaatcagttatgcttttctatctcctctgttgtatttctcctcaacgtccacttctgtgagtgagtaaggttgtctgttttgacagctgaatgaacagaaaaaggaggttttaaaagcaaaagtctgctgtgtcccagtttcccagttaactccattctctctagccattcatggcatggagacagaaaaatcacagagcaatcagagtgcattttctgaaatcagtctcaactgcggagtgggaacgtgccactctgaggaacttccttccggcccggcttttgtgacatgtcgtgtggtagcggtcgtattccatcccaccttgtcctccaatgctgagctcaaggatttgggaaagcacatggtcccaccccgaggtcacagggagggctttcgccacagcagatgtgtgtgccgttcacatgtcctcgacagccagcggagtcacaattgattttgatgttaatatggcaaaatccattagggagaaaaactttcccccattcattgactcacaacccaagtagaaattgttttttgacattatccacattcctgttcttcccatgaggcatatttgaggcgggcagatcacctgaggtcaggagttcgagaccagcctggccaaaatgctgaaacaccgtctctattacaaatacaaaaattggctgggtgtggtggtgcgtgcctgtaatcccagctacttggagaagctgaggctggagaattgcttgaacccaggaggcggaggttgcagtgagccgagatctcaccactgcactccagcctgggtgacagaaaaagactgtctcaaaaaaaaaaaaaaaaaagagctgacattctaggtgtttaataataccatactatcatatctagtgtgataaaataacaacatgcattttccacaggactatatttcaaaagagtatgagatgattatattatatttttagaccaaagtttcactgatgcagaaaaatctgtaagttgcaggtttatttttaataaacaaaatcgactttatgcaccttgtaggttaacctaaccgacattattgtaatttattcagtaggtagggaagtttgaactctactcttgaattcatggcgggatatattaatagtagggagcatgcggggaagtacgcagacattgttagcaataagcagtgaacacacagggagtggtgatataaagataaaccaatacagacagaatgtccaaataaggccccagtagggcatgttttccacgtttcctagcagggttgggaataccctatttagattttcagaccagaaaagggtaatgaagtcagagagattagcctgggcagaaagggaagaatggaccaggggccatccattcttccctgtgctggtgagagcacaggtcacggctacagagaggggggtcaacctaaggatgcaggcagggttggctataacagttccttgggaaatggaagtgtaggaatattgttggcttagttttaaacccagaagaggaaatagctctggaacttaggctgggggatgggggcagaaaggactcaggtctttattcctagactactccagtacatatcttaccccatgggcacctgtatcaacagactctgagggaaaggtttgcagcagacatggaccttgaaaatgctggaaaaagagaaggtgctgatcctccccaggaatcagaagaccaaaagccttagaaactcaaagaaagaaagctatagcaggggggctactttggctcccagacttcagctctcagggccaacatagagctatgatttgaggactgttctttccatctgtattagttagaattcctccagagaaagagaaccaacagaatacaaacacacacacacacacacacacacacaaagatattgagataaacatctcagtatatatgtgtgtatatttatatacacatataaaatttgatgaaatgtattttaatgaattggcttaagagactgtgaagcagtagtagatccaaactatgcagggttgaccagcagactggagacccaaggaagagttacagttagattccaaatgcagtctgttggcagaattccttctttctcaggaagggttagtctctgttctattgtctttaactgattgaatgagatcccccacattttgaatagtaatctgcttttactcaaagttcaccaattaatttattaaattatttatttgagatggagttttgccctgtcgcccagactggattgcagtggcgtgatctcagctcactgcaacctccacctcccaggttcaagagattcccctgcctcagcctcctgagtagctgggattgcaggcgtgcgccaccacacctggataattttttttttgtatttttagtagagacgggatttcaccatgttggccaggctggccttgaactcctgacctcaggcgatccacctgcctcggtctcccaaagtgctgggattacaggcgtgagccaccgtgcccagcccaaagttcaccaatttaaatgttaatttcatccaaaaaaaaaaaaagaaacatccagaataatgtttgaccaaagatctgggcactgacctggccaaactgacacataaaattaattatcacaccatcttaacactgtccctgggtaaaggactaaaaaagaaaagacagaaggaagaaggagctaggacccagggataggtaggatgtatcaaggaataagaatcagcatactgtgtttccacaaaacacaagaaagaaagtaaaaatctagaaagatctgcagcactgtttaattcagtacatgtgcctcaggtatttctgggggctggttggggggccagtcccaggcaaactgaaggtgcggaagcggtggtgggattagcttagtcagcaggcctggtacgcatggactagttgcataaagtactggaagccttggacctgatggttgtcttcagagtaaaaaaggaggtaagcagaaaaatgcagtctacaagctgctgagtcagttaccacttagcatgacttgagtgccaaagatatgacaggcatagagtagtttggggcacagaagaacagatcagaggaggttacaggtttttgtgcatttaatccttacgacaaatttatgagacaggtgctgttctttatcctcattttccagatgagaatctaaggcatagaaaggtttagcagtttgcccaaggctgcacaatacttgtgatgcttaattttgtcttaacttagccaagccgtggtgcccagttgtttggtcaaacatcagcctacatgttgctatgaaagtatttttttagatgtgatgaactttttttttttttttattgagacagagtttcactcttgtgacccacactggactgtaatggcatgatcttggctcactgcaacctctgcctcctgagttcaagcgattctcctgccttagccttccgagtagctaggatcataggtgcccaccaccacacccagctaatttttttgtatttttagtaggaacagggtttcaccatgttggtcaggctgctctcaaactcctgacctcaggcgatccacccgcctcggcctcccaaagtgctgggattacaggtgtgaggagtcatgcctggccagatgtgatgaacatttatatcagtagacttcgagtaatacatatttcccttcataatgtgcatgggcctcatccaatcagtagaaggccttaagagcaaagactgaggtttcctgaggaagaaggaattctctttaaaactgtcacatggaaactctgcctgagtttctagtctcctgccccatggaattcagattcaagactgactgcaacattgactcttacctgaatttccagcctgtcagttttccctacagattctggacttgccagtccccatagttgtgtgagccaattccttaaaatagatctctttctctcagcatgtgtgcatattacagttacatataaatgaggctctgtctctctctccatactgaaagcaggaagtagaagaggaaaagaaacagaaatcacatttttgtcaaatcccagaggcacttgcagtccagaatcttgtattaggaagggcagtgggtgatggggcaaaccttacctcctggatggggctgtcaggacttcatgtctccatggagggggcccaccccagaaccaccagctcagccccagccagcaaaagcctcctggctcttcaggagcctgctatcacagggaacccaagtccacccacgtcaggctcagggaccttggagggctttgtcctgcgattacattggtctctatccagcaaaagaaaagttggaaagcagtctgtgtgctttctaaatgaacacactgtgataatgggggcccaaagtacatatttctaataacaaacctgattagaggtaaaattaattgtatatgctatttaaacatagtatatgttgagttgtatattatatttttttacaatacttactcatggttgtgccttggatgcttatatgccataagcaagttaaagaaaacatatggcttacataccaactattgacattccattcatgcctttattttttattgtttatttttattttttttgagacagagtcttgctgtgttgcccaggctggagtgcagtggtgcaatctcagctcattgcaacctctgcctctcaggttcaagcaattctcctgcctccacctcctaagtagctgggattacagactcccaccaccacacccacctaatttttgtatttttagtagagatagggtttcaccatgttggccaggctgatctcgaactcctgacctcaaccgatctgcctgccttggcctcccaaagtgttgggattacagcatgagccaccatgcccagcctccattcatgcctccagaggtgggaaggacactgcatggagtagggaccatttggatcgttgctttgtgttctcattttatgcaaattcttcctatcagacagtctgtacctgcaaggaatagccatgaaggcttaccgcagttcaagtgttactctagcccacaaaacacataatttatgagccaaaagagaagctggaggccatttatgttggagcaacttcaaaatgtctcaccagcaattaagactatttttgttttcctttcggagaagcattagcacacattttagagaatgaccgcttaatttataacctcttactcatattttagaggtttactactgaagggcagagttatttggaatgttcggaatgagttgcatcatcttgttttaggctccagcaaagaacaaaaactaagaacagacaccaggcacacacttcaacggcatcaagtgcccacagtcaaatggagtcaagtgcccacagtcaaataccattcttctcatactgcggaacaaccaaaaaaatcacacagtggcctaagtatgtcctagaaaatattagcatcagcaaaacaacgtgtaagtagccaaaggacgcagtggaacaagaactatgaggagaggaagaaaatgaaaagtaaaaagacaggcctttttaaagattacaaacacaccgagaatgttaacatacttgttacataattggagactttgttcttgatcttcagtgtcaaaagcactgctacgatcgggttgagttccaacccttgctttttcttctgcagcagatgcattttgtaaggtcctatgggtttattctgcattataacacaaatgggtatcacatttctggcaagctcacccactggttgcttttcttttttaaaattataacaatatgttgctggagatttagctatcccaaattgtatacaaaagaacaaacattattcagtttacatttctctaaacaaacatccattcattcattgaaaaataagtcattaccagttgttcaaaataaataagtgcttgtctcggctaggaatagagtggccctttttcaaaagtgcatgctgctatttttctgaacatgcggctttgagaggaaatacccacattcttttttaatttaatttaattttattttattattattatactttaagttttagggtacatgtgcacaatgtgcaggttagttacatatgtaaacgtgccatactgctgtactgcacccattaactcgtcatttagcattaagtatatctcctaatgctatccctcccccctccccccaccccacaacagtccccagagtgtgatgttccccttcctgtgtccatgtgttctcattgttcaattcccacctgtgagtaagaacatgcggtgtttggttttttgtccttgtgatagtttactgagaatgacgatttccaatttcatccatgtccctacaaaggacatgaactcatcattttttatggctgcatagtattccatggtgtatatgtgccacattttcttaatctagtctatcattgttggacatttgggttggttccaagactttgctattgtgaatagtgccgcaatgaacatacgtgtgcatgtgtctttatagcagcatgatttatagtcctttgggtatatacccagtaatgggatggctgggtcaaatggtatttctagttctagatccctgaggaattgccacactgtcttccacaaaatacctaggaatccaacttacaagggacgtgaaagacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccagtgactttcttcacagaattggaaaaaactactttaaagttcatatggaaccaaaaaagagcccgcatcgccaaatcaatcctaagccaaaagaacaaagctggaggcatcacactacctgacttcaaactatactacaaggctacagtaaccaaaacagcatggtactggtaccaaaatagagatatagatcaatggaacagaacagagccctcagaaataatgccgcatatctacaactatctgatctttgacaaacctgagaaaaacaagcaatagggaaaggattccctatttaataaatggtgctgggaaaactggctagccatatgtagaaagctgaagctggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaatcaaactaaagagcttctgcacagcaaaagaaactaccatcagagtgaccaggcaacctacaaaatgggagaaaattttcacaacctactcatgtgacaaagggctaatatccagaatctacaatgaactcaaacaaatttacaagaaaaaaccaaacaaccccatcaaaaagtggacaaaggacatgaacagacacttctcaaaagaagacatttatgcagccaaaaaacacatgaaaaaatgctcaccatcactggccatcagagaaatgcaaatcaaaaccacaatcagataccatctcataccagttagaatggcaatcattaaaaagtcagaaaacaacaggtgctggagaggatgtggagaaataggaacacttttacactgctggtggaaatacccacattctttgcaatatttaaaaaagggcttcatggaatcaggggaggaaggaaaaggaggcaccagaatcactttcaaatatggcttcttcctgagcctctgaccgatgatgcgcacgacttccccatcttgggcttgggtttgggcttggtccctcttgagcttgggaaccagaatcagagggggttctggctgacttctaagactcaccagttgaactcgtcttgctcttcctcgggatctgaccatgatttctgcctctgcctggacagcaccttcacagcacacctggttgaacgcttctgccacttggttccctcataggcctttccaccctgcttcccatcaggcccaagaggcaatggtccccagcaaagagctgatagcacatggattgaaaccttctgtgggtcccctttaactctcaaagcccgccccacgcacctcttcacccacccctgcccaaaccaccctccacctttgttcacgtcttctgctcctccagctcctgaaggcggcgtccatcctcccatcatcgtgtagtcagtggcagccctgtgcctgctggttgtaaacacataagcatgcaatcacactgaatcacgtcactgtggaaaagcccatcccaagagacaagctatgggaaagatggtttcgggaaccactttccctgagctttcctggtatgttcacacttcaattgcccttctagctctagctcttgctcatcttcccaatgggagaaggtcaggaacaaaagaaatgtggtggccactttaagaggtgggaaatgctgtagggatgagcctcttgcccctactccccagtccctgggaggtggctcttcccctgtaattagaggtgccagtcattctttttatggtacaagtgacctgttgcaacaaccagtattgtccacaaacaacattaaaatgtggatataaaacatgaagagacagtataggacttccaggccccatgaatatcactagccatgatagcgaaataccgcaggttcttgccttcagctttgtgctgaattgataatcctgccttctacggagcactctgcagccacactgctcacttggagctttcttgctgtgctaccctaggatgcagttatttaatagtctgtgtttctaatcacggcagctgattgtttttgtatcacaagaactataaggcttcctcagaatttatatgagctgagtctaccccatacagtgagaggaaatggatttccttctgaagttggatgtcgttataaccgatcataaatcaccctctttgggggcacccacaaagggtgagccccattgaacacagatggatcacccagtgctgagagggacttgagactttgcaaagtacttgctttatagcctgggattgattattacccagggcatcacttacaaacattagtctgaaagtctacattctgaccactggtatgacattcaggtagcaaaagaacttgaacattttcagattttcttttttctctctttcttttcttccttccttcctttctttcttttcttttctttttttttgagacacaggtattataaggtattataataataatacattattattattatttttgagacacagcttcgctcttatcactcaggctggagtgcaatggcatgatctcggctcactgcaacctccacctcctgggttcaagtgattctcctgcctcagcctctcgactagctgggattacaggcacctgccaccatgcctggctaatttttgtatttttagtagagatggggtttcaccatgttggccaggctggtctcgaactcctgacctcaggtgatctgcccgcctcagcctcccagagtgttgggattacaggcgtgagccaccacgcccagctgagaattttatttttcaaaaaaaaaaaaaaaaatctcaaaaacaatctctccagttaaactctggtaatataattgctatatctttttttaaaatacaacttttaagtagttttagattctcatggaagttgcaaaaacatgtagctttcattcagctacatagatgaataaatacttctcagaaaaaaattgtattacatgacagcctaaagtaacataagaagccattcataagtattcattttcaccaacttgactttttcaggggattgattattttattcaatgttatgggggctgtggaatggaagggcttgtaattaacccacaatttgccacaactatcctaaaagccaagggcaatttttccagagacaaatcttaaaatatatgatgtcaatatattgtaaaatataaaagcttaactttattacaaaagcttaaaatataagcctgggcccttatggttctgtcttggagaaatgtaggcaaatgaagaccagcaaccaaatgctgcttcaaaatagttcaaatccttttcttgcaattctctaaaacctgaataggtccacatgcacacaggccatcgtatcacaaaataggaattccctgttcttgcatctgtccccgttactcctgcaactttcccagaacatccgctgcagttaccttccccaaacccttctcttctgaccagccctgttcaccttttctttctcacactcttctttccctcccccactcttcatttctttatgacattggtcaacccaaaccctctcctagcaagaaagaatcttttctcttgagaaggaaggaggttgggaaattagaataggcaattataggtctctctttggaaggctgggagaagagaaacagttgggaagacttccatgccagtttttttttttttttgagatggagtctcactctgttgcccaggctggagtgcagtggcaccatcttggctcactgcaacctccgcctcccaggctcaagccattctactgcctcagcctcccaggtagctggggctataggcatgtgccactacacccagataatttttttgtatttttagcagtgacagggtttcacctcaaatgatccacccgcctcggcctcccaaagtgctgggattacaggcgtcagccacctcaccctgccccatgccaatttttttaaatgacaactttattgagatgtaatgtgcataccacagaaatcacccttttaaatatatgtaacatatttaatatattttaaaatatttactatattaaatattaacatatttatatttatatagcatattatataacatatttattatatattatatatttattataatatatataatatataatatattaatataaaatatatactatatattatattaatatatcattatatatgattacatattataatatattaatacaatatattatattaatatatgatattatattatcatatattatataatatatgatatatcatatattatataatatatgatatatcatatattaatataatactaattattataataatatattatataatgatatataataataatataataattatattatatatttatatataatattatattatattatttttattatttattttttattttttatttttttatttttattttttatttttattttattttattttattttttaaatttatttttatatttttattttattttattttatttttttattttttatttttattatatattatattatattatattataatattattatataataataatgtaatatattatattatatatatttatatcatattatataacatatttatatttatataacattatataacatttatatttaatattaacatatatttaatatattaaatatatataactatatataaatatttatattagttcagtagtttttggcatattcacagttgtgtgcaaacatcataatctaatctcagaacattttcattatctcaaaaagaaatactgtatctgtcagcagtcacttcccattcccccactacttctgctcctggcaaccactaatctactttgtctctgtggattttcctattatggacatttcataggaacggaaacctacagatgtacgttttgtgatgggcttctttctcttagcataaagttttaaaggttcatctgtgttgtagcatgcatcagtaattcatttctttttacaaaataatattctgttgtgcagagagaccatattttgtttatccatctggttgatgggcaattgggttgtttctactttttggctattatgaataatgctgctatgaaccttcttagaccagtttttcatggacacattttcatttatcttgagtttaggaaccaagaatggagttggtagatcatacgtcaactctagcattttgaagaaccatgatcatttttgtgcctctacgtgcagaatgaaagctaagtccagcttccttaacctattaatattttatgtcttgcacttaaaaatcctcattaaaacaagaaagatataaatatttctataagatgattagaaatcatccctcaggttgtgtcaggagctgtgcacggttttattgggcatcacagatgcttacttctatatcacgagattttagagagaagcattgggtatttttattaaagtaaaaatcaatgcagggttgaaactcatgattacatactgtggctgggtacctgatattttggttagatcataattaagcttactactttttagagcaaactatgtccttacctttgtaataaagaaaaaaacaggtgagtaggtaagggcagaattcctccagatgagagcagaaagcacagaaggcacttgcacctttgaaaaggagctacaggagaaaagcctccactctcttgggatagcaatcctgagggaggatctctcggtactcctttaaggagaacagccatcagacgccaagtgcgggagcgcctgactcacagtgaattccttcaggatcttctctttataactcatcagtatccgagagccacttgttcctcttctccttttctctctgtgttcttgtctcactgtcataaaaccaagacttggctcttctctcaaacatcctggtgtgtggagaactcgggaaatatctccctcctgggtcttgctgctctgtgccctccgtgggcaatgtccacaccgcaccgacacctacaaccaaaaccatactgccacctggaattattacagatctgcgggaggaagggaggcttcagattaaagccaggagctgcccaatgctgaccgtcctgtcccaagacaattgtgctgcactaatcaaccccttgccgcagtaaacttcaaaagacgaaaagagatgcagtctggctaacccctgatcaatgtaaatccctcctttatctccaaataatcatttccccagctccccacaccctcaaatgatgactttcaacactttgaatataacaggctcacagtctgtattcaatggtctcatcataaggcaggaagccctatcaggaactgcgctgctctcctatccctacacttcccaccacgtagttcggggttaggcagggaattgcagtaaagctatacacagtaaagaaaagttggtttgtgtgtgtgtgtgtgtgttgtttgtttgttttttgagaccgagtttcgctctttgcccaggctggagtgcagtgggacaatctcggctcactgcaaactccgcctcccgggttcaagtgattctcctgcctcagcctcccgagtagctgggattacaggtgcatgccgccacagccagctaatttttgtattattagtagagacggggtttcactatgttggccaggctggtctcgaactcctgacctcaggtgatccacccaccttgacctcccaaagtgctgggattacaggcgtgagccatcttgcccggccggcatttcagttttattaaactgtctactgcatgccagttcttagtagcacagtctctttttttgttttagaaactcaaaaccttctaagtgatcacctggttaaataatgcaatcccataaatgacccctctcttctgatccatgcctggtgtccatttaattaaaccagattagaaaaagggattattgctggctcagggaggctgctgccacagacaatgcctcacttcggattgtgcagatataatatgattgctccaagccagccttcatgtttacacctgcctggaagctctcaggccctggagtaacctcaggacactcctggccctgtctgcgggtaaccagttcttctctcagatgtgcggtctgtgctgttcctccccatctgccagtacaagtaaggtgtggcacctgggcccttctcccactcacattgcctgtgtcctctctctaaaagtcaccttaagaccatgcgggtaaagaggagtgacttaaaggagctcaaattcatcttacttttttccagttgggaaattggcaaaaagttctgtagttatggaaatattcttgccagtttatagaagcaattagatctttttctatagcatctgtgtggaagatttccttttcaggaaatcaaaactcctttgagtggcctgacaatagtaaccataagaaaataattttcctggaattgcttctgagctcgtttgtgaactggagagtataactttgtgtcactatactccattttactaaccatgtggttcagatgctttgtcattttggagccttggtgaccctggagagactgcgtcttccagggttagccagttcctagagatagcaaagaacttgcctgaaagcctgcctttcatacacaaatcaaccaatccattacagaccagcctggccaacatggtaaaaccctgtctctgctaaaaatacaaaaaattagctggacatggtggtacatgcctgtaatcccagctactggggaagctgagacaggagaatctcttgaacctgggaggcggagcttgcagtgagccaaggtcgcgccactgcactccagcctgggcgacagagcgggactccatctcaaaaaaaaaaaaaaaaaaaaaaaaaaaaaaaaaatcaagcaatccagtgctcataccccagccccctcctttctcagactcctatactctgggccaggatccacctgccctagtcaccccagggccagctaccagaatactacggacagccgtatgccccagtcaatcatgccccagaaattattcaaaccagtcagtgctaagtctgcttaccctgcctcacctgtcccttcccgtggaaaccacaagaaaggctcttgccctcgttttcctcctgctctgtctcctgacctacctggtgccccttcctcttgggaacagtaaaaaactctctttccagcagcagtcatctcctgatctgttggcctcatcacacctgaatcataataatacctatctttaataacagccatggaaagtataaacctggggttgggctgggacaacattgtgaagctcttttagcttcatgaataacggggccgggggcagtcacaatccctgctacactcttcagcagtagcaatttctggaaatgcagccctcattgaagcttccga

SEQ ID NO: 804 - DNA, 23341 bp, Homo sapiens
gagaagccacacttacttgaggatgtccttcttattgaagaaggtgcagtcctgttgagggaaaacacacaacacacagtcagtgtgcggctcccagactttcttcctcagaggcctcgatgccacagggctcacaggggatagctccggactggggacagaagagtcactactatccctttccaccttgccctcacccactggggacagctggctctagtaggtatagaaaatgcctcccaaaacctttatccatcctgggctaggcctaaggagcttagtgcatggtggggggctgtagcatgctttagggtacacatgtaggaggaagatgaatgctcacaggtatgcgtggctgatttgagtgccagtgggatacactgggggatgacagggaggtggctgggagacaactccgaatgaggacccacagggccacctcgtgtagctgcatggggtgccatcctcactgtagccctgagcatggtgctaggggggttgtgcagtcccaggctcagagactgagagttccaggcacatagactggggaagcatcagtatatacttggtgtctgaagccagaaagggatgaggtcacccagagaagggagtgaagaggccagggagatatgggagggagaaacgtgggcagggggaaccaggtagcatctggggtagaggtgagggtaggggctgctggggatccccaggtaagcattactccaggtggggggcagcacttggctcctagggccatccagatgacaaactcatctcggaggggtcctgtctttgtttagatgaactgcctctatccacagcttggcctgcccaaggtgagtatcaaccactgggagtcagtgacaatggccactatgccagcccttggtgaaaagtatagaggtgaagaggacccagcactttgtaaaatgcccaaccgtaaagggcttttgtgcacctcccctgctgtttagctcctccgcctttgtccactgttacagcatgaagcaagaaggcctcctaggtctgcagagcccagagcccatagggcctcctggggccataagctgaccagagccagctctgatgaggagtgaatggctgaaactcaggcctgcaaacagccaggcttgccctgaatgagacctgaagccgctggacatcagggcaattggattgcgtgttaagaggcccaaagagaggacgcctgcaggatgcacacaacatctggggtttccactgggtgccttcgggagagctgaaaaggggagagctggtgggaatttccaggccccatttggcccaacaagtctgtccttctaagctgctgctccctgggagttagactaaggatccatgctggcttcttggaaacacgaggggttctcctgggggtctcagctttgcttttgacagtggttcctctgtaggagcccagaaaggctcaggctggggaagcagtgccccctgctcctcacccaacacagacagaaaactccctacttagcaggcctcaggcacagacaggctggagacacagtgggctgatttatcagcaaactccagaaacatggtgcagaatgtggacttccctccaccccagggccgtttccatggtctaaggtgcccagtgagaagggccagggctctcccacctagcctggaggaggcagtcagcagaactggaaatggggagaggtcccaactcctgctctcttccccccgatctgtcctccttcccctcccctcttctctctcctatcccatgtgttggaaaggaactatccaggtcctgattcaagggttctcctgacaaaagatgcaaacacttcccctataaccctgctccctgtcacaattacttacacctccctacatcaatggtcctcacgctgtggctcctggaccagcagcatcagcctcactgggaacttggtgaaaatgtagattcttaggctccactccagatctcttgaatcagaaactctgtgggtggggtccagggatctgcactttaaaaaaccctcccaatgatgctgatgcatgttgaagtgtgaggaagtctgctctagagcagaatcacttgggggactgtttaggatacctgtgtcccccatccctcagcagaccccagacaaattgtagagaaatccccaaggatggatccaggcattggctgttttcaaagccactcaggtggtcccaacgtgcaacccaggctgaaaaccacatcacaaccagtacatgatgtaccatgcacctggcacctggggctctaaatatccaatttttcttaatccttatcattagccaatgggggtgggcattatctctctatcttaaagatgggcaacttgagactcagcaaagttgagtagcttgccttaagttgcacacacagcccaggagggctgggaatggaacttaggcctctgtgcttccctttcccctgccccccccccttttttttttgagacggagtcttgctctgtcacccaggctggagtacagtggcatgatctcagctcactgcaacctccgcctcctgggttcaagtgattctcctgtctcagccttccaagtagctgggattacaggcatgcgccaccatgcctggctaatttttgtattcttagtatagagatggggtttcaccatattggtcaggctggtctcgaactcctgacctcaggtgttcacccaactaggcttcccaaagtgccgggattataggcatgagctaccacgcatagccttctttttttctttttaatgggagtagaccttggggccctcactggcaaggaagcagaggcaagaaaagatcctctgtgcttcttggccactgcctatgactacaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttggctcccgcggccggaagtgctgggggcgcgcgggggtctcggaggcggggacaaagacccggagcggcggcgactccgccccgcagcaggaagaggtgtgagcccgggtcccgccgtgggagtccaggtcgcacggcgtgagggtgcggggcctgggaaaaaaccctctcgaggcgggcagtggggcgagtggcgccccttgacctggggcgggggcggcagcgaggactgtgagtgcgtggatctagctggggccgggctccgccaccgtctcgcgtcgcgaccttggtcaagcccttacccgggccctgtccctctggggagaaggagggggtcagtcaagctgacatctgaggccctcccggccaggcctcgggaagcccatctggcctttgggcgcggcctaggcagggcatctcagaccttctgtgttccttagggagcaggacaggatttacttggcttggttacaaacgtgagacttgagaggatttaaaggacttgactgtgtccacagaagtgtgacaaaggccaagacattttttggagcttttaagcagatgccattgtaagggaagcaggactttacctctgccctcctagggtctttggctgggcttgagaattaatttggcataagacagattaaggggagaaaaacagatttaatacaagttttacatgacgtggaagccctcataaggaaatgaagaccctgagaactggcaaaatctaaatacttttttttttttttgagatggagtctccctctgtcgcccaggctggagtgcagtagcgcgatcttggctcgctacaacctccgcctcctgggttcaagcgattcttctgcctcagcctcccctagtaggtgggactacaggggcatgccaccacacccagctaatttttttttgtatttttagtagagagaggtttcaccatgttggctgggctggtctcgaaatcttgacctcaggtgatccacctgcctcagcctcccgaagtgctaggattagaggcctgagtcaccacgcccggccaattattgtattttttttgtagagatggggttttgccgtgttgcccaggctggttttgaattcccaggctcgagcaatccacccactttggcttctcacccaaagtgctgggattataggatgtgagccatcatgcccggcctcatctcctgttttttagaaaaagaaggatgatcaagagtgcccttcttgcatctgctatttttcaagtgcctttaactcaaatactcaatatgccagagcagcatatgttgtggtggcatgttctgaactccttccccatccaccaaatggagtcaccgctatctttttggggtccagcccatacaactgttatttctaaactcaggacaactgaatcagtaggtattatctccatattataggcaaagagttgggctgagagaggttcagtaacttgcccagggtcccacagctgggaattagtagaacctggactggacccaggcactggctcaacataccattccacaactgccagtggactttgaagagatcaggatttttttttatttatatatataaaaaaaaatagagatggagtctcactatgttgtccaggctggtctccaactcccaggttcaagtgatccttctgccttggcctcccaaagtactaggattacaggcgtgagccaccatgcctgggcgagatcaagactttatgctttaaaatgcgtggtttgttactttaggatagtggttctgaaaccacctgggagcatgtatcaaaattacttgggaggctgcacccctagattttctgatttagaaggtctggggtggctaagaatgtgggtatcgaaagggttcctgggtgacactgatgcagctggtcttggaaccatactttgagagtgcttaggctgctgaagcttgtgggttctgatgggaacagggcttcaagtttggcagatgatccctcatgcttttagttttcttttatatctgaggctactggttggggttttccaaccttattttgccactccctggtgagaacagcagccatcagctaaacagacatgtcaccctgttaaaatcacaagagtcttcagaggcaccatcaattgctatcagaggggtaagaagcaattcattagcctggggattggtgaccagccttcaggggtcacctcaccatcttttcatcattgtggacacatgcaataggggcctaacccatgggaaagaaggcaggatgtgtccccagagatttggagcatgtggaattttagagcagagaaggcacatttaaaagattctctcttctgtacctcccctttttcctgtgttggagttggggaaaaggaaacccttttgaaaccacataaccactattacacaagttttccttcttcccatcttattagattccacactgtgcatgaacaagccagaattctgtgtgttcagatcctgctctggcgcattcttgtacaattgctaacatgctgcttatttgcataccaggtgttccaggtagaaaatctggaacctatacaaagaggactgtgttttcagtcccgggagcccttcctctcataggagagaaatagaggtaaccaactgaactagaaaattcctctcaaaaatccttttaggccaggtgcggtggctcacacctgtaatcccaacactttgggaggccgacacagacggatcacctgaggtcaggagtttgagaccagcctggtcaacatggcgaaaccctgtctctgctaaaaatacaaaaaattggcctggcgtggtggcgtgcctgtagtcccagctactcaggaggctgaggcaggaggatcacttgaacccgagaggcagaggttgctgtgagccaagatcgtgccattgcactccagccggggcgacaagagcgaaactccatctcaaaaaaaaaaaaaaatctttttggatcattattaccatggcctatctgaagctctctctcttgagcaatgctgtgaggaggggcaaggaacacaattcccatgttacagataagaaacctggggctcagagaggccaaatgacttgcctgatgccccccagctgggaagtggcaaagcaaagctctaacgtcgttctctgattccaaatcctgtgctttagctgctccctgatgttgagtgtggtccctgaggagcagagtgtgtgtgtttgctgggagggaggatgggccgagggagaagaataaaacattactgattacttatctagtgcccagaattgtactggatgtgctatatttactgaatttgattattccacaatagcctcctcagtctgtggagtttcatattattatcccatttcacaggtgaagaaatagtttcagagaaggtgacttgcccaaggtcacatagctggtaacaggtagatttaaatctgggccctgactcttttcttttcttttttctttttttttttttttttttttgagacagtcttactctgtcgcccaggggcatgatctcagctcactgcaacctctgcctcccgggtttaagtgattcttctgcctcagcctcctgagtagctgggactacaggtgggagccaccacacccagctaatttttgtatttttaatagagacggtgtttcaccatgttggccaggctggtctcgaactcctgacctcctcagcctcccaaagttgggattacaggcatgagccaccgtgccctgccggactcttctcttgatcacacagtctaggacagggaaacgtggttaccagtgtttaaagggggctgactccttgtcaattgcagtcttgtaaataatgtaaaaggaaaaggcagcaggggtgccagatactcattaaatgttagcttattttttttcatttctgattcacacaatgaagtttattttaaaatttggaaggaaaacaggaataaatgctaccaagtgcttctttgggatgagaggtcatcttgacctgctgcccaagtgctcgtttgtgatgatgatgcactttgtgatcaagatgacctctcatcccagagaagccttgtagcatttactgcagaacaactcaatctgcaagttgttcttctaagacttagaatctagatagatctttttgtttgtttgtttttgttttgttttgtttttttgagacggagtctcgctctgtcgcccaggctggagtgcagtggcgcgatcttggctcactgcaagctccgcctcctgggttcctgccattctcctgcctcagcctcttaagtagctgggactgcaggcgcctgccaccatgcccagctatttttttgtatttttagtagagacggggtttcactgtgttagccaggatggtcttgatctcctgaccctgtgatccgcccgtctcagcctgaatctaggtagatcttaatgacagagatggaagatccctgggcccaaggtctgggtgggaccatctcttaaagtaaacgaagcctgcagcctgtcttctagcagctctgtgggccctgtgagtcattccccagtcctccactcaaatcctttactatcccacctctactttttatcagctcaggaccccacctgctatcttggctcatgggaatcttctctatcttaggggcaattcaaatcttactcttatctttacctataaagcattgtcatcttggcgtcttccctgacatggctgtgatttatagtgtgtgagcagttactaggtctgcctcagtctctctctctttctctctctctccctctctctctcacacacacataccctgcaaccccttgtttaacctggcctatatcctagcactgaacagcttgtctctgtttctctagcattttgcacatagtaggttcttaatgagtatttggtggataaataaatacacaccctgggactgtttttttttttgtcctgaggagggttatttttccctctcaaacactaagaaacaggagggctgggaccagggctgggaccacatgttcgtctgtatccccagacacagaggaatctcccagggtctagcacatggtcttagcaaatgtaaaatcaacaccctttaaaagagtacattttcctggacctgttcatacatttaatcaactagatccccaaatattctgacttgaaaaagattttcttactggaggatttagtgaccagtcgtttagcgcagagccaacagaatgaaacccctttctctcttccgggagactgacctgccctagagccttccccagaagctactctggatgtgagaagttactggatggctcaaatgggaccccagctggatggcgactgtcctgttgttgagggaggagggggtcaatttcctccacaaatctgcttcttctggatcgtgtcccacccacctcttggatgcctttgacatctttggaggcacccttgatttctctccttccctcagacccctcagtccattagcacagccagtcatatctagaagccagccacttcttagcactccattgctatcactgtggtccacgcccccctcacctctctcctgttatggccgtatctatcatgaaatgacctaaaccaattcatccacaactaggttcattttactgcagatctcagtaatctccagtaatgagtggtaggtaggggtgttgtgtttccttccacaaaccttgctatgagggggtctgaggcaagcaagtctcagactgaagtccacaccttgtaccatcacttatcagcaagcaggtccccaacagtcatataaccttctctatgagctcaatgaaggcctagctccctgaccttttgcatatttcaataaactttcctcttgaaagatttagttcaggctgggtgcagtgctcatgcctataatcccagtaccttgggaggctgaggcaggaggatcacttgagctcaggagtttgagaccagcctgggcaacatagtgagaaccccatctctaaaaaaaatacaaaaaatagctggacgtggtggcacacgcctgtagtcccaactactcaggaggctgaggtgggaagatcacttgagcctgaggggttgaggccgcagtgagctgagattgcaccactgcactccagcctgagcaacagagtgagactctgtctcagaaaataggggggagggatttcattcaaggaagttgcaaacaatatttaaggagcaagatttgaacaaccttcaatttgggatcaggcaactgcattcttactcagaagcttgaacctgaccagacggactcctaagacctagaccccatcaaaactccctaggtttttgtgtcctgtctgtctgtgtaagggcagaggtacttggacaacccttcacatatctaaaataccactcatttgatcaatggacaattatttcagccatccattttgctaatgaacagaccctctgctgctggaatggcatcaagacagctgaagcccttgtggaagggtctctggagtgtgggcttctgggtaaagtcccaactgcttctagaatggcctctctcaaagtgtgatcgtgggtctcctggggtctctgggatcttttcagagagtctgcaagggcaacaatatctcataataatactgagacattatttgcctttttcattctcattttctcacaagtgtagagtgaagatttccagaagttatatgggtatgtgatattgcaacaggttgaatgaagaagcaaatgtgagaatccagcagttttctattttgtttttgtttttttgagacagagtctcgctctgtcacccaggctggagtgcagtggtgtgatctctgctccctgcaagctctgcctcccgggttcatgccattctcctgcctcagactcccgcccggctaatttttttgtatttttagtagacacagggtttcaccatgttagccaggatggtctcgatctcctgacctcgtgatccgcctgcctcagcctcccaaagtgctgggattacaggtgtgagccactgtgcccagcccgagcagttttctattaagccaagctctaaagacatttgcaagcatgtaaaacaatgccactcttctcaataaatatttttgtcttcaaatatatgattatttttcataaaagtctgttaactaagccaacatataatggttttgtctttgcagtgggtaggaagaacccatcgggtgattacacttgccaagctttcagtatcagagaggaaggtgggggtgtccgtagggtgaaaatagcaccccaaatgtcttagatcctcatactttttttttgagatggagtctcactctgccacccaggctggagtgtagtgatgtaatctcggctcactgcaaccttggcctctcaggttcaagcaattcttatgcctcagcctcctgagtagctaggactacaggcgcccaccaccatgcccagctaatttttttttttttttgtattttttttgtattttttttttttgtagagctagggtttcaccatgttggccaagctggtcttgaactccttacctcaggtgatccgcccacctcggcctcccaaagtgctgggattacaggcgtgagccaccgcaactggccagatcctcatactttttaagaacaggctgctttcatcatcaagaggagctcttcatcacacttaaggtggttctgcaagacctctgggagaatcccagtgagctggggtccctgtgtctgtagaggcctggcatcatggtttacacaaaaggaacaaaagaaactacctgggaatcccttaacccttcccaagctctatcaactcaggtcacattgatgtctctgaagcatcttgtcataatatgaactgtcttccagagctatctttgtggctctcccaggctactatgggttcctcagaggcaggccctgaatgattagatgttcatttctgtgtttggaggattgttgggaagtttgtgtagggagggttctcatttaatcagtttccctgcatcttctgatctgatcagcccaggagaatgggagcttcagcaggtctgtgtgaccgcaaccattcttgtgttgctataaagaaatacctgagactgggtaatttataaagaggtttaattggttcatggttctgcaggctgtgcaggaaacatggcttctgatgaggcctcaggaagcttttattctcggcagaaggtgaaacagcagcttgcgtaacacaggtggaaagcaggagcaagggggaggtgccatacacttttaaatgaccagatcgcactataactcactatcacaaagacagcaccaagccatgggggacctggccccaaacaccttccaccaggccccacctctagcattggggattacacttcaacatgagatttgggcggggacaaatatccaaagtatatcaaagtcttttgtcattctattagcttcagcttactcaaacatctttaaagatgttataaggtgtcacattaatcagagagtcttctgaattctccgtgggagtgttaataactccattttacaggtgagagaatggaaggtcaaattcacacatctggagagtgtcaatgtgagaactgggacccaggtttgcctggaggatcttccactattgccctggcacctatactgagaataaatgttgtccctttgaaaggggcagctagttcctttgttcaccccagagactatgagaataggctttcaagtatttactccattaaccttgcagcccaaggctcagctactccaggaagagagagggactgggagtcagtatctgctttgagggaagttttatcactttttatagcaacctctgaacttgacccatggacttaggcagatagagcaaagccagtccctgcagtataaacagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgtttcagtggattgggatcaactgtttgaatatttaccctctagatcagtgttcgtatgggagggatactgctccctaaggaatgttttgagctgtatgggtgttttgtggatgcaatgacaagagggtactatttccacttagtgcctgggttttggggatgctgatgttctgtaatgccgggacaatcctgcccactggagaatgtctcatgtcctgcaggaccttgaggagatcaaccagatactcctgtaggaaacaaacctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctcaaaaaaaagaaagaaaaagaattttgcttgaccccatacaacacacctgtattcatctgcatttgtgaacgtcaccatcactgtgattcatggtctattaacatctacttttttagctcttatttttaaatgtcaaagataaaaactgtggcctgaatattatcatacctctctcaaatccaaacttacttgttataagtaggtgcaagcatgtgactgcttcataatgtcttttagagtttaggcctgagcatttatgtattgaaacccattattttattacagtattccttttatttctctttcatattacagtagcagcattatattgattttgttttttcattatgtgtataagtggtttagattatccatgaatttcgtttcagtatggtaaagaggatattcaaaatatttgttataaaaagggagcatctggcagcattgagaaccactctaaggttcaggaggcagggacttcgcctcccctgggttactccattcttctttgtgcctagcatagggcctggaatatcacagatgcacaaagaatcttttctgaatgagtgatgaaggaattgaggctgatactctggtttggtaaccacctaggtatgtgatgaggccctctgctgagatgggaacacaggagagagggcaggttttggggagagtaatgagttcagttttcattgtgaaagtttggagagccctggaatttctaggtggagaggcctgaggcccagggctgtgtgggccttgatttctctcaaggccacagaagagtggaaagtgcaaagtcgtagtaacagttcatctctttagtcagtaatcattgctgagtctctccatgcaggatgaatagaccagtgagagctgcccatgaggtgtctccctcctcctgtggtgatctgtgtacctgcccaggccctcagaggctaggagctcctccaaggtaggggatagaaatccttcatctctagcccctctgacttcctgccccatcctgacatagtaggtggctcggcaatgatagctggagggaccacgcagtaaaacccatctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaatataacttgaccgtcatgaggaatgaaggactgatgcatgctatgatatggataagtcttgaaaacatcatgctaaatgaaagaagccagacacaagagaccagatattttatgactccgtttatatgaaatgcccagagtaggtgaatacattgggatgtaaaagagattggtggttgccagggtctgggagaggggagatggggagtggctgatggaacaagccatatggaaaagcattccaggcattgggagcagtaagtgcaaaggccctgcagtgggaggaagcatggccgattaaagaacagcaaggaggtaggtcggcttcaagggagacagtggtgggggagaagctcagagaggggctagcaggactagaccctttagggctttatggggcactgccagggcattgccttttacttggagagagacaggatgtcgctggcagctttgggcagagaaggatgtatctgtcttatgtttgaacacaatccctctggcaggagatggattttaaggggtagaagtagggaagccagtttgggggccactgtgttggttcaggcaagaggtaactctgacttggaccctggtggcagcagctgccaaggggaaaagtgtccaaaactgaacctattttgaaaacagctcatcttcaggcttttggcctcagcaactagaaggctggagttgaattttattgggtgggggaattctgtgggagggagcaggtttccttctactctttgttcacatataaaaagaagttataagagaacatagataatagtttaaatttttatttttttctgaacattcaaccataaacatttatcaagatgctaaagtcttcataatactcactttaaaaatgttttttttggccaggcgcggtcgctcatgcctgtaatcccagcacttgggaggccgaggcaggcggatcacgaggtcaggagatcaagaccaccctggctaacatggtgaaaccctgtctctactaaaaatacaaaaaattagctgagcatggtggcgggcgcctgtagttccagctacttgggaggctgaggcaggagaatggcatgaacgcaggagaatggcgtgaacccaggaggcggagcttgcagtgagccaagacagcgccactgcactccagcctgggcgacagagccagactccatctcaaaaaaaaaaattattttttaattttatttttagagataaggtcttcctctgtcatccaggctggagtgcagtggtgcaatcatggctcactgtagcctctaactcctgggctcaagtgagccttccacctcagcctcccaagtggctgggactacaggtacatgccaccatgcctggctaaatttttatattttgtagagactatgtcttgctatgttgcccaggctggtcttcaactcctggcctcaagtgatcacctcggcctcccaaagtgctgggattgcagatgtgaaccaccatgccaggccattgatcacttttgaaggctgcatgatggtccacttcattcatttcccctaaattacataaccatttcttctgttaatcatttagactgcttttttctctttttagttttcaaaattaaggataattgtataatgaatatctttgtgttgatggctttttctttctggatttttttccccaagagtttaattctcaggaatggatttactaggtgaaagagtaagaacagttaatgtctctcttaagacacattgctaaactgttttccaaagagattgtggaaatgtataaggccagccaagcagtgcgccataaattggatggtataaggcattgcattttattaatatttttaaataaaaataattttttttagaaatttgcatgcatttgactattgttaagattgaacatttatttaaaagtttatttggctgtgaattgattattcaggtccttttcccgttttgttttgtttttttttttcccgagacggagtcttactcagtcacccaggctggagtgcagtggtgtgatctcgcctcactgcaacttccacctcccaggttcaagtgattctcctgcctcagcctccccagtagctgggactacaggtgtgcaccaccatgcctccctaagttttgtatttttagtagagagggggttttactatgttaaccaggctggtcttgacctcctgaccttgtgatctgcccgcctcggcctccaaaagtgctgggattacaggaatgagccaccatgcccggcctatgttttttgttttgttttgtttgagacagagtcttactctgtcgcccaggctggagtgcagtggcacgatctcggctcactgcaacctcggcctcccaggttcaagcagttctctgcctcagcctcctttgtagctgggattacaggtacccgccaccacgcccagctaattttttgtatttttagtagagacaggctttcaccatcttggccaggctggtcttgaactccggacctcgtgatccacccacctctgcctcccaaagtgctgggattacaggcgtgagccaccgcgcccagtccccttttcccatttatttactaaagtcctaataccttctttaccaatttgttggatcttttcctaacttagagatagggatgaaccctttgccaatcatatctttaatgaaaataatattttaaataaagtaggaaaactgttgaaatgaatttcttttgtaacaaaaaataaacatttggtatgtgaataatgtatattctgttttgctgatttattcacttaaaaattgctatcttgattttattatttatttatttgacacagagtctcgctctgtcacccaggttggagtgcagtggtgcgatcttggatcactgcaatctccgcctcccaggttcaagtgattctcctgcctcagcgtcctgagtagctgggactacagatgcacaccaccacccctggctaatttttgttacttttaggagagatggggtttcaccatattggccaggctggtctcaaactcctgacctcaggcgatccacccacctctgcctcccaaagtgctgcgattacaggagtgagccaccgcacctggcctcttgattttaaaatctttttttttttccttagagtgaagcacacctggattggatagtgcttgttattacagataagggtgcactttctagattcttctcctgagtggcaaagttttcccaccgtcttgtccaaacatactttgctgatggtatctctgggcactacacagtgcaagggacaaggaaaaagggcttttccagaggagagtgacctgcatcttggaggaactctagaacatgttcgaggaatggtgactggggcttctggagccaagggctgactcagggaacagatctcagctcaaggtgaggtcatttctgtttcctgcatgtccctccagctgctgacattttacctcttcaaggactgattcaaatgccatctccattgtgcaatcttccttgatcaccccccaacttccatctgagacttctgagtttctccctcactagatctggagggtaggagtgggtcttgttcattttttgttctcacagtgcacttgctagagaatggcttgggaagcctttgtaggattggactggccctcagcgaaagttcagcagttaggagaactgccttagtacttaggaagcttcctagtgtgaatgccagcatcatcacttactagctgtacttcagttttctcatagggttgttgtgaagattaaatgaagactggacaaagtcagtcaatgtttatttcacaatcactgagcagcaagtattccttgtgtaccagtc

SEQ ID NO: 805 - DNA, 17239 bp, Homo sapiens
gaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttggctcccgcggccggaagtgctgggggcgcgcgggggtctcggaggcggggacaaagacccggagcggcggcgactccgccccgcagcaggaagaggtgtgagcccgggtcccgccgtgggagtccaggtcgcacggcgtgagggtgcggggcctgggaaaaaaccctctcgaggcgggcagtggggcgagtggcgccccttgacctggggcgggggcggcagcgaggactgtgagtgcgtggatctagctggggccgggctccgccaccgtctcgcgtcgcgaccttggtcaagcccttacccgggccctgtccctctggggagaaggagggggtcagtcaagctgacatctgaggccctcccggccaggcctcgggaagcccatctggcctttgggcgcggcctaggcagggcatctcagaccttctgtgttccttagggagcaggacaggatttacttggcttggttacaaacgtgagacttgagaggatttaaaggacttgactgtgtccacagaagtgtgacaaaggccaagacattttttggagcttttaagcagatgccattgtaagggaagcaggactttacctctgccctcctagggtctttggctgggcttgagaattaatttggcataagacagattaaggggagaaaaacagatttaatacaagttttacatgacgtggaagccctcataaggaaatgaagaccctgagaactggcaaaatctaaatacttttttttttttttgagatggagtctccctctgtcgcccaggctggagtgcagtagcgcgatcttggctcgctacaacctccgcctcctgggttcaagcgattcttctgcctcagcctcccctagtaggtgggactacaggggcatgccaccacacccagctaatttttttttgtatttttagtagagagaggtttcaccatgttggctgggctggtctcgaaatcttgacctcaggtgatccacctgcctcagcctcccgaagtgctaggattagaggcctgagtcaccacgcccggccaattattgtattttttttgtagagatggggttttgccgtgttgcccaggctggttttgaattcccaggctcgagcaatccacccactttggcttctcacccaaagtgctgggattataggatgtgagccatcatgcccggcctcatctcctgttttttagaaaaagaaggatgatcaagagtgcccttcttgcatctgctatttttcaagtgcctttaactcaaatactcaatatgccagagcagcatatgttgtggtggcatgttctgaactccttccccatccaccaaatggagtcaccgctatctttttggggtccagcccatacaactgttatttctaaactcaggacaactgaatcagtaggtattatctccatattataggcaaagagttgggctgagagaggttcagtaacttgcccagggtcccacagctgggaattagtagaacctggactggacccaggcactggctcaacataccattccacaactgccagtggactttgaagagatcaggatttttttttatttatatatataaaaaaaaatagagatggagtctcactatgttgtccaggctggtctccaactcccaggttcaagtgatccttctgccttggcctcccaaagtactaggattacaggcgtgagccaccatgcctgggcgagatcaagactttatgctttaaaatgcgtggtttgttactttaggatagtggttctgaaaccacctgggagcatgtatcaaaattacttgggaggctgcacccctagattttctgatttagaaggtctggggtggctaagaatgtgggtatcgaaagggttcctgggtgacactgatgcagctggtcttggaaccatactttgagagtgcttaggctgctgaagcttgtgggttctgatgggaacagggcttcaagtttggcagatgatccctcatgcttttagttttcttttatatctgaggctactggttggggttttccaaccttattttgccactccctggtgagaacagcagccatcagctaaacagacatgtcaccctgttaaaatcacaagagtcttcagaggcaccatcaattgctatcagaggggtaagaagcaattcattagcctggggattggtgaccagccttcaggggtcacctcaccatcttttcatcattgtggacacatgcaataggggcctaacccatgggaaagaaggcaggatgtgtccccagagatttggagcatgtggaattttagagcagagaaggcacatttaaaagattctctcttctgtacctcccctttttcctgtgttggagttggggaaaaggaaacccttttgaaaccacataaccactattacacaagttttccttcttcccatcttattagattccacactgtgcatgaacaagccagaattctgtgtgttcagatcctgctctggcgcattcttgtacaattgctaacatgctgcttatttgcataccaggtgttccaggtagaaaatctggaacctatacaaagaggactgtgttttcagtcccgggagcccttcctctcataggagagaaatagaggtaaccaactgaactagaaaattcctctcaaaaatccttttaggccaggtgcggtggctcacacctgtaatcccaacactttgggaggccgacacagacggatcacctgaggtcaggagtttgagaccagcctggtcaacatggcgaaaccctgtctctgctaaaaatacaaaaaattggcctggcgtggtggcgtgcctgtagtcccagctactcaggaggctgaggcaggaggatcacttgaacccgagaggcagaggttgctgtgagccaagatcgtgccattgcactccagccggggcgacaagagcgaaactccatctcaaaaaaaaaaaaaaatctttttggatcattattaccatggcctatctgaagctctctctcttgagcaatgctgtgaggaggggcaaggaacacaattcccatgttacagataagaaacctggggctcagagaggccaaatgacttgcctgatgccccccagctgggaagtggcaaagcaaagctctaacgtcgttctctgattccaaatcctgtgctttagctgctccctgatgttgagtgtggtccctgaggagcagagtgtgtgtgtttgctgggagggaggatgggccgagggagaagaataaaacattactgattacttatctagtgcccagaattgtactggatgtgctatatttactgaatttgattattccacaatagcctcctcagtctgtggagtttcatattattatcccatttcacaggtgaagaaatagtttcagagaaggtgacttgcccaaggtcacatagctggtaacaggtagatttaaatctgggccctgactcttttcttttcttttttctttttttttttttttttttttgagacagtcttactctgtcgcccaggggcatgatctcagctcactgcaacctctgcctcccgggtttaagtgattcttctgcctcagcctcctgagtagctgggactacaggtgggagccaccacacccagctaatttttgtatttttaatagagacggtgtttcaccatgttggccaggctggtctcgaactcctgacctcctcagcctcccaaagttgggattacaggcatgagccaccgtgccctgccggactcttctcttgatcacacagtctaggacagggaaacgtggttaccagtgtttaaagggggctgactccttgtcaattgcagtcttgtaaataatgtaaaaggaaaaggcagcaggggtgccagatactcattaaatgttagcttattttttttcatttctgattcacacaatgaagtttattttaaaatttggaaggaaaacaggaataaatgctaccaagtgcttctttgggatgagaggtcatcttgacctgctgcccaagtgctcgtttgtgatgatgatgcactttgtgatcaagatgacctctcatcccagagaagccttgtagcatttactgcagaacaactcaatctgcaagttgttcttctaagacttagaatctagatagatctttttgtttgtttgtttttgttttgttttgtttttttgagacggagtctcgctctgtcgcccaggctggagtgcagtggcgcgatcttggctcactgcaagctccgcctcctgggttcctgccattctcctgcctcagcctcttaagtagctgggactgcaggcgcctgccaccatgcccagctatttttttgtatttttagtagagacggggtttcactgtgttagccaggatggtcttgatctcctgaccctgtgatccgcccgtctcagcctgaatctaggtagatcttaatgacagagatggaagatccctgggcccaaggtctgggtgggaccatctcttaaagtaaacgaagcctgcagcctgtcttctagcagctctgtgggccctgtgagtcattccccagtcctccactcaaatcctttactatcccacctctactttttatcagctcaggaccccacctgctatcttggctcatgggaatcttctctatcttaggggcaattcaaatcttactcttatctttacctataaagcattgtcatcttggcgtcttccctgacatggctgtgatttatagtgtgtgagcagttactaggtctgcctcagtctctctctctttctctctctctccctctctctctcacacacacataccctgcaaccccttgtttaacctggcctatatcctagcactgaacagcttgtctctgtttctctagcattttgcacatagtaggttcttaatgagtatttggtggataaataaatacacaccctgggactgtttttttttttgtcctgaggagggttatttttccctctcaaacactaagaaacaggagggctgggaccagggctgggaccacatgttcgtctgtatccccagacacagaggaatctcccagggtctagcacatggtcttagcaaatgtaaaatcaacaccctttaaaagagtacattttcctggacctgttcatacatttaatcaactagatccccaaatattctgacttgaaaaagattttcttactggaggatttagtgaccagtcgtttagcgcagagccaacagaatgaaacccctttctctcttccgggagactgacctgccctagagccttccccagaagctactctggatgtgagaagttactggatggctcaaatgggaccccagctggatggcgactgtcctgttgttgagggaggagggggtcaatttcctccacaaatctgcttcttctggatcgtgtcccacccacctcttggatgcctttgacatctttggaggcacccttgatttctctccttccctcagacccctcagtccattagcacagccagtcatatctagaagccagccacttcttagcactccattgctatcactgtggtccacgcccccctcacctctctcctgttatggccgtatctatcatgaaatgacctaaaccaattcatccacaactaggttcattttactgcagatctcagtaatctccagtaatgagtggtaggtaggggtgttgtgtttccttccacaaaccttgctatgagggggtctgaggcaagcaagtctcagactgaagtccacaccttgtaccatcacttatcagcaagcaggtccccaacagtcatataaccttctctatgagctcaatgaaggcctagctccctgaccttttgcatatttcaataaactttcctcttgaaagatttagttcaggctgggtgcagtgctcatgcctataatcccagtaccttgggaggctgaggcaggaggatcacttgagctcaggagtttgagaccagcctgggcaacatagtgagaaccccatctctaaaaaaaatacaaaaaatagctggacgtggtggcacacgcctgtagtcccaactactcaggaggctgaggtgggaagatcacttgagcctgaggggttgaggccgcagtgagctgagattgcaccactgcactccagcctgagcaacagagtgagactctgtctcagaaaataggggggagggatttcattcaaggaagttgcaaacaatatttaaggagcaagatttgaacaaccttcaatttgggatcaggcaactgcattcttactcagaagcttgaacctgaccagacggactcctaagacctagaccccatcaaaactccctaggtttttgtgtcctgtctgtctgtgtaagggcagaggtacttggacaacccttcacatatctaaaataccactcatttgatcaatggacaattatttcagccatccattttgctaatgaacagaccctctgctgctggaatggcatcaagacagctgaagcccttgtggaagggtctctggagtgtgggcttctgggtaaagtcccaactgcttctagaatggcctctctcaaagtgtgatcgtgggtctcctggggtctctgggatcttttcagagagtctgcaagggcaacaatatctcataataatactgagacattatttgcctttttcattctcattttctcacaagtgtagagtgaagatttccagaagttatatgggtatgtgatattgcaacaggttgaatgaagaagcaaatgtgagaatccagcagttttctattttgtttttgtttttttgagacagagtctcgctctgtcacccaggctggagtgcagtggtgtgatctctgctccctgcaagctctgcctcccgggttcatgccattctcctgcctcagactcccgcccggctaatttttttgtatttttagtagacacagggtttcaccatgttagccaggatggtctcgatctcctgacctcgtgatccgcctgcctcagcctcccaaagtgctgggattacaggtgtgagccactgtgcccagcccgagcagttttctattaagccaagctctaaagacatttgcaagcatgtaaaacaatgccactcttctcaataaatatttttgtcttcaaatatatgattatttttcataaaagtctgttaactaagccaacatataatggttttgtctttgcagtgggtaggaagaacccatcgggtgattacacttgccaagctttcagtatcagagaggaaggtgggggtgtccgtagggtgaaaatagcaccccaaatgtcttagatcctcatactttttttttgagatggagtctcactctgccacccaggctggagtgtagtgatgtaatctcggctcactgcaaccttggcctctcaggttcaagcaattcttatgcctcagcctcctgagtagctaggactacaggcgcccaccaccatgcccagctaatttttttttttttttgtattttttttgtattttttttttttgtagagctagggtttcaccatgttggccaagctggtcttgaactccttacctcaggtgatccgcccacctcggcctcccaaagtgctgggattacaggcgtgagccaccgcaactggccagatcctcatactttttaagaacaggctgctttcatcatcaagaggagctcttcatcacacttaaggtggttctgcaagacctctgggagaatcccagtgagctggggtccctgtgtctgtagaggcctggcatcatggtttacacaaaaggaacaaaagaaactacctgggaatcccttaacccttcccaagctctatcaactcaggtcacattgatgtctctgaagcatcttgtcataatatgaactgtcttccagagctatctttgtggctctcccaggctactatgggttcctcagaggcaggccctgaatgattagatgttcatttctgtgtttggaggattgttgggaagtttgtgtagggagggttctcatttaatcagtttccctgcatcttctgatctgatcagcccaggagaatgggagcttcagcaggtctgtgtgaccgcaaccattcttgtgttgctataaagaaatacctgagactgggtaatttataaagaggtttaattggttcatggttctgcaggctgtgcaggaaacatggcttctgatgaggcctcaggaagcttttattctcggcagaaggtgaaacagcagcttgcgtaacacaggtggaaagcaggagcaagggggaggtgccatacacttttaaatgaccagatcgcactataactcactatcacaaagacagcaccaagccatgggggacctggccccaaacaccttccaccaggccccacctctagcattggggattacacttcaacatgagatttgggcggggacaaatatccaaagtatatcaaagtcttttgtcattctattagcttcagcttactcaaacatctttaaagatgttataaggtgtcacattaatcagagagtcttctgaattctccgtgggagtgttaataactccattttacaggtgagagaatggaaggtcaaattcacacatctggagagtgtcaatgtgagaactgggacccaggtttgcctggaggatcttccactattgccctggcacctatactgagaataaatgttgtccctttgaaaggggcagctagttcctttgttcaccccagagactatgagaataggctttcaagtatttactccattaaccttgcagcccaaggctcagctactccaggaagagagagggactgggagtcagtatctgctttgagggaagttttatcactttttatagcaacctctgaacttgacccatggacttaggcagatagagcaaagccagtccctgcagtataaacagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgtttcagtggattgggatcaactgtttgaatatttaccctctagatcagtgttcgtatgggagggatactgctccctaaggaatgttttgagctgtatgggtgttttgtggatgcaatgacaagagggtactatttccacttagtgcctgggttttggggatgctgatgttctgtaatgccgggacaatcctgcccactggagaatgtctcatgtcctgcaggaccttgaggagatcaaccagatactcctgtaggaaacaaacctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctcaaaaaaaagaaagaaaaagaattttgcttgaccccatacaacacacctgtattcatctgcatttgtgaacgtcaccatcactgtgattcatggtctattaacatctacttttttagctcttatttttaaatgtcaaagataaaaactgtggcctgaatattatcatacctctctcaaatccaaacttacttgttataagtaggtgcaagcatgtgactgcttcataatgtcttttagagtttaggcctgagcatttatgtattgaaacccattattttattacagtattccttttatttctctttcatattacagtagcagcattatattgattttgttttttcattatgtgtataagtggtttagattatccatgaatttcgtttcagtatggtaaagaggatattcaaaatatttgttataaaaagggagcatctggcagcattgagaaccactctaaggttcaggaggcagggacttcgcctcccctgggttactccattcttctttgtgcctagcatagggcctggaatatcacagatgcacaaagaatcttttctgaatgagtgatgaaggaattgaggctgatactctggtttggtaaccacctaggtatgtgatgaggccctctgctgagatgggaacacaggagagagggcaggttttggggagagtaatgagttcagttttcattgtgaaagtttggagagccctggaatttctaggtggagaggcctgaggcccagggctgtgtgggccttgatttctctcaaggccacagaagagtggaaagtgcaaagtcgtagtaacagttcatctctttagtcagtaatcattgctgagtctctccatgcaggatgaatagaccagtgagagctgcccatgaggtgtctccctcctcctgtggtgatctgtgtacctgcccaggccctcagaggctaggagctcctccaaggtaggggatagaaatccttcatctctagcccctctgacttcctgccccatcctgacatagtaggtggctcggcaatgatagctggagggaccacgcagtaaaacccatctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaatataacttgaccgtcatgaggaatgaaggactgatgcatgctatgatatggataagtcttgaaaacatcatgctaaatgaaagaagccagacacaagagaccagatattttatgactccgtttatatgaaatgcccagagtaggtgaatacattgggatgtaaaagagattggtggttgccagggtctgggagaggggagatggggagtggctgatggaacaagccatatggaaaagcattccaggcattgggagcagtaagtgcaaaggccctgcagtgggaggaagcatggccgattaaagaacagcaaggaggtaggtcggcttcaagggagacagtggtgggggagaagctcagagaggggctagcaggactagaccctttagggctttatggggcactgccagggcattgccttttacttggagagagacaggatgtcgctggcagctttgggcagagaaggatgtatctgtcttatgtttgaacacaatccctctggcaggagatggattttaaggggtagaagtagggaagccagtttgggggccactgtgttggttcaggcaagaggtaactctgacttggaccctggtggcagcagctgccaaggggaaaagtgtccaaaactgaacctattttgaaaacagctcatcttcaggcttttggcctcagcaactagaaggctggagttgaattttattgggtgggggaattctgtgggagggagcaggtttccttctactctttgttcacatataaaaagaagttataagagaacatagataatagtttaaatttttatttttt

SEQ ID NO: 806 - DNA, 33617 bp, Homo sapiens
taaggggatgctaacaacctattgttgctttctttatttctaaacaccctccccattttactccctcagaaactacaaagcacctgctgtatattgtacaggttaaaatgatgtcacatttaaattggatttttaaggctgggcgtggtggtttacgcctatgatcccagcactttgggaggctgaggcagaaggatcacctgagctcaggagttccaggccagcctggccgatgtggcaaaaccttgtctttactaaaaatacaaaaattagctgggcatggtggtgcgtgcctgtagtcccagccactcgagaggctgaggcacgagaatcgcttgaacccgagaggtggagatttcagtgaaccgagatcgcgccgctgcactccagcctgagcgacagagcaaaactccatctcaaaaacaataaataaaatacaaataaaaattgggtttttaactattttgtaacattgcttaaaggtgtggaagacactttggggtgttagaggaccaaggttgccatgattgcagtaatggtaacgaacactcagatgtcattggtgtcaccttcacagtgtcgtgaagtgctcttacattcctcgtttccgtggagggaaatgttagcattcctgttttccaaagtcccacatgtgaccgtgtggacaagtctagctgcttgtctgagggggtgtttgccttagcccctttttcaggcctcttaaggcctttgtaagtactgggccctagctgaaccccagcatccttaaagccctcttgagagagagagagagcaggtttggacaagccctgcctcgaggactatggcatgggtcagcttctggaagggcaactgtcggggacgcactttcccttgaactcagcaccatccaagccctgaatgtggcccagtcaccctgggcagaaaaaagacctcagccactttccccacagctctctctcctgccccttcttccccaggacaggagtccagagcatgtcccctacatgtgagacagcaggtgggtcttgggtgagaaacctctcactgcatatcacacagagggggaggttgtagtaagctgagatggcaccactgcaatctccacgcaagatgcagggagtctggctctggcgcccaggctggagtgcagtggcacagtctcagctcactgcaacctccacctcctgggttcaagtgattcttgtgcctcagcctcccgagtagctgggattacagctgcccaccaccacacccggctaatttttgtatttttcgtagagacggggttttaccatgttggccaggctgatctcgaactcctgacctcaggtgatctgcccactttgtcctcccgaggtgctgggattacagacatcagccaccacacccagcctcgtttctaccttttgactgttatgaatatgctgctataagcattcatgtacaaacttctgttttgtttttagggacaaggtcttgctctgttgccctggctgaagttcagtggtgccaccatagctcactgcagcctcaaactcctggtctcaagcgatcctcccatctctgcctcccaagtttctgggactacaggcgcttgccaccatgcctggctaatttttaagttttatgtagagatgtggtcttgctgtgttaacagcccacgctggtcttgaactcctgacctcaagcactcttccaccttggcctccgaaagcagtcggattacagacgtgagctaccatgcctggcccatgtgtgcaagtttttatatggacctatgttttcatttcttttgggaatatacctaggattagaatcagagatcatctggtatctctataatcttgtgaggaactgccacactgacttctaaaatggctgcacaatttacattcccagcagcagtgtatgagaattacgatttctccttatggttaacagcacttagtatctgactttcgcttctgaccatcctacagagtttgaagtggtatctcattgtagttttgattttcatttccctgatgacgaatgatgttgagcatcttttctttttatgtgcttattggccatttacacatcatctttggagaaatgtctattcagatctttgcccatttttaattgggttatttgtatcattgagttgtaagagttctgtatatattctgcatatactgggtcagatatatgatttgcaaaatgaggttttctcccattttgtgggttgtattttcattttcttgctggtgtcttttgaagcacaaaaggtactttttattatgactttaatctcttcacttgttttaggtttactcggattgtctatttctgcttgagtcagttttaatgattttctaggaatttgtccatttcacctaaattatataatttgtccacaggcaattattcatagtatttctttataatcctttttatttctgtagagttgatagaatgccctctctttcatttctgattctaataatttgagtctgattcttggccaatctagctaaaagtttgtcaattttgttgaccttttcaattaaccagtgtttagtttcattgatttttctgtactatttttttatcctctatttcattaatttcaccatattctttgttattttcttatttctatttgttttaggttcagtttgcttttctttgttccagtgtcttaaggtggaaggttaagttattgattcaagatctttctttgttaatatagtcacttacaacaataagtgttctaagtgtctaatcaccactttagctgcatcccgtaagttctggtgtgttgtgctttcattttaactcatttcaaattagtttctaatttctatttctattgtgatttcttctttgacatatttcttttctttttttttttttttttttttgagatggagtctcgctctgtcacccaggctggagtgcaatggcgcgatcttggctcactgcaagctcagactcctgggttcacgccattctcctgcctcagcctcccaagtagctgggactacacgtgcccgccaccacgcccggctaatttttttttgtatgtttagtagagacggggtttcaccgtgttagccaggatggttttgatctgacctcatcatccgcccacctcggcctcccaaagtgctgggattacaggtgtgagccaccgcgcccggccttctttgacatattccttttgtgatttcttctttgacatatttgtcatttagtagaatgttttttaaatttttacatgtttgtgaattttcaatagtttcttctgttgcctttttttttttttttttttttttttgagatgaagtcttcctctgtcaccaggatggagtgcaatggcatgaccttggctcactacaacctctgctcctgggttcaagcagttctcctgcctcagcctcccgagtagctgggactacaggcacgcaccaccacacccagctaatttttgtatttttagtagagatggggtttcaccatgttggccaggatggtctcgatctcctgacttcatgatctgcctgctgtagcctctcaaagtgctgggattacagatgtgagccaccacgtccggcctgtttttgttttttgtttgtttgtttgttttaagccctgtctatgggagccattggcaatccaagaacttttttattttatttttgaattatagagacgggagctcactatgttgcccaggctggtctggaactcctgagctcaaatgatactcctgcctcaagctcccaaagtgctgaattacaggcatgagccaccatacctggcctcttctgttgctttctaatttaattccattgtggtcagagtatgtattttgcataatttcagtccttttgaaatttgttaaggcttgttttatggctttaccatatggtctaccctggagagtattctatgtgcatttgagaataatatgtattctaccattgttgagtggggtattccgtagatatctgttatgtctagttggtttatactattgttcaaatcttctcttttcttgctggccttttgttttgttaattttatttattttatagtgacagggtctcccttggttgcccaggctgctctggaacccctgggctcaagccatccttccactgcagctacccaaaatgctgggattacaggtgtaagccactgaacccagcctcttgctcttctttttttctttttcttttctttttaatttttttttttttttttgagacagagtctcactctgtcacccaagctggagggcagtagtgcaatcacagctcacttcagcctcaacctcctgggctaggaagatcctcccatctcatcctcccagggacctgggactacaggcatgcaccaccacgcctgtctaattttggtatttttttgtagagatgggagaccgctatgttgcccaggctggtttcgaactcctgggctcaagtgatccacctgcttcagccccccaaaatgctgggattacagatgtgagccactgcacccaggatactgttctttttatctcgggttttgttttttcgagatggagtcttactccatcttgtgtgacttactcagatggagtcacacaggctggagagcagtggcataatcttggcttgctgcaacctctgcctccggggttcaagtgatcctctcacctctgcctcccaagtagctgggattacaggcaaacactaccacgcctggctaatttttatatttttggtagagatggggtttcaccatgttggccaggctggtctcaaactcctgaacttcagatccactggcctcagcctcccaaagtgctgggattacaggtgtgagccaccatgctggaccttccttatcttagttattctattcattactgaaaataggaaattgaagtctcaaactattcttgttaattaactatttctccttttgtaactgagtacccccatttttctaaaagatagtttattttaaaaattattttctcttcctttctccttccccactgctccccacttcctacttagccctttagaaatgcaaagagaggcctggtgagttggctcatgcctgtaatcccagcactctgggaggccgaggtgggtggatcacttgaggtcaggagtttgagatcagcctggccaacatggtgaaaccccattagcagggcgtggtggtgtgcccctgtagtctcagctacttgggaggctgaggtgggagaatcacttgaacccgggaggtgaaggttgcctaggtgacagagtgagactctgtctcaaaaaaaaaaaaaaagaaggcaaagatagtctttgacccctccttcaccagtcactccctacagggcaagttcatgtaactcctggagagttaagaaacagacttagagaccaaagcacgccccttataggactttcacctgggaacttccactctccagggattgcctgagagctcagtctcaccaggaggacatgttgaaagcgtgcccatggccacttttacaacttacttcttcccaggaaggtgccaactcagctgcccagtagataagacatcacgctcaaaaggagacccctgcccttgctggctgtatcccctacgtcttaaaagtgcccactttttctccagaagtgaagcggcacgtttaaagccagggcgctttgtgccccttccccaagctagaacttttttattttatttttgaattacggagacgggatctcactatgttgcccaggctggtctggaactcctgagctcaaatgatactcctgcctcaagctcccaaagtgctgataattcggaataaattcactttctttttggtaccagaccttgctcatggtaactgaaccctgcaatgcagcgagcaaccaacgtgcttttcagttacactttcagttctgtcagtgtttccttcatgtattttataaagggctctgttaagtgcatgtatgtttataattattatatcttccagatagtttggccctctgagtggaaaaaaactcagtttctttcacactgttctcacaacacgcttttttttttttttttttttagatagagactcacttcgttgtccagtctggagtgcagtggtgcgatcttggctcactgcagcctctgcctcccaggttcaagtgattctcctgccccatcctcctgagtagctgggattacaggcacgcaacatcaggaactgctaagtttttttgtatttttagtagaaacagggtttcaccgtgttggccagactgttatcgaactcctggcctcatgttctgcctgacttggtctcccaaagtgctgggattataggcatgagccaccgcgccaagctcgcaacacacttctgacaccagatgtgtgaggatttctccctacagcaagcaataatttctgcaggcagcctgcttccccttttgccctccagagccaggctccacaggagcccgagagatcctttaaaatgtaaatacagaccgggtgctgtggcactttgggaggatgacgcgggcagattgcttgagctcaggaattcgagaccagcctgagcaacgtggtgaaaccccatctctaccaaacaaaaacaaaaacaaaaacaaaaaaaattagctgggcgtggtgatgcacacctgcggtctcagctacttgggaggttgaggcaggagaatcacttgagcccaggaggtggaggttacagtgagttgagatcgcgccactgcactccagcctgagccacagagtgagactccatcttagaaacaaaaagtaaatgcaaccctgtctctcctgctcctgatcctccagtggctcctacccagggatgggctgtgcttcctccctggctgacatctatcatagaagaaagggcgtgagatgcttcatgacgagtaactcctggtttctggatatattcaaatacagagttgcctccttctcatccaggccacttggagatgagagcactgttgactttagtagcatctcctggtccccttgtaggttccagtctaggccttgggagagccaagaggacctcttgaacaacggctatcatcagaaagcttctgcacttcacttaccttctcccccagccatacccggcttcacattttctcctcctcttttgcagtcaatgcagaccctgcaggacttgctcactgatcttcatgcactccaggtcaccatcacagccctcagaaaagaagtggacatgctgaagaacatgcttgacaaggtaggccctcccccagcatcctccatgccagctgcgttgctcaggcctctgggggttggagcaatgaggaaaatctaggaagcttactgttaggccaagagtgcagctgtgagggtgtggtcatgtggaccctccaattggccagtgccaccgacttctctgtgacccctccatgctttcttttcttttcttttttttttttaagacagagtctcactctgttgcccaggatggagtgcaatggcatgatcttggctcacggcaacctctgcctcccgggttcaagtgattctcctgcctgagcttcccgagtagctgggattacaggcacgcaccaccacatctgggtaatttttgtatttttagtagagacaggggttcatcttgttggccaggctggtctcgaacttctgacctcgtgatccacccacctcagcctcccaaagtgctgggattacaggtgtaagccaccatacctggccgacccctccatgctttctaccccagtgtgttaaaacgttagttgtaagtgacagaaatcacgttcatcctggattaggcaaaataagggatttattgtctcatttactaaaaggtccagggacggccagatctaggtactcatgcaatacttatatttctttttttttttgagatggagtctcgctctgttgcccaggctggagtgtagtggctcgatcttgactcactgcaacctccacctcccgggttcacgccattctcctgtctcagcctcccgagtagctgggactacaggcgcccgcccccatgcccggctaattttttttgtatttttagtagagatggggtttcaccatgttagccaggatggtctcaatctcctgacctcttgatccgcccgcctcagcctcccaaagtgccaggattacaggcgtgagccaccacatccggcaatactgacgtttctcagtgaaactttcctcccagttggcttcattctcaggcaggtgctcctcaagtcttggcaacagcagacttatattccaccaacctagcaaaaagaaaacctcttccccttctggaaagctctgtccacatggaaagtggaataatcataatagtgcaggcatacatacaagctccttctgtacttctgtagccaaaaaccatcagccaagtattttctaacaccctaccatgcatggaaggacatggagtccccgagacatgaggcagctgtccccgtcacaactgatgagtcacagctggggtctgaagccagctctccacacccccaggtttaacaacttcccccaaatagtgtaattttctgtatcatcccggcttcacagatcagggcctgtatttgatcatcatggcaactgtgggagctttaggcatgggctggatggctcccatctaagcagaaagaacgctgttaaaagctgcatcatgagctactcaaaagggccccttagacaaagctgttggagaaaccatgccttctcggcggggcctggtgtctcacgcctgtaatcccagcactttgggaagccaaagcaggcggatcacctgaggtcaggagttcgagaccagcctggccaacatggtaaaacccccgtctccactaaaaatacaaaaattagctgggtgtggttgcaggcacccgtaaccccagctactcaggaggctgaggcacgagaatcacttgaacccaggaggtggagattgtagtgagccaagattgcgccactgcactccagcctgggtgacagagcaagactccgtctcaaaaaaaaaaaaaaaaaaaaggtggggtcggtggggcggcatggtggttcacgcctgtaatctcagcattttgggaggctgaggtgggcagatcacaaggtcaggagatcgagaccatcctcgctaacacggtgaaaccccatctctactaaaaatacaaaaaattagctggatgtggtggcaggtacctgtagtcccagttactcaggaggctgaggcaggagaatggtgtgaacctgggaagtggagcttgcagtgagccgagatcacaccactgcactccagcctgggcaacagagtgagactctgtctcaaaaaaaaaaaaaaaagaaaaaagaaaagaaaaacaatgccttattggcctgtctcttggaggtgtttttgttgttgttgttttgttttgtattctttttgagacggagtctctctctgtcacccaggctggagtgcagtggcacgatctcagctcactgcaacctctgcctcccgggttcaagtgattttcctgcctcagcctcctgagtagctgggattacaggtgcaagccaccacgcctagctaatttttgtgtttttagtggaggtgggggcttcaccacattggtcaggctggtcccgaactcctgaactcatgatccacccgcctcagcatcccaaagtgctgggattacaggcatgagccactgtgcccggccctcttggagattcttaatgtgcttttgctcattcaaggctctgggaagtcctgccgtacagaaacctgttgaaatgttttttatttatttatttatttacttatttttgagacaaagtctcactctgttgcccaggctggagtgcagtggcgccatctcagctcactgcaacctctgcctcctggattcaagtgattctcctgcctcagcttcctgatagctgggattacaggcgcatgccatcaggcccagctaatttttgtatttttagtagagacggtgtttcaccatgttggccaggctgctgtcgaactcctgacctcaagttatccacccaccttgacctctcaaagtgctggggttacaggcatgagacactgtgcccggcctgacatgctttcaagcccagcatttcccaaacttgtttgcccatggaaccctttcccactccttgggaaacactggatttggaacccgttcttccttctcaagctcttagtcacctagagccacgggaaaaggcaggggtgggacagaacctggacccccagtccacagactcagttcctttgacaggtacacccagaaagaatggacatctttgctgaagacttcaaaatacagaactggaagatggttgcactgcagcgggaagtggtgagggccaccatccctgtcttcccccactccccctgggaccccccaacctcccgggtcctgggtgctgagggtagggaggtgcaaggaggagaacacagcctggaaaggtttctttgcaggtgtgggggacactgccccctccaggctcacagccctcattttctacccccaccttgcaggcttctctccagaataagtttaaaaccatccccaaaaccgaggacatggtgctctggagtggccttcatgatgccatgttcacctcagtgagtgaggaaggaaggggaggttagcaggaagctggggagcaggcgggtggctgactgagagtgggaggcggggctggaagccagcagagcccctctgccccctcttctgcaggaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctaggtaggcctggtctggccctgggaagggcacaagggagtggggctctccctgcagcctttgagaagtgtgtcctgtccttcactgggctccaccaacaaaatctgcattccaccattagccattctttcctttggcttaagcatttggctcttaacgagtctattcttttctgttgaatgtacaatgaggtcttatcttagggcagggaggctgttagggtctaaagttggcacgaggaaaatggcatgccaaaattactctcaaaaactcttgtggccaggcgtggtggctcccacctgtaatcccagcactttgggaggctgaggtgggcggatcacctgagaccgcaagttcaagatgagcctgaccaacatggagaaaccccgtctctactaaaaatacaaaatttgctgggcgtggtggtgtatgcctgtaatcccagctactcgggaggctgtggcaggagaatcgcttgaacccaggaggcagaggttgcggtgagccaagatcatgccattgcgctccagcctgggcaacaagaacgaaactctgtctcaaaaacaacaacaacaaaaaaaactcctttgtgatagcccataaaacagtattgtattggctaagcatggtgactcatgcctgtaatcttagcactttgggaggccaaggcaggaagactgcttgaactggaagttcgagaccaccctgggtaacatcaagacctcatctctaaaaaaatttttaaacactagctgtgtgcggtggctcacgcctataatcctagcactttgggaggccaaggcaggcagatacggagaccatcctggctgacacggtgaaaccccgtctctactaaaaatacaaaaaaattagctgggcatggtggcgggcgcctgtagtcccagctactcaggaggctgaggcaggagaatggcgtgaacccaggaggcgaagcttgcagtgagccgagatcgtgccactgcattccagcctgggcgacagagctagactccgtctcaaaaaaaaaaaattttaaacattggccgtgtgcggtggctcacgcctgtaatcccagtcccttgggaggatgaggcaggtggatcacttgaagtcaggagttcgagaccagcctggccaacatagcgaaactccgtctcgactaaaaatacaaaagttagccaggcttgatagtgcgcgcctgtaatcccagctacctcggaggctgagacaggagaaacactttgaacccgggaggcagaggttgcagtgagcagagattgtgccactcccgcctgggcgatagcgagactcctcctcaaaacaaaaaaaaaagcctgagtggtggcgcaggcctgtagtcccaactactcaggaggctgaggtgggaagattgcttgagcctagcagttcaagactgcactgggttatgatcgtgccactgcactccagcctgggcaacagagtgagaccttgtctccatacaaacaaaatttaaaaaaaaatttttttaattattgttattattttttgagatggagtttcacttttgtcgccggttggagtgcaatggcgtgatcacagctcactgcagcctccgcctcctgggttcgagagattctcctgcctcagccttccaagtagctgggactagaggcatgtgccaccaagcctggctgattttcgtatttttagtagagatggggtttttccattttggccaggctggtctcaaactcctgatcccaggtgatccacctgcctcggcctcccacagtgttgggagtacaggcgtgagccactgcacctgataaaaaaaattttttttaattaatttaaaaactaataggccgggtgcggtagctcatgcctgtactcccagcactttgggaggctgaggaaggcggatcacgaggtcaagagatcgagaccaacctggccaacatggtgaaaccctgtctctactaaaaatacaaaaattagctgggcgtggtggcgtgtgcctgtaatcccaggtactcgggaggctgaggcaggagaattgcttaaacccaggaggcggaagttgtagtgagccgagatcgcgccactgcactccagcctggtgacagagcgagattccatctcaaaaaataaattaattaaaaaataatgaagaaataaataaaaaggtaccacaagctgcgaggcccagtgcatttccactgggcagtgctgcctgagatgctccataagagaagcagctagagcccaacagaaacatcttcctccatccgagccctcagcagccaccctgtcctctgctttcagccaatatgggaggtccttccagcctcgggacaacagtggacatattgcagaaaaagattggcagcctccagaaatctaggctcaaggttagtgtctccggcgaagggcttttgaggcagtgatggcttgaggtgagctggctgaagactccttgactctgcccccctcccaggtgcagctgtgttctgcagcaaaacaggctgggggaaagcgagctggctgcgaaggcagctgctgcctctcaaagctgattcactggtgcggtgggggggcccagcaggtgtggggctacacggttctgtgtctcaggtggctgttcagagggcaggtgaagccggtgcggtggctcatacctgtaatcccaacgctttacaaggctgaggcaggcagatcacttgagctcaggagttcaagaccagcctgggcaacatagtgagatcccttctctgcaaaaaaatacaaaaattatccaggtgtggtggtttgtccctacagtcccaactactcgggaggctgaggtgggaggatcacttgagcctgggaggtggaggctgcaatgagccaagatcacgccgctgcactctagcctgggtgacagagcaaggccctgtctcaaaaaaaaaaaaaaaaaaaaaaaaaaatggcaggtggaaggcaccctggtctgataccttatttttttttttttttgagacggaatcttgctctgtcatccaggctggagtgcagtggcgtgacctcagctcgctgcaacctctgcctcctgggttcaagcaattctcctgcctcagcctccctagtagctgggattacaggggcccgccaccacacctggctaatttttgtattttttgtagagactggtttcgccgtgttgggcaggctggtctcgagctcctgacctcagttgatctacccatcttggcctcccaaagtgctgggattacaggcatgagccaccacgcccagcctggtctggtacattcttcttggcctcaaccctccctcaggccccttcccggccatggtaacttcagaagcagaggcctggggtgtctgtgtctcccccttttaggaggaagaacttgagagaatttggggcaaccaaatagagatgatgaaggatcgctacatcactttggacaaggcggtggagaacctgcagattcgcatggatgagttcaaggttaggaggactgggtaggctggagaagggctggcaaagggagaattcctcacctagaccttctggcccttcccgaaggttctgcatgaggtggggatgcacttgaggctgggaaccagtggggctttactggcattttactgtgtgtaaattacacttcaatgaaaagcaaacgaatcccaccacccccccccacccatataaacagaagggccgggacaatgttcgtctttttgaccactgcgtcacctgcccctggaagggcaggggtagtgaaggctccatcacatttgctgaatgactcagtgaatgattaagagaacttcttgtgccaactgttacattcttaacatttccctgagccaagaggtagaaatatttactgacattttgggctgggtgataaaaataaaaaaataataataaaaagaaatatttaggctgggtgcggtggctcacatatgtaatcccagcgctttgggaatctgaggtgggaggatcacttaagacaaagagtttgagacaagccagggtaacacagggagaccccatctctacacaaataaaaaatttagctgggactgggcgcggtggttcacgcctataatcccagcactttgggaggccgaggtgtggtggatcacttgaggtcaggagtttgagaccagcctggccaacatggtgaaaccccgtctcttctagaaaaatacaaaattaggctgggtgcagaggctcacgcctgtaatcccagcactttaggaggctgaggtgggcggatcatctgagatcgggagttcgagaccagcctgaccaacatggagaaaccctgtctctactaaaaatacaaaattagctgggcgtggtggcgcatgcctgtaatcccagctactcaggaggctgaggcaggagaatcccttgaaccggggaggcagtggttgcggtgagccccgatcgtgccattgcactccagcttgggtaacaagagcaaaactctgtctaaaaatatatatgtatacatatatatatatatatatatatatatatatatatatatatataattagccaggcgtagtggcacacacctgtaatcccagctacctgggaggatgaggcaggagaatcgcttgaacccgggaggtggaggttgcactgagctgagattgcgccattgcattccagcctgggcaacaagagcgaaactctgtctcaaaaaaaaataaaaagggccaggcgcggtggctcacgcctgtaatcccagcactttgggaggctgaggcgagtggatcacgagttcaggagattgagaccatcctagctaacgtggtgaaaccccatctctactaaaaatacaaaaaattagccgggcgtggtggctggcgcctgtagtcccagctactcaggaggctgaggcaggagaatggcatgaacctgggaggcagagcttgcagtaagccgagatcccaccactgcactccagcctgggcgacagagcaagactccgtctcaaaaaacaaaaacaaaaacaaaaaaacctagctggatgtggtggctcatacctgtgatcctagtactttgggtgcagaggcttaaacctgtaatgagggaggattgcttgaggccaggagttcaagacttggccaacagaagaaaactgtctctacaaaaaaaaaattataaaattagccaagcgtggtagcacatgcctgtagtcccagctacctgggaggctgaggtgggaggattgcttcagcatgggaggttgaggctgcagtgagctgtgactgcatcactgactccagcctgggtgacacagaaagaccatctcaaaaaaagaaagcaaagaaacaagcaaaaagcaaaaaactcactaacggccaggcgcggtggttcacacctgtaatcccagcactttgggaggctgaggcaggcggatcacctgaggtcaggagttcgagaccagcctggccaacatagtgaaaccccgtctctactaaaaatacaaaaattagccgggcatggtggcggatgcctgtaatcccagctactcgggtggctgaggcaggagaatcacttaaacccgggaggcggaggttgcagtgagcgaagattgcgccattgcactccagcctgggcgacaagagcaagactcagtctcaaaaaataaataaataaataaataaataaataaataaataaataataacccaccaaggttgtttccgtgaaggcttccaagtcggggggctgttgctgggatgcactggggtgtgttgggggaaaagggaccaaggaaacccatggcgtatggctgaccccaaggctggcacactgtaatcaggctgggacccatttgaggcaactttgaatggaaaataactcattaaaggggaaccaattcacagcctatgaagtgggggtggacaggagggttggctgtctctggagatgctgggccgagtgtgggtggactgcatgcaggggtacgtgctcagactgtgcaccactggccaggaaccaggtctcctgccaacactcctcttcagagagacccaggccaccatgtcctggggtcatcttggtgccctttctccatggagctggagccagttccattcagcatgtccatcgtgcacccagcactacgccagaccctgcatgggggtgagcaggggctgcagtgtctgcctgcgtgtccgtagttgtcacttattagaaagactctgaagctgatgaagccctgccacgtgtgccaaaacagagcacatcccttgtcccaggaccgttgtcccagcttcctggctcttgtgctatgaagatttcattgctggccaggctcggtggctcacgcctgtaatcccagcactttgggaggctgaggcaggcggatcacctgaggtcaggagttcaagaccaacctgaccaacatgatgaaagccgatcgctactaaaaacacaaaaaaatcagctgggcgtggttgcgggtgcctgtaatcccagctactcgggaggctgaggcaggagaatcgcttgaacccgggaggcagaggttgcagtgagccgagattgtgtcattgcactccagcctgggcaacaagagcaaaactccatcttgggaaaaatctcagcactttgggaggccaaggcaggaggatcccttgaggccaggacttcaggacgagcctggacaatacggcaaggccccatcgctaaaaaaataaaaataaaaatattagccagatgtggcagcgtacgcctatagtcccagctaccagggaggctgaggcaggagaatcacttgaacccaggaggtggaggttgcagtgagctgaggtcatgccactgcactccagcctgggtgacagagtgagactctgtctcaaaaactaaagtaaactaaaatacagtcttaggattttgaaccacacaaatggtttgtattaccaatagttaaagaagaaaaataaaaaataatgtagaacaagtgtgggaataggcaaatcaataggccaagaagactgggcatggtggctcacacttgtaattccagcactttgggaggccgacatgggcggatcacttgaggtcaggagtttgaaaccagtctggccaacatggtgaaaccgtgtctctactaaaaatacaaaaaaattagccaggcgtggtggcgcatgcctgtaatcctagttacttgggaggctgaggcaggagaattgcttcagctcaggaggcggaggctgcagtgagccaagatcgcaccactgcactccagcctgggcgagagagcaagactgtatctcaaaaaaaaaaaaaaaaaaaaaaaataggccaagaagaccagatctaagatttacaagaatttagcatatgaccactacaggaaggatggattactccacaaccagtgttaggaaaaccatttcaaggaataacagtaagtcttaagtccgatagcaatcctctagatgacacaaggcagtagcacggtgacaaatgcaggatgggagcaagatctcatgactgtgtctctgtcttgctctccaccatgtgacttacatgtaagacttaggtttcccagtgtcgttttgggtcttgctctgtcccccaggctggagtgtagtggcctaatcatggctcagtgcagccttgaactcccaggctcaagtgatcctcccacctcggcctcctgagtagctgggactacaggcgtgtgccaccatgcctggctaatttttttttttgagatacagtctcgctctgtcgcccagcctggagtgcagtggcgcaatcttggctcattgtaacctccgcctcccgggttcaagcaattcttctgcctcagcctcctgagcagttgggactacaggcgtgtgccaccatgcctagttaatttttgtggtttttttggtttgttttttgtttttgttcgaggcagaatttcactctgttgcccaggctggagtgcaatggcgcaatcttggcttactgcaacatctgcctcccgggttcaagtgattctccttcctcagcctcccgagtagctggggtaacaggcgtttgccaccacactcggctaattttttattttgagtagagacagggtttcaccacattggccaggctggtcttgaactcctgacctcaggtgatttgcctgcctcggcctcccaaagtgctgggattacaggcgtgagccaccgtgcccagccaatttttttgtatttttagtagagatggggtttcaccatgttggctaggctggtctcgaactcctgaccccaagtgatccacccacctcagcctcccaaagtgctgggattacaggcattagccactgcgcccagccaaaataataagattataaaacatgaatatagcctggcatggtggcttgcacctatagtcccagctactggggaagcagaggtgggaggatcactggagtctgggaggtggaggttgcagtgagctgagctcgcaccactgcattccagcctgggtgacagactgagaccctgtctcaaaaaataaaaataaaaagcataaataaggccaggtttgatggctcttgtaatcccagcactttgggaggctgatgggggaggatcctttgagcctaggagttccagatcagcctgaggcaacatagtgagacccctgtctctacaaaaaaaaaaaaaaaaaaaaatccaggtaggtggtgtcacctgcagtcccagctcctctggaagctgaggcaggaggcttgcttgagcctggaaggctgagactgcagtgagctgtgatcaagccactttactccagcctgagtgacagagcaagagcctgcctcaaaaaattaaaataaaaaaattaaaattaaaataaagaggaggtaacagagactcagcaaagaaacgagcccaagcctgctgggctgggagggggcctggagtggctgtggttcagagcccaggctttggaacagacgtgcctaggtttgaatcctgattctgccacctgctggttggatcagttccctgcggttgctgcggcaaatcactcttggggttctggaggcgggaattctgaaatcaaggtgtcataggctgtgttccacctgaaagctcagaggggcctcctcgcctctcccagcttctggtggttcaaggtgtcccttggctttggagcaacttggatggaggccggggtcattattctaagtgaagcaactcaggagtggaaagcaaagactgcatgttctcacttgtaaatgagctaagccataggtgtgaaaagacagaccgagcaggataatggacacaggagactcaggataatagagagagggaaggatagaaaactacatattggagccaggcgcggtggctcacacctgtaatcccagcactttgggaggctgaggcaggcgaatcatttgaggtcaggagttcgagaccatcgtaaccaacatggtgaaaccccatatctactaaaaatacaaaacttagccaggcgtggtgttgggtgtcagtgaccccaactactcgggaggctgaggtgggagaatctcttgaacccgggaggcggaggttgcagtgagccgaaatggcgccactgcactccagcctgggcgacagagcagattctgtaaaaaacaaaacaaaacaaaacatgttaaagatacccattcacttctgttgacaccccagtggccacactaagctataagagaggctgtgaaatggagtcttgattctgggcagctgggttccagctaaaagtccagagttctgttcgtaagcgtgagcgggacacccgacaggaagagagaagtagaagcctgtttgcagctttgcaggaactatggcccgaccctctggggaaatggaggctcttcccaagctgaccagctgctgctcctattacaatggggatgtagtaattggagagagggtggaattcatgggggcagttggttctttgtggagttgtggggataggacgtgaggtttttccctaacgcttgagcacagtgtgtgtggctgtgataagtgctcagttcatagtagactggagttcctgctgggaccccaggacagatcagaagtagtaaacatgccttaaacatccagggagcgaaatcgtccacattggtttgtgctttccttccttgggtctaactccccgtggaggaaagttcctatgataccatctctgaggggacagcttgtcccaagtcgcacgttccttcccttttcatctgggcacctggagcccttgagcctgagtcttgtaacgcccatgcccacctgcctgctgtccacacggcctgctatccctccccagcatatggtaatggtagaggtgggaggttgacattttatcctcaaggctctccaggatggcagacatgcctgtgcttctgttcttagactctccaggctcaaatcaaaagactggaaatgaacaaggtgaataagagcacgatggaggaggagctgagagaggtgagtgagcagaggttcctctgccttccctgctcccctacccagggaaacggcaccatccaggcaaagcccaccaaagagtcttccagaatttccctccccctttgttcatattgaaaccaggagttggctgggcgcagtggctcatgcctgtaatcccagcactttgggaggccaaggcgggtggatcacctgaggtcaggaattcgagaccagcctgcctggcctacatgatgaaactccgtctctagtcaaaatacaaaaagtagccaggcgtggtggcaggtaactgtaatctcagctatttgagaggctgaggcaggagaatcacttgaacctgggaggcagaggttgcagtgaaccaagatcatgccattgcactccagcctgggcaacaagagcaaaaactctgtctcaaaaaaaaaaaaaaaaaaagaaagaaagaaaaagaaagaaaagaaaggaaaacaggaggcacatcaactcccattttcagcaattgaggattattaacactctacttgaaaatcacacatcagctgtgcacagggtggctcatacctgtaatcccagcactttgggaggccgagaagataggatcacttgaggccaagagtttgagaacagcctgggaaacataggaagatcacatctctacaaaaaaataaaaaaatgaactgggcatgatggaacatgcctgtagtcccagccactcaggaggctgaggtggaaggatcccttgagcccaagaggtggaggctgcagtgagctatgattgtgccactgcaatccagcctgggcaaccttgaacaagatcctgtctcaaaaaaacacataataataaaatacatcaacttccctgttataggaaaaccttggctttgatctcgagatcgtgtttgaatccacgtagaccccagggttgcatttaagccaaggctaaaagtccagagtcccaaactagaagcatcagacccaaggggtgtgatgtctcccagctttgccttcctccatcccagcagccatgcctccctgaactccctgtctccctagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaaggtgaatgcccccatgttgattttcactttattcctaacaaattaacccagaacttagcaactgcaaacaacaaacgttttcagtttaggaggagcaagaatttgggagtgacccagcaacttagctgggtggctcagggtttcctgtgaaattgcagtcaagatgtcatccagggctggtctcatctgaaggctcgaatgaggctggatgagccaattcaaagagattccctcacatggctgttggtaacactcttcagttcctcatcccatggactctgcctttgggccacttgagagtcctcatgacattgcagctgacatctcccagatcaaatgatccaagaggggaaggaagaagcagcaatgtcttttttttttttttttttttttttcatacagggcctcactctgggcacctgccccatacatagtcaataaatgaattgatccccatttcacagaggagaacactgagcctcagagaggttattatacttccctcaggaaacgctgctgctcatggtggagcttgagactcaaacccagagctgcctgattctaaacctaatttaacctctttgggccagtccagccacctcagttgcaagaaccatgtagcactgttgttggaccaactgttccagtctactatgaggaaggggctgtgactcctctagacacttccccggggtctgacacatcactggcagtcagtaaacgatgaatgaataaatgaatgactgtcacagtccctcagagactctcctcctccaccccacatccctgcacttacgcagccaggagagtggcatagttagcctccagggcggtcgccaaccatacctcttggtattcacacagttgtttagccccctcccacattgaatgggaccagcttgtgtaacctacaggatattagagagatgatggagggtgaccaccttccatcataaaagacattgcagccagttgtggtggctcacgcctgttatcccagtactttgggaggccaaagcaggcagatcacttgagcccaggagttcaagaccagcctgggcaacatggtgaaactctgtccccctaccaaaaaaaaaaaaaagccaggtgtggtggcacatacctgcatttccaactactcaggaggctgaggtgagagaatacctgagcctgggaggttgagactgcagtgaaccaaaatcgtgccactgcactccagcctgggcagcaggagcaccctggcaggcactcagagtgaaaccctatctcacaaaaaaaaaaaaaaatgggcgcagaacaaccaaaagcaacacatgaagagattttacttgtttcctggtttaattgaaccacatctacaaatgggctggagatgacatccaattcaggaatagttgctaattgtattaaacatgataatagtgttgtggttatataataaaatgttatcacactcaaatatttattagtgaaatgtcaccatttctgtaacttaaaaaaaatactccatcggctaggcacggtggctcacgcctgtaatcccagcacttcgggaggctgaggcgggcagatcacgaggtcagaagattgagaccatcctgaccaacacggtgaaaccccatctctactaaaaaatacaacaaaaattagccaggcctggtggcgggcgcctgtagtcccagctacttgggaggctgaggcaggagaatggcctgaacccgggaggcagagcttgtagtaagccgagatagcgccactgcactccagcctgggcgacagagcaagactccgtctcaaaaaaatactccctcgggtggcacagtggctcacacctataatcccagcactttgggaggttgagatgggaggatcacttgagcccaggggtttgagaccaatcctggcaacatagagagactccatctctactttaaaaaactatttttggccaggcgcggtggctcacacctgtaatcccagcactttgagaggcagagatgggtggatcacttgagatgaggagttcgagaccagcctgaccaacatggtgaaacactgtctctactaaaaatacaaaactagccggatgtggtagtgggggcctgtaatcccagctactcgggagactgaggcaaggagaatcgcttgaacccgggaggtggaggttgcagtgagccaagatcgcaccattgcactccagcctgggcaacagaagtgaaactctgtctcaaaaataaataaataaataaataaaataaaagtaaataaataaggccaggtgcggtggctcacacctgtaatcccagcactttgggaggctgaggcgggcagatcatgaagtcaggagtttgagaccagcctggccaatatggtgaaaccccgtctgtactaaaaatacaaagattaggctgggcgtggtggctcacgtctgtaatcccagcactttgggaggctgaggtgggcggatcacctgaggtcaggagtttgagaccagcctggctaacatggtgaaaccccatgtctactaaaagtaaaaaaaaaaaaaaaaaaaattagtcgggtttgggggcacacgcctgtaatcccagctacttgggaggctgaggcaggagaattgcttgaacctgggaggcggaggttgcagtgagctgagatcacaccactgtactccagccagggcaacaagagcgaaactccctctcaaaaaaaagccaggtgtggtaacacgcacctgtagtcccagctacttgggaggctgaggcagaagaattgcttgaacccgggaggcggaggttgcagtgagcagagattgcaccactgcgctccagcctgggcaacagagcgagactctgtctcaaaaataaataaataaaattaaaaataaataaataaatacgattgattatgatggtcacacaactctgtaaatatactaaacgccataaacctgcccactttacatacagaccgtcaataaacatgtgttgagtgtgtgaatgtcaggtgcagtgggaccattgccagaaaggtgtctcagaccgcccagcctgcagctgagcttggtttgatttggtcttttgcagacagtagctgatggtgttttttgcttctgctgctaggaagctcaccttgcagctcccctctaccaatagcatctagtaggggttgagcctcatcgaagctgtgtcattttccctttcctggactccctcactattttagttgaattttgttacaccgtgtaacttcccaggttgctgcaaccctcttctggaaggaggcagggtgtgaattcatagagtattctttcttatcttccccttggctgttggcagttagtccacagtgatctggatcccttgaagaaagaaatggaagaggtctggaaaatcgtccggaagctgctgattgagggcttaagactggatcctgacagtgctgctggctttaggaggtgagtgcccgcccgagcccctcctggtaggggtcctgctgcccaggctgtggggaacacaccctggaagctctgggaggaaagattccagacctttggatgaggggatgggggcttggctgtggctgaaagcactgaggaggagggaagctctggcctgagctggcagaggtgatccagccctattcctgccaatggggaaaccaaggctcagagagggaaggggactgggcagatccaggacccctgacccccacccagacagtgccccaggcagagggacccaatatttatggggctcctgtcctcagaccacccctcacacagctttaaaaaccatccgttgtgtttggggcggcagagaaaccacaagagtggttggagactgcagggcctgtggggctgagctgggccgggcactggcaggagggatgcagccctggggctctggctggctgcagcctcccacacatggcctgggcccagcaggggcagcggctgatgatcatgtgcctttcaggaagctgttcaagcgcgtgaagtgcatctcctgtgaccggcctgtggagatgatgactggcccgtgagtaccaccgcccagggtgccccggccctaagggcttgtggggcccatggaggtcatctccgtgcacctccatgtgcaccgttccatgcacgctgtgtgtctacacatccatatacagcattctctccagccatcaagtccatacacgcccacatgcaccattctctatgcaccaggtatctacacatccacatccactgttctgtaccgtcaagtccatacacatccatgtacactgttctgtatgtgccatgtgtatccacattcatatacagggttccccagccttcaagatacacatgtccacatacactgttctacagccatcaaaaatatacaaatatgcggccttgtatgatagcgcctgcctatagtcccagctactcaggaggctgagatgggaggatggcttgagcccaggagttcgaggctgtagtgagctaggattgtgccactgctctccagcctgggtgacagtgagacctcatatcaaaaaaaaaggccatgttggcaaggctggtctcaaactcctgacctcaggtgatccgcccacctcagcctcccaaagtgctgggatcataggtgtatgccaccgcgcctagcctggtttttacttttggaaatagaacaattgttttttgtgtcttactgtgatgatcagaggtcctgagatgcctttcgggggggccccttctacttctatgctgtggacgcttctggcattcgagggtggtgacctgagtctgcacctccttcctcctgctgggaaggcttcctggaggggtgggagacgagccctctgctggcctagcacgcctcccacagcccctgctgtgcccttgtcctccaacagacagctgatcaccatccgcaaagcccacctgctgtcccggctgcggccagccagcgccaacagctgcgagtacttgcagcggcaacagatgaggtgagcaggatgggcgccccgcagggaggccgccccgcatggaggccactctggagcctgggaaccctgttcctgcagagacacatcctccaggcccagggacctaagattgtcctggacatggccagcccttcgcaagacaggcactccgagaggtggctggggcggcagacaggcccacgagatgatggcggagggaggaactgacatatttactgcacatctattgtgggccaggaactgttagacggtttcttatttaaatctcacaaccccctgtgagctagggttcctatgcccatgtccctgtttcttggcggagggaatcggtgatgatggggaaccctcagggagccgctgctgtgcccggcaggcactgtgccaagcgctggggctcacctggccttgttgagtcctcacagctgccctctaagatgtatcctggtaccatcccatgtcacagttgaagaaactgaggctcagagaactgcagtgacctgcccaaggtcactgctagcaagtccagggctgatgtccaaaccctcaggtttccaccgcacccagctggctccctgggtgccagccccacccctcaacctcctgacatcccacagctctatggatctccccagcctccaaccctgctgtggggacgtctggccaggtgggggaagaaccggtgaatcgtcaccacagccgtgggaaggggagggacgtgggggcctgtgctgactctgccaccctccctccctggctccttgagatcaagagattagaaggacacgctcttcaggccaggggtccaaagggaaatggctgggtctggggaaatgcaggtctcaatttgattcctctgccccactgtgtgtgtctgtatccatccgccaggccccaggcctgcctggctgtgccagctaaacacaagctgaaagaaatgctggtcttccctcgatgctggccaggcccttggggcccgtcctgggctctggggtacagggtctccaggtcgctgctgacccactgccctgctgcagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgtgagtctggccggggcctccttctcagagggtggacgtcagcgcaccccagccccaggtgtgggaccaggcactgagcagtgggcaaccccagcagaggctgcactctgtctcctgggcttctgcgtgtaccaaagttcgggggcagatcgggtcgggggctccctaacccgggacctgggccatccaacaggccgaggtggacatcctgggcgtggatgggatcctgtacaaaggccgcgtgaacagccagcgtggggctcagcccttggccgtcgcaaaggagctggcaggtgaggggcgtagggctccctggggcacccttgcctggggccctggttctgctgggcagggtgagagggtgcaggtggggcccagagccagcactatccctgaccggggagtcctcacacagtcagtcacaaaaattgggtcacagcaggcccccaggagactcagtctttgcaatgggggagggagaccgcgggagcgaggatctgctgttcccgagatcaacagctgaccagagagagggccgtggccacaggaccatggcctgtgacgaaggacgatgagctaggaaaggtgctgggctggtgccaagggacgccagtccacggaggacggactggacagctgccctgaagcccttgaagagggactaggacttagctggatgaaggggtcgggtgagaggagagtggtcgtgtggcaggaacggtgggtgcaaaggccctgtggtgggtggaagccactcacaggcaggagctcaggacgccgagtctccctgaagggtggagactggggtggggcagtggggtgacaaggaggagacttgggccagaccccagaagctgtgtgttaatatcacaggcaagggttgggccagcgggagacccagaattgtgcacatctggaatcagtcaatgtggttgctgcagtgctgaggcccggctctggccggctcctgctgggaccccaagactctggagtccatcactgggttcgaaggacaaaaagaggagccttctctgcacaccccttgaaggctcttcccccttggggatggggagttctaaattttgcccctgggtgggagctacacgccgccccataaggagcagtcccggagccacaagatggccggggcctgaactccacctgcagaaattctggttttttgttgttgttgttgttgttgtttgtttgtttttgaggcggagtcttgctctgtcgcccaggctggagtgcagtggtgcgatctcggttcactgcaacctccaactcccgggttcaagcgattctcctgcctcagcctcccgagtagctgggataacaggcacgcaccaccacgcccggctaaatttttgtattttttagtagagacggggtttcaccatgtttggcctcaagtgatccacctgcctcagcctcccaaagtgcaaggattacaggcatgagcctctgcgcctggcccaccggcagaaattctttcttgccaacgctgtgcctccattgactcgaagaccagacatggaagaagggaagggggactgtttcatcaatgtgctgggcaaaggaggaggcaccctgattcgtctcctggggttgccgagacaaattaccacaagcagggtggcttaaagcagctgaagttccttcattccccggcccatgtagcacgccgtcccattggccgggcacggtggctcacgcctgtaatcccagcactttgggagaccgaggcgggcggatcacaaggtcaggagttcaagactagcctgaacaacatggtgaaacctcgtctgtactgaaaatacaaaaattagccagccatggtgacacacgccgttaatcccagctactcaggaggctggggcgggagaatcacttgaacccaggaggcagaggttgcagtgaaacaagatcacgccactgcactctagcctggacaacagagcgagacttcgtctcaaaaaaaaaaaaaaaaaacagctgaagttccagctgggcaacaacaaattagctgggcatggtggcgtgcgcctgtagtcccagcttctcaggaggctgaggcaggaggatcgcttgagcccgggaatttgaggctgtagtgagccatgatctcaccactgcactccagcctgggcgacagagccaggccctgtctcaaaaacaaacaaacaaacaaacaaaaacagaacagaacaaaaccaaacaacaacaacaacaaaaacaaaatacagccagagttgatcctcccgctgtcctggaggctggaaatcctaaatcaaggagtcagcagggctgcactccctccaaaggcttgaggagggtccctccctgtctcttcagcttctggggccgatggcactccctggcacttctctgtccccatgtgagcttctcttctgtgtgtcctctcctctgtcccccataaggacatttgtctttggatttgtgcccgacctaacccaggatgatctcatctcaagatccttaagctaattatacctgcaaagaccctttctccaaataaggtcacattcacagcttctaggagatgtatctttttggggagcacattcaacacaccctgtttccaggcgggccagacaccgtctcaaaccctgcattctcctgggcgggatgtggcttctcctcgagaggactggccgttccagcccctgccccctgcctggtatctgctgggagggctcaggctgggcgtcagggatcaccaggcaggatcacaacggtggctaatatttaatgaaccccgacttcgtgccaggccctgccccacctccttcaccctccaacaacctgccaaggagtttcacaaatgaccagctgagtgagggctgcttgccgggcggccagggcagatggagtccacatctgatgcacccagtcctgtccccactcattcactggcctccccaagggctgtcatctagagggaggggctttcccccttggctcattcattcccaagacccacacagcaagccaggacttgaatcatgatggcgtcaactgcttcatcttttttttttttttgagacggagtttcgctcttgttgccaaggctggagtgcagtggggcgatctcagctcactgccatctcaacctcctgggctcaagaaatcctccctcttcagccttccaagtgactggaactacaggcgtgcgccaccacgcctggataatttttgtatttttagtacagatggggttttgccatgttggccaggctggtctcaaacatctggcctcaagtgacccacctgtctcagcctcccaaagtgctgggattacaggtgtgagccactgcgcccggcctcatgtaacttattgactactatatattacattgaaattgtgacggatttatagcatcttaaagctgaaaagtggtaagtcaaaccatcataaatcagggaccttctgtattagaaatcaattggaaacctgtctgtggccagatcttgatca

SEQ ID NO: 807 - DNA, 11953 bp, Homo sapiens
catcaaaaatcttcctggaaatctcttccaaatcctatagtaaatgttcctccagaggattctgtttctttcagtcttcaggttgatttgcccttccctggttttgagaaaatttttcagaatccctataatgttttgttaacattattaacattatttcattcatccagaattgtataaaaataatgtaatgaatgcctgtggaccaccccacccacacaactattttttttctctttattcatcctcaaaacagacaccatttggctggccgcagtggctcacacctgtaatcccagcattttgggagaccgaggtgggtggatcacctgagatcaggagttcgagagcagcctggccaacatggagaaaccctgtcttcatctccacaaaaaatacaaaaatgagccaagcgtggtggcgggcacctgtaatcccaactacttgagtctcctgaacccgggaggcggaggtggcggtgagccgagatcacgccactgcactgcagcctgggcaataagagtgaaactctgtttaaaaaaaaataaaaaagaggcaccatctctcagaatcagcttgagcaacttgtagacaaataggtggccagctcttggccctgctctctgtccatcagatcaatggctgaatcccctcttcaggtccacggttggaagggccactattcgggatatgacagttgctctggtagttcaacattagtgctggtgacaacctctcatcggccacctcctgaggaaccagagttttccagtgcctgtgcttctccctctggcgctgtttcagagtaactattctccatacacttctcttgctgtgacttctgcttatttctggtgtcagttgcctctggcttttgattgcttctttcttgcatacaactctcagtttgaagccaccccactctctgatgactgtctcagcttgtctcacagacacatttcccaatcatgaagatccagtcggtggattggtcattatccagtcagtgtacctctgttggatggagttctcacctcgagagacctcacaggtcgctggctacatgtctgcctttgggtcagctacttgttcctcaatcaaccagccctggcctagataagggggtctgtgttaggaacttgttactgggcaacaaaccatccccctcgacgaagtcttagtgtcaaataaatataagcatttatttcactgatacacacataggagttggctgggggtcaggtgatctagggtgggatccaatgtgacccttttccttgtatcttttttttttttttctagatggagtcttcctctgtcacccaggctggagtccagtggtgcaatctcggctcactgcaacctccatctcccgggttcaagcaattctcctgcctcagcctcccgactagctgggattacaggtgcctgccaccacacccagctaattttttttgtatttttagtagagacagggtttcaccacggtagccaggatggtctcgatctcctgacctcatgatctgcccaccttgtcctcccaaagtgctgggattacaggcgtgagctactgcgcccggccaaaagaaattttttaaattagttgagtgtggtggtgtgggcctgtaatcctggctactaaggaagctgaagtgggaagacagcttgagctaggaggtcatagctgcagcgagccatgattatcttaccatggcactctagtctgagtgacagagaccctgtctcaaaaaaaaaaaaaaaaggataatgtaaaatctttaaagaaaagggacagaggctgggcgcagtggttcatgcctgtaatcccagcgttttcggaggccgaggcggggatcatctgaggtcgggagttcgagactagcctggccaacatggagaaaccccgtctctactaaaaatacaaaattagctgggcgtggtgtcgcatgcctataatcccagctactcgggaggctgaggcaggagaattgcttgaacttgggaggtggaggttgcagtgagccatgatcgcaccactgcactccagcctgggcaacaagagcaaaactctgtctcaaaaaacaaaaaagaagaggaacagaaaacatcagaagcaatatggaaatgttgtttaaagcattaaacatgccaacagaagcaaaaccaaatgtatcagtcatcataattacctatgagtcagagacaaatagttggggaggttcaaagtattttctttttcaggcatcctctgattcaagaggtaaattctccatgtatttttctcaatccagttcctctgtcttataaatagcagagattctggcttttctccattttccacatttctgtagtggtctgagtgggccgcaaggaggggctgcatcaggggccactggctggtgacactttccaggtgacagcctcattgcataccctctgaagccctgcagcccttcctgctaccctcatctcttcatggcactcccacatcctacttgagctagggctcattctgtgggggccttcactctcctgtttgcttctgagacccaggaggcagaggttgcagtgagccgagatcacaccactaaactccagcctgggtgacagagcaagactccatctcaaaaaaaaaacaacaaaaaaccattagccaggtgtggtggcacacacctatagtcctagctactcgggaggctgaggtgggaggatcacttgagcccaggtggtcagggctgcagggagccatgatccactccacaccagcctgggcaacaaagggagaccctggtctcaaaaacatttttttaattaaaaaaaaaagaagtcgactgggtggcttggctcatgcttgtaatcccagcactttgggaggctgaggcaggtggatcatttgaggtgaggagtttgagaccagcctggccaacatggtgaaaccccgtctctactaaaaatacaaaaattagctgggtgtggtggtgggcgcctgtaatcccagctacttgggaggctgaggcaggagaatcgcttgaacccaggaggcggaggttgcagtgagccaagatcacgccactgctctccagcctgggcggcagagtgagactccgtctcaaaaaaaaaagaagttatcaaggaaactgcagcaccccaacaaaaacagaacttctttgacctcagaatggaaaaatggcagaagctgattctcacagagttggctcagatcgcatggctgttgctaaatcaaacaccgaggctagcaggatagaacgctctcatcaatgaggcctaggtcccgagcccaccctgagagacaggcagtggcctcaagaggaggagacatcaataatcaaataccaggaagacgaaatgcaaggacaataagagcccacaatcacctctttaatttctccctgggaagaatgctgcctgagaggctggcagaaacgaagaggccaccacacatctgctctgtgcttcctagtttacaaaatacttctcaggttgtcccatttaatcctcacaagtagcccacaaggcaagtggcatcacttatttatttatctatttatttatttatttatttatttactttttgagacagagtttcattcttgtcactttatttacttatttatttatttttcgagacagagtttcactcttgtcacccaggctggagtgcaatggcacaatctcagctcactgcaacctccaccttccaggttcaagtgatcctcctgcttcagcctctcgaatagctgggattacaggtgcccgccaccatgcacagataacttttgcatttttagtagtgacggggtttcaccacgttggccaggctggtctcaaactcctgacctcaggtgatccaccctcctcggcctcccaaagtgctgggattacaggtgtgagccaccgtgcccagacacaagtggcaactgagacttaagagacatgaaggggcttggctaagttgcaaagcaggtatggaaccaacagaggggctgtggagctgtgcagaaaaaacaggaaggcactaacccagggtaatgtgtccatagcccccaccttgtccagcaccacatcctcccttcacctcagggctgcagctcctccgcctctgcctcctcagggcccacatcctgtgcctctctcccttatcattctgatcctgccagtttctgccacgcctctgtctgaactttgctccgtgctccaggcttgttttcctctggacctgggaaccactggcttactttcactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtgagaaggctggcaggggagcccgggccagctggctgggtgccacctaaggggttctgaacaggagggagagggagagaggaataagaatggttgcttgggagaggatggcaatggcttcgtgggggctagcagccctctggagtcagtcctggaggagccccagggtcccaagctgaatgtctgtggggcacagaaaggacgagagcctcactgctctaaagagctcccctaccgggtagggagcatgtcctgcctgtcctccctgtccccactgttgagcagatgctgggaaaacctcactacaatggtcgaggcagaaggagcagctggttgtcagagacgtcatcggggcaggataataacaggcatgagggtggggcgcagtgaaattacccagagccagggactgccctcacggatcagtcaccctcgcttgcctccacgtccattcactctcaccccacatttctggaagcccaatctgtgcggactgctaaggataaactcagaacttaggtcagtatggcagggaggatgccctcaagtcgtcttccgggagatgagaatctatttgccaggggcggaggtgggggttggtttttgtgtttgttttttgtttttttttttttttgagacagggtctctctctgttgcccaggctggagtgtggtggtgcgaacatggctcactgtagccccaacctcctgggcccaagcagtcctcccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggctaggctggtctcgaactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaaactttgggatggtcaacctcgtttaatatcttcatgcgataaagacaaaagatctacccagcacagttccccacttctcaggacagttggctaatgacattctccaggggagagctccccttggtcccttttgctggtcacacctcgctggtcacacctctatttgctaaaagaggatacctctcctttaaccaacaatcccctcttactctctagtatcttttcttctactccctcctcctgcatggattcttggctgctgtactctactctatcgctctaaactcaactctctttgagagtcacactcctctcaggctgacacacttagccattgtcacggggtgctccctctgcaacctgaaccacccctgtctccccacactcctctgccccatctaaccagcttgcttcagcggagctccctgagtctgccttccccaaatatgcattcacagctgccttccctccacctctgtgcccagagtcactctcaagaagcaccacccggtgggcatggtggcttacgcctgtaatcccaacactttgggaggccgaggcgggccaatcacctgaggtcaggagttcaagaccagcctggccaacatggtgaaaccccgtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagcttgtgttccctttggtaaggccaccagtctcacggaagcaaggctggaagtcccacgagagcaagcactgcctgctttgttggccactatgtacccagtgctagaccagcaccttgcactaaacagacacccaattaatagtcatggaatggcagcgtgtgcctgtagtcctagtttgggcccagaaatgaaagattgcagtgagctatgaccacgcgccactgcactccagcctgggcaacagagcaagaccttgtctcaagaaaataaaaaataaaaaagtcattgaatgaagtatagaactaggcaaggcaatttcagatagaagtaggtaccatcggccgggcgcagtggctcatgcctgtaatcccagcactttgggaggctgaggcaggcggatcaccgaggtcaggagttcacgaccagcctgaccaacatgcagaaatcctgtctctactaaaaatacaaaaattagccaggcgtggtggcgcatgcctgtagtcccagctactcaggaagctgaggcaggagaattgcttgaacccgagaggcggaggttgcagtgaaccaagattgcaccattgtactccagcctgggcaacaagagtgaaactctgtctcaaaagtaaaaaataaaaataaaatgaaatggtgctggcatgaagagctcctaggcaaagcagatgccactttttataggattttcagggacaggctctatgaggtgatgtctgaactgagacccaaatgacaagaagaaggtgtgagtgttgcagacactaggggctggtagtacaaagcctaaggtgggaacaagctctacacttctgaggatcagacaggtggccggtgaggtgagatgtaatgagatgaggtctgaggagggcagaggctaggcctggaacaccctgaaaagccacagtggagtcatttgaatttttattattataagtacaacagaaaactattgaaggacttttttttttttttgagacggaatctcactgtgtcgcccgggctgcagtgcagtggtgcgatctcggttcactacaagctccacctcttgggttcacgccattctcctgcctcagcctcccgagtagctgggactacaggcgcccgccaccacgcacagcaaattttttttttttgtatttttagtagagatggggtttcaccgtgttagccaggatggtctcgatctcctgaccttgtgatccacccgcctcggcctcctaaagtgctgggattacaggagtgagccaccgcgccatgccctattgaaggacttttggcactttgttttttgacggtttaaaactttttatttaagtcacacagacaagtacccagatccttagtacacagctcaacaaacttttacaaagtgagcacatctgagcccaggtcaagaaacagatcattaccagaagcccagacatgcttctcaccacacacggaaccccagaatcacttcaccaacaagcgtaaccactattctgtcttctaaccccatagacgagtttggcttattttgcactttacacaaatggaatgatagagtatgtgtctggcttttttttgagacggagctgttgcccaggctggagtgcagtggcgctatctcagctcactgcaacctccgcctcccaggttcaaatgattctcatgcctcagcctccagagtagctggggttacaggcatgagccaccacgcctggctaatttttgtatttactttagtagagatgggggtttcgccatgttggtcaggctggtctcgcactcccgacctcaggtgatccacccacctcggcctccccaagtgctgggattacgagcgtgagccaccgcgcctggcctgtgtctggcttctttagctccatattacgtttgtgagagccacccatattatcaggtgtagctgtagttttctttttttcttatacattctattatgtgactatacctcatttatacattctactgtttgtttgtttgtttttttgcttttttgcttttttgttttttttgaaacagagtctcgctctgtcacccaggctggagtacaatggcgccatctcggctcactgcaacctctgactcccaggttcacatgattctcctgcctcagcctcctgagtagctgggattacaggcatgtgccaccgtgcccagttaatttttgtatttttagtagagacggggtttcgcgatattggtcaggctggttttgaactcccaaccttaggtgatccgcctgcctcggcctcccagagtactgggattacaggcataagccactgtgcccggcccattctactgttgaaggagatctggatcattcccagtttggtttttttgcaaataatgctgctataaatattcttgtagatgtatttaggtacaaatacgtgtgcatttctattggataaaaacctagcagtaaaactgctgattcttaagacatgcaagtattcagcgctaatagatattgccagttttctgtagttcttagtgtgagaggtctggttgctccacacgccactggaatgaagaagactcctttgaccactgtgtggagaatgggtagtagaaggtctgcaatatatacagaaaaagaccaaactgagctgggcgtggggcctcaagcctgtaatcccagcacttttggaggccgaggccagcggatcatgaggtcaggagttcgagaccagcctgaccaacatggcgaaaccccgtctctactaaaaatacaaagttagcagggcatggtggtgcatgcctgtaatcccagctactcggaaggctgaggcaggagaatctcctgaacccagcagacagaggttacagtgagccgagatcatgccactgcaatccagcctgggtgacagagcaagactccatctcaaaaaaaaaaaaaaagaaaaagaaaagaccaaactgaggtcacggaagacatccaggagagatgagagtggcttggactaggccagtggctatggaaatggagaaatatgagctgattcaggctataagcacagtgttttcttcttcatttatgatgacacttttcactaagacaaaaagatggtgaagaatgagacagagaagcacatactacaaagggaagcaaacactttaatcaaaagagtaaaaatctcaaatagggccaggtgtggtggctcatgcctgtaaaatcccaacactttgggaggtggaggcaggagaatcgcttgagtcccagcattcaagaccagcctgggcaacatagtgagactctatctcaacaaaaattttaaaattagctgggtctggccaggtgcggtggctcacacctgtaatcccagcactttgggaggccgaagcaggctgatcagctgaggtcaggagtttgagaccagcctgaccaacatggagaaactttgtctctactaaaaatacaaagttagcagggcgtggtggcgcatgcatgtaatcccagctactcgggaggctgaggcaggagaatcacctgaacacgggaggcagaggttacagcgagccaagatcgcgccattgcactccagcctgggcaacaagagcaaaacttcgtctcaaaaaagaaaaaattagctgagtgtggtggtacaagcctgtaatcccagctactctaatgctaaggtgagaggatcacttgagcccaggaggtcgaggctgcagtgagccatgatcatgccactgcactccagtctgggcaacagtgtgagaccctctctcaaacaaaagcagaaacctcagacaagtagatcattcaaaattggtaaatccaaaaggcaattctaggtgtgtttggatccacaagcctccagtaagtgacctaaccagggaggtaaagtaaggtgtcagcatgggtcctggccctgccatgagacaggaagaagagagagcaggtgtttctctgaggttgctggggatgatataatagaactgaaactctcagccctttccctggagaagcacaaaatgctgccttggatggtatgtgccagataagacacatgaggagccaggcacagtggctcatgcctgtaatcccagcaatttgggaggctgaagcaggaggattgcttgagcccaggagttcgagatcagctaggcaacatggtaagacatgaactctccaaaaaaattagccaggcatgttgttccgcacctttagtcccagctactcgggaggccgaggtgagaagatcatttgagcccaggaggttgaggatgcagtgagccatgattgcaccactgcattccagcctggatgacagagtgagatcctgtctcaaaaagcaaacacacacacacacgaaagcaagaagcaagacagctgtggaattccagagataggagacaggcaaagaacctgacctggtgcaacgaagataaaggtaacggagccagatgaggaggcttaaatgccttacaagagttaggcgttcaagttacaagtcttggccaggcgcggtggctcacgcttgtaatcccagcactttgggaggctgaggcaggcggatcacgaggtcaggagatcaagaccattctggccaacatgatgaaaccccgtctctactaaaaatacaaaaaattagcccggcgtggtggcatgtgcatgtagtcccagctactcaggaggctgaggcaggagaatcacttgaacctgggaggtggaggttgcagtgagccaagatcacaccactgtactccaacctggtgacagagtgagactccgtctcaaaaaaaaaaaaaaaaaaagagttcagtcttgatgggcttctctgtgaagagaccctaaaggatttgagcagagaaaagaccagttgaaagctatgtttaggccagatgcagtgacttacacctgtaatcccagcaatttggtaggccagggcaggaggagcccaggagttcaagaccagcctgagcaaatagcaagaccccatgtctacaaaattttttttaattagctgggaatgatgacgcatgcctgcgataccagctactcaggaggctgaggcaggaggatcacttgagcccaggaggtcaaggctaaagtcagccacgatcaagccactgcattccagcctgggtggcagagtgagaccctgtttcaaaaagaaagaaagaaaaaaaaaagctatgtttaacctgatagaggatagagtgtagggtggcatggggcaagagctatgagagtgtaatagggaggctgagaacaccctcatgggaggtgatgagggattcaatgtggggaggaactcacagatt

SEQ ID NO: 808 - DNA, 3704 bp, Homo sapiens
gggatcagagtagacgataatattagttaacatctattacaacctaattacatgccaggcatttatctcccagccctacgagggagggaggctggagcggctctggggcttgcaaatccgtgtggtctgggtccagaaccagacagatcgcttgtcctaggcgtggaagagccctgtggcatgagcccccaatggggggcacttggtaccccagcattcctccctggggcagccctcagctccagtcctgggactgctccgctcaaccccacccctctctccacagtgcccgcctaacctgcacaagctggacggttactactgtgaccatgagcaggtatgatggctgccccctgagcctgggattcagggcagtctcttgtctccactctgaccactcagcatctccatcccttgcctcttaattcttggactctcagggccgctgctacggaggtcgctgcaaaacccgggaccggcagtgccaggttctttggggccatggtgagtctggctagggctgggagtggggactccggaggacccagagctgagaagctggggagagtgggttccagctgaacaggcccccaagtgtgtagctccccaggatctcagggacccaggcagagtgtgggagatgcaggcctgaggtcttggggtgggtcctggggcgcgtggggtcacttggcatcctctccccacagcggctgctgatcgcttctgctacgagaagctgaatgtggaggggacggagcgtgggagctgtgggcgcaagggatctggctgggtccagtgcagtaagcagtgagtactgaggctcccagagggcctctcagctccagggcaggtgtgagacttttcagagatggggcagcaggttctcccaggaggagcctgtcagtcccaatgggcgggcacgtggcaaatgaggtggcagggtgcagggtgagggcagattagagttcagtagttgagtctgaggtcaaacttggggctcactgtctctatatgccccaacagggacgtgctgtgtggcttcctcctctgtgtcaacatctctggagctcctcggctaggggacctggtgggagacatcagtagtgtcaccttctaccaccagggcaaggagctggactgcaggtgctggccaggaccaagactagggaggggaggttgcagctgtgctgggggttaggagacagggggctgaggctggctgtgtcacttccccaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtgactgcctggagcctgggatggcgggagaagcttacaagaggggacaggcccctgctcacctctcctggccctgccctgcctctaggtctgcagcaatgaagggaagtgcatctgtcagccagactggacaggcaaagactgcagtatccataaccccctgcccacgtccccacccacgggggagacggagagatataaaggtgaggctggagctggccgaggggggtctgtctgtcctgctctctatgcctgtccttgccagctaagccctgccatcctccccaggtcccagcggcaccaacatcatcattggctccattgctggggctgtcctggttgcagccatcgtcctgggcggcacgggctggggatttaagtaagagacacacacaccctgtgccccctggcatccttgaggggggatcagaatccctactggtggagctgagggggccctccctgaaagcccaactgaaccagagctcacacgtcataggtccaagtagcctgcagggcttaacatttagaaactaggagattttaggctagatgaggtggctcacgcctgtaatcccagcactttgggaggccaaggcaggcggatcacctgaggtcaggaattcaagaccagtctggccaacatggtgaaaccccgtctctattaaaaatacaaaaattagccagccatggtggtgcgcacctgtaatcccagctacttgcgaggctgaggcagagaattgcttgaaccggggaggtggaggttgcagtgagctgagatcgcaccattgcactccagcctgggtgacagagcaagactgcgtcaaaaaaaaaaaaaaaaaaaaaaaaagaaagaaagagagaaagaaaagaaaagagaaaagaaatcaggagattttacactagcaattcggatttccagctctggaaacatgaaaaggttgagccccagcgtgcctctaagcatccccaaatagccacagagtggagctgggcaggggccacccaagccaggcatgtgtcctccagtctccagtccccacccagcctataatgctttgtgcgtgtctaagtttggggtccttgtgctggtctaacccccttaatgtgcagaggaggaacccatggcccaaggtcacatgattgagttagtagcagagtcagagctggaaccgggacgcatttttgtgggtgccctgggtaattctccctggcccttacattagtgtccaggccccggggaccccggccccgctctggggcaaggggtcgcatggcagccaaaggcccctccctgagagaagcaaaaggtcagatgtctccttttcctctccccttccaccatcctccccctgcagaaacattcgccgaggaaggtacgacccgacccagcagggggcagtgtgatgccggccacgtcatccctcccgctgtccttgtctcctccatctcattcgtcaccccgcgttctgttgatggggagcgggggctgattcccccacccctgctgccaggctgtcccggcaggggtgggagagcctcgctcagggaagaaggtcccagctgccctcgccctcgcccgctcaggccacgtccttctcgactgccctgctgcggccaggccctcccctgccaccaggtggaactggagctgcgcccctggcagtccccatccccgggagggccctccctgtgcgtcccatctgttttgtcttccatatcaccactgtctgacctcccgcagatcccttccctggccagcctgtgacttgccgcctgcctccagggcccagcactgagctccggggccctgctggggggctctccccgtggcccctgctcacgtcctcccctgatgccccctctccgttccaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacct

SEQ ID NO: 809 - DNA, 31086 bp, Homo sapiens
tataagactttgtggctggaaatgcaaggtggaggctgaaatgttctatatttttatctggtggaggttgtacagcatatagtcagccctccctgtatccacaggttacacattcattggaagattcaactaactgcaaatcaaacattcaaataggccgtgctctggtactggtataaaaataggcacataggccgggcgtggtggctgaagcctgtaatcccagcactttgggaggccaaggcaggtggatcacttgaggtcaggagttcaagaccagtctggccaacatggtgcaaccccgtctctactaaaaatacaaaaatcaggtgggcgcagtggtgggcacatgtaatctcagctattagggaggctgaggcaggagaatcgcttgaacccgggaggcagaggttgcagtgagccaagatcgcgccactgtactccagcctgggcgacagagtaagaccctgtctaaaaaaaaaaaaaaaaaaaaaaaagcacatagaccataaacccaaatacttaacagccaactggtcttcagcaaagcaaacaaaaacataaaaggggggaaaggacacccttttcaatagtaacgccaggataattggctagccacatgtaggagaatgaaactggatcctcatctctcaccttatacaaaaatcaactcaagatgggtgaaggacttaaatctaagactggaaactataaaaattctggaagataacattggaaaaacccttctagacattggcttaggcaaggatttcatgaccaagagcccaaaggcaaatgcaataaaaacaaagataaatttctgggacttaattagactaaagagctaagtaacagtcagtagagtaaacagacaacctacagagtgggaaaaaatcttcacaatgtaaacatctgacaaaggactaatacccagaatttaaaatgaatttcaacaaatcaacaagaagaaaacaaataatcccatcaaaaagtgggcttaggacatgaatagacatgtctcaaaagaaggtatacgaatgaccagcaaacatatgaaaaaatgctcaacgtcactaatgatcagggagatgcaaatcaaaaccacattgtgataccaccttaaactcctgcaagaatggccataatcaaaaaatcaaaaaaaacagtagatgttggcatggatgcagtgatcagggaaccctcctacacagctggtgggaatgtaaactagtacaaccactatggaaaacagtgtggggagtactcaaggaactaaaagtagaactaccatctgatccagcaatcccactactgcgtatctacccagaggaaaagaagtcattctacaaaaaagatacttgcacatacatgtttatagcagcaaaatttgtcattgcaaaaacgtggacccaatccaaatgcccatcaatcagcgagtggataaagaaactgtggatatatattcaatggaatactactcagccataaaaaggaatgaattaatggcattcgcagcaacctggatggacttggaggctattattctaagtgaagtaactcaggaatggaaaaccaaacatcgtatgttctcactcataagtgggagctaaactatgaggatgcaaaggcataagaatgacacaataggctttggggattcagtgggggaagggtgggaaggggctgagggataaaagactacaaatagggtgcagtgtatactgctcaggtgatgggtgcaccaaaatctcacaaatcaccactaaaaacatgctcatgtaaccaggcaccacctgttccccaataacctatggaagaaaaaaaaagttttttaaaaaaagaggccggacgtggtggctcacgcctgtaatcccagcactttgggaggctgaggtgggcggatcacgaggtcaggagatcgagaccatcctggctaacacggtgaaaccccgtctctactaaaaatacaaaaaattagccgggcatggtggcaggcgtctgtagtcccagctactcgggaggctgaggcaggagaatggcgtgaaaccaggaggcagagcttgcagtgagccaagttcgtgccactgcactccagcctgggtgacagagcgagactccatctcaaaaaaaaaagaaaaactcaaacagtccatgcttggtggctcatgcttgtaatcccagcactttgggagaccaaggtgggaggattacttgaactcagaagttcaagaccagcctgggcaacatagcaaaactccatctctacaaagaaaaaaaagtaatggaaaaaagttcaaataaataataacaggccaggcatgctggcttacgcctgtaattccagcactttgggaggcccaggtgggaggatcacctaggttgggagttcaagaccagctggccaacatggcaaaaccctgtctctactaaaaatacagcaattatctgggcatggtagcttatgcctataatcactttgggaggctgaggtgggtggatcaccagaggtcaggggttcaagaccagcctgggcaacatggtgaaaccccgtctctactaaaaatacaaaaattagccaggtgtgatggcacacccttgtaatcccagctacttgagaggctgaggcaggagaatagcttgaacccaggaggcagaggctgcagtgagcggagatcacaccactggactaccgcctgggcaactgggcaacagagtgagagtctgtctcaaaaaaaaaaaaaaaaaaaaaaaaaggccaggcatttttacttacttacttacttacacctgtaatgccagcactgtgggaggccaaggtgagtggatcacttgaggtcaggagttcgagaccagcctgaccaacatggtgaaaccccgtctctactaatattacaaaaatcagccaggcatggtgttgtgcgcctgtaatcccagctattcgggaggctgaggcaggagaatcacttgcacctgggaggcggaggctgcagtaagccaagatcgcgccactgcaccccagcctgggtgacaagagcaaaactctgtctcaaaacaaagaaaaaagagaaggaaagaattagaaaatcaccatgttgcaaaagccagcaaaatcattgatgcagacagcgatcatctataggtgctaaaaaaagtagatgaggccgggtgcggtggctcatgcctgtaatcccagcactttgggaggccgaggcgggcagatcacctaagatcaggagttcgagaccagcctggctaacatggtgaaaccccatctctactaaaaatacaaaaattagccgggcgaggtggcgggcacttgtaatctcagctactcggtaggctgaggcatgagaatgacttgaacccgggaggcagaggttgcagtgagccgagattgcatcactgcactctagcctgaacaacagagccagactccatccaaaaaaaaaaaaaaaaaaaaaatttggccgggggtggtggctcatgcctgtaatcccagcactttgggaggctgaggtgagcagatcacctgaggtcaggagttggagactagcctgaccaccatgccgaaaccccgtctctactaaaaatacaaaataaataaataaataaataagctgggcgtggtggcagttgcctgtaatcccagctactcgagaggctgaggcaagagaattgcttaaacctgggagttggaggttgcagtgagcgagaccatgccattgcactccagcctggtcaacagagcgggactctgtctcaaaaaaaaaaaaaattaaaaaaagaaggaaaaagatcaataatccaaaagtatactaggcaagggaggttaccagagagtacagaggaaactaatggtccttaaacacatgggactttgccctgccttgcttgtggtcaggaaaatgcaaattttctctactctgagatactatttttcacatgtcatgttggcaagaaaccaaagttcgataacactctctgttggtaaggctgtaaggcagcagaacttttacccattgctagagagagtgtgaatcgctctaacacctgagggggaatatttgtcaatatgcgtaaaaattacaaatgcacacagtctttgagccagaaatcccgcttcggaaaatttatccacagagacacttgcatatgtgtaaaatgacgttctgtatggcgatgtcagcctaagaacaaacgagtggaaaaaatgtccatctctgagagtgaaattaaccataaagcattcacacagcagcatgctatgcagctgtgaaaaaataaaaataaaaaataacaagaatgtggccaggcacagtggctcacgcctgtaatcccagcactctgggaggccaaggcgggcctatcacttgaggtcaggagtttgagaccagcctggccaacatggtgaaatcccatctctactaaaaaataaaaaaattagctgggcatggtggcatgcacctgtagtcccagctacttgggaggctgaggcatgagaattccttttttttttttttttttgagacggagtctcactctgtcacccaggctggagtgcagtggcgcgatctcggctcacggcaagctccacctgccaggttcatgccattctcctgcctcagcctcccgagtagctgggactacaggcacctgccaccacgcccagctaattttttgtatttttagtagagatggggtttcaccgtgttagccaggatggtctcgatctcctgacctcgtgatctgcccgcctcggcctcccaaagtgctggggttacaggcgtgagccactgagcccggctgagaattccttgaacctgggagacagaggttgcaatgagccgagttggcgccactgcactccagcctgggcaagagcaagactccgtctcaataaaaattaaaataaaataaaataaagttttgttaagagatctccaacacttgttaagtcacgtgggagaagcaacattcagaagaatgtgtagaacatgctaccttttaatgaaattctgggccaagcatgctggctcatgcctataatcccagcactttgggaggccgaggtgggaggatcacttgagcccagaagttcgagaccagcctgggcaacataataagacctcgtttctagtgagactggacaggatcttgctctgtcacccaggctggagtgcagtggcacaatcatagctcactgcagccgccaactcctgggctcaagtgatcctcccacctcagcctcccaagtagatgggactacaagcacacgccaccaccctgggccaaattttaaaaattcttttggagaaatgaagtctcagccaggtgtggtggctcatgcctataatcccagcactttgggaggctaaggtgggtggatagaaaggtcaggagtttgagaccagcctggccaacatggtgaaaccccatctctactaaaaatacaaaaatttgctgggcctagtggtgcccacctgtaatcccagctacttgggaggctggggcaggaggatctcttgaacccgagaggcgagggttgcagtgagccgagatcataccagtgcactccagtctaggtgacagagcaagactccatctcggaaaaaaatttttaaaagtccgggtgcggtggctcaggcctgtaatcctagcactttgggaggccgaggtgagtggatagcctgaggtcaggagttcaagaccagcctggccaacatggtgaaatgccatctccactagaaatacaaaaattaggccaggcacggtggatcacgcctgtaatcccagcattctgggaggccgaggcgggtggataacgaggtcaggagatcgagaccatcccagccaacatggtgaaaccccgtctctactaaaatacaaaaaattagccaggtgcggtggcatgtgcctgtaatcccagctactcgggaggctgaggcaggggaatcccttgaacctgggaggcggaggttgcagtgagctgaggtcgcaccactgcattccagcctggcgacagagcgagactctgtttcaaaaaaaaaaaaaaaaaaaaaaaattacctgggtgtagtggcgggtgcctgtaatcccagctactcaggaggctgaggaaggagaatcactttaacccaggaggtggaggttgcagtgagccgagatggcgccactgcactccagactgtgcaatgggagggaaactccacctcaagaaaaaaaaaaaaattcacaggggtagaaagtagtatggtggttgccaggggtagaaggaggaaggacggagagagtgtttaatggggacagagttttggttggggaagacaaaatgttctggagatggatgattgcacaataatgtaaatatgggtaatgccactgaatcgtacacttaaaaatagttaaaacagccggacacagtgctcacgcctgtaatcccagcactttgggagcccgaggtggggagatcccctgaggtcaggattcaagaccagcctggccaacatggtgaaaccccgtctctactaaaaatacaaaacacattagctggatgtagtggcgcacgcctgtaattccagctactcgggaggctgagacaggagaatcgctggaacctgggaggtggagactgcagcgagtcaagatggcggcattgcactccagcctgcgcaacaagagcaaaactccatgccaaaagaaaaaaaaaatgttaaaacggtaaattttacatgtattttgccacattaacaaaaaatgtttaggccaggtgcagcagctcatgcctgggcaaaatattgaggccctgtctctaaaaaaaaaaagaaaaaaaaaaacaagaaaaagaaaaatattggccaagcatagtagtgagctgaggtgggaagatggcttgatcccaggggtttgagactgcagtgagctatgatcgtgccactgcactccagtctgagtgacagagccagagccagacaaagccaaagagggaaaaaaatgggtttaacatactggcggggcacaatggctcacacctataatcccagcactttgggaggatgaggcaggcaggttgcttgaactcaggagtttaagaccagcctgggcaacatggtgaaaccctgtttctgcaaaaaaaaaaaaaaaaaaaatttagctgggcgtggtgacatgtgcctgtggtctcagctactctgggaggctgaggcaggaggatcacttgagcccaggaggtcaaggctacagtgagctgggatggtgctactgcacttcagcctgggtgatagagtaagaccctgtctcaaaaaataaataaataaataaataaataaagcaagcctaggagtttgagacctgcctggggcacatactgagaccctgtctctacaaaaaatttaaaaatgagctgagagtggtatgcatctgtggtcccagctactcaggcggctaaggtgggaggataacttgagcccgggagatcgaggctgcagtgagccgtgatattgctgctgactctagcctgggcaacggagtgagaccctgtctcataaagaaaaaaaaaacctgtattcatatttgttttcatgtgtacaaagtaattctggaaagatactcaggaaattaagagctgtggttattcatgagagaaaggggaggaactgaaacttggaaggcagatgctgcttcataaaccttatatgctttgctttttgaagcatgtaaatgtattaactattcgaagataaattaaatagtttggagaagctgagggcagtgatacagacctctaatcccagctatttgggaggctgaggtgggacgatcactttaggaaagggaactaagaccagcctggcaacacagcgagactccagtctcttaaaaaaaaaaaaaaaaaaaaaaaaaatatatatatatatatatatatatatatatatatatatatatatatatatatatttattgtattgctgggcacagtggctcatgtctgtaacctcagcactttgggaggctgaggcaggtggatcacttgaggccaagagtttgagactaccctggccaacatggtgaaacaccatctctaataaaaatacaaaaattagccgggagtggtggcgggtgcctgtagtttcagctactcgggaggctgagacaggagaatcacttgaacccaggaggtggacattgcagtgcactgagatggtgccactgcactccagcctggatgacagagcaagactccatctcaatatatatataatatatatttatatataatatgttaatatattgtatacatacatatatgtatacaacatattaatttatattaaggtaatatattatattaattaattatattatactaattaaattatattaatataagatgtattaatttacatatatttctgtatacaatatattaatatattataaaaatgttacattatgtcctaggctatatttatatgtgctatatttatattatataaataatatatcataaaaatatgttacattatgctatgtatttattttatatagcataatgtaacatataatatataatgtatatattacatattatatattatatattttttgtatacttttttaacatgtccccagagataggaaatataaatctatattatacattatataacatatttatattacatattatatattatatatcataatacattataatatattaattataatataatatattaatatattataacatattctataaataaaatatttatatattatataaatatgttatataatatgttatatataaatgctatgatatattgtataacataaatataaaattatatctcatataatagattatacatgatatataatatacattatatatcatatacattatatatcatacatgatatataataattatatttaatatataatgtatatttttataataattacatataacacatatatttatatattttatatatatatatatatatacagtctgtatcttcaactgttttgtttttttaaaaggacactcataattggatttagggcccacccagataatccaggatgagcttatcttaatataatataatatataattttatattatatattatatattgtattataatataataaatatataaatattttattatatattttataatatatattatatatattatatatataaaataaatatatatattatacataaatataaatatatataatatattatataacctatttatattatatatataaatatataaatatatcatatatatttatgtagaatatatttatatattataatatactatattattataattataatatatttatatataaatatataaatgtatttctatataatatataagtatattatataatagaatatagtataatatataacatctataatatataagtatacttatataatatatattatacaatatataagtatattatatatgtttatataatatataaacatattatataatatgtttatatatgatatatgcatattatgtttattatgatatatgcatattatataatatgtttattatatgatatataaatatatttatatgttatagatgttatgtatattatagatatattataatttataaatgtatatcataataattttataaacttataaatatatattatatatataaagtttggaaatcagggctttatttagaattggcaaaattggcttgcatttttatagtgaacaaaatcatcatgacacccatattcctagcaggtgacatttcccgttctgactatattcatttcactgtagctgctgtaaccagtgtccacaaaccaggtggcttacaccaatgaacatttattcccttcctgttctggttgtcaggagtctgaaatgcaggcgtcgcagggccgcgccccctctgaggcctctaggggagggtccctccttgcctcttccagcttctggaggctccaggccttccttggcttcctcaatggcattaagccaatttctgcctctgtcttcatatgaactttcctcttttgtctgtgtcttcaactcttttgttttttaaaaggacactcataattggatttagggcccacgaagataatccaggttgagctcatcttaaggttctttttaatttttttttaatggagtctcactgtgttgctcagactggagtgcagtggcatgcgatctgggttcaatgcaacctccgactcccgggttcaagcgattctcctggatcagcctcctgagtagctcatattacaggtgcccgtcaccacacccagctaatttttgtattttcagtagagaccgggtttcaccatgttggccaggctggtctggaactcctgacctcaggtgatctgcctgcctcagcttcctgaagtcctgggattacaggcatgagccaccccccaaggccatctaaagattcttaattacatttgcaaaagctctttttctttttctttctttcttttttttttttgagacagggtctcactctgttgccgaggctggagtgcagtgacaccatcccagctcactacagtctcaaattcctgggctcaagcgatcctcccacctcagcctcctgtgtaggggactacaggaacacaccaccatacccagctaatttttgtatttgtagagacgggagtgtcactgtattgtccaagctggtgtggaactcctggcctctagcaatcctcctgccttggtcttccaagtagctgagaccacaggcatgcatgcctggctaatattttctattttttaaaggccagatcttgacattttgcccaggctggtcttaaactcttacgctcaagtgttcctccggcctcagcttcctaagtagctggaaatacaggcacacatcacctcacctggctaaggttttgttttgttttgttttaagataggatctctgtcacccaagctgggtgacacaatcatggctcactgcagccgtgaccttctgggctcaagcaatcctcctgcctcagcctcctgagtagctgagattacaggcacctgccaccgtgcctgactaatttttttattttttagtagagacagggtttcactgtgttggccaggctggtctcaaactcctgaccccaggtgatccgtcctccttggcctcccagtgtgctgggattacaggtgtgagccaccgcacttggtttcaaatacttttttctagtaagatcacatttatagatcccagggtttaggatgtggacatagatttctgcagatcaccatttacacaccacaccgacgagtgctgtgcagaatgcttaggactctatagaatttcaccaaagtccccaagaggctcatgaagcaggtatacttatcatctccatcttcacaatgaactcagagaggtatagggtcttgcccaaggatacacaggaacagagatttgaacctagctatgttgggcccaaaactctgattctatgtgagacacaaaagacgcttctgggctgggtgcagtgactcacgccagcactttgggaggctgaggtgggcagatcacttgagatcaagagtttgaggctagcctggccaacatggcaaaaccccgtctctactaaaaatacaaaaattaaccagacatggtggcgcacacctgcagtcctagctacttgggaggctgaggcacatgaatagcttgaaccctggagacagaggctgcgatgagccgagatcactccattgcactccagtctgagcgacagagtgagaccctgtgtcaaaaaaaaaaaaaaaagaaaagaaaaagaaaaaagaggcttctggtttgaggcccatcagttaagtcaggcaggcaggcagcagatatttcctgaatgcttgttcttccccaggccaggcactgggggcgcaggagaaaagggcaggagggtacctccctacaggaagttcctggagaagaggccgaggggaagagagtattattcaccagccctttagaaacagagcaatcagaggtgacctctgcctccggaaggttgcccttggcctgtgacatccacagcaggcaactggggccaggagtttgtgacagagaaaaggacaaagagatgaagttctaatccaaagggaacgtgtccagtagaaataacatttaaacagcacttacttcatgcaggagattgttgtaaaaatttgactcactcattaaatctttcccattttgcaagtgaggaaaccaaggcacagagagtttaagtgacttggccaaggtcacacagcaggaaagaggcagaggtggaatttgaagccaagcttgccccccttaccagagcccttgtttttgctgtgttttaaagtcgaggtgaaattgacattaacatagctgtgcctggtggctcatgcctgtagtcctagcactttgggaggccaaagggggaggatcacttgagctcaggagttccagatcagcctgggcaacatagttaggcctcatctctttaaaaaagaaagactggccgcagtggtttacatttgtaaaccacctgtttcccacctggctaatttttgtatttttgttagagactgggttttacactacggtggacaggctggtctcaaactcctgaactcaagtgatctgcccgccttggcctcccaaagtgctgggattacagacgtgagccaccgtacctggcctggttagttttattttatatggatgttatctctctctttttttttttttttttgagacagagtttcgctcttgttgcccaggctggagtgcaatggcgtgatctccgctcactgcatcctccgactcccaggttcaagagattctcctgcctcagcctcctgagtagctgggattacaggcatctgccaccatgcccagcaaatttttgtatttttagtagagacgggtttcaccgtgttggccaggctggtctcaaactcttgacctcaagtgatccgtcctcctcagcctcccaaagtgctgggattacaggcatgagccaccatgcccggcctcaattttttttttttttagacaaggtttggctccgttgtacaggctggagtgcagtgatgcaatctcagctcatggcagccttgaacgcttaggcaaaagtgatcttcccacctcagcctcctgagtagctgggatcacagatgtgtgccaccacacctggctaatttttacattatttgtagaggtggggtttcacctgttgcccaggctggtctggaactcttgggttcaagcaatcctcctgccttggctgcccaaagttccggaattacaggcgtgagccatcattcccagcctctcaatatatatatttttattttattatgatgatgatgattattttttgtgacaaagtctcactctgtcgcccacgctgatgcacagtggctcaatctcggctcactgcagactctgcctcctgggttcaagtgagtctcctgcctcagactcctgagtaactgggattacaggcatgtgccaccatgcccagctaatttttgtactattagtagagatggggtttgaccatgtcggccaggctggtctcgaactcctgacctcaagtgactcgcccgcctcagctgcccaaagttctaggattacaggcatgagccactgtgcctggccactgccactaattttacattatggtgagttgtatgattatttcaatatacaactacagtataataataatagaaataaagtgcacaataaatgtgatgcgcttggccaggcgcggtggctcatgcctgtagtcccagcactttgggaggccgaggtggacggatcatgaggtcaagagatcgggaccaacctggacaacatggtgaaacctcgtctctactaaaaatacaaaaattagctgggcgtggtggcatatgcctgtagtcccagctactcggaagctgaggcaggagaatcgcttgaacctgggaggcagaagttgcagtgagccaagattgcgccattgcactccagcctggtgacacagcaagactccatctcaaaaaaaaaaaaaaaaaaaaaaaaagtgatacgcttgaatcatcccgaaaccatccacttgacactccatccatggaaaaattgtcttccacgaaaccggtttctggcgtcaaaaacgttaggatctgctgcctcaggacacccttctgtgtctccgtttcctcatttgtaatatgagaattatcttagtcctgaattcataaccccatgctcttaaaagtgtggtttccgccgggcgcagtgtctcacgcctgtaatcccagcactttgggaggtcgaggcgggcggatcacgaggtcaggagatcgagaccatcctggctaacacagtgaaaccccgtctctactaaaaatacaaaaaattagccgggcgtggtggcgggcgcctgtagtcccagctactcgggaggctgaggcaggagaatggcgtgaacctgggaagtggggagcttgcagtgagccgagatcatgccactgcactccagcctgggcgacagtgcgagactccatctcaaaaaaaaaaaaaaaagaaagaaagaaactgtggtttctgggctgggcgtggtgctccaggctggagtgcaatgacacaatcttggctcactgcaacctctgcctcctgggttcaagcgattctcctgcctcagccttctcagtagctgggattacaggcacccgccaccatgcccggctaatttttatatttttaatagagacagggtttcatcatgttggccaggctggtctcaaactcctgacctcaggtgatccacccgcctcgacctcccaaagtgctgggattacaggtgtgaaccactgtgtccagccaatcccagcacttcgagagtctgacgcatttgggtcccttgagtccaagagtttgagaccagcccgggcaacattgtgaggtctcatctctacaaaaaatacaaaaattagctgagcatggtggtacacacctgtagtcccagctacttaggaggctgaggtgggaggatcatttgaacccgggaattcaaggctgcagtgagctatgttgccaccactacaatccagcctgggcaacatagccagaccctgtctctgaaaaaaagaaaaaaaaaaaagtctggtttctgaaccagcaggatcaatgtcacctgggaactggttggaaatgcagattcttagatatgttccatacctgttgagtcaggagctctgcaggtaggacacaaagatatgtgttttgtttgtttgtttttgagacagagtctcactctgttgcccaggctgaagtgcagtggcgccatctcagctcactgcaacctccacctcccaggttcaagcaattctcctgcctcagcctcccaaggagctggggctacagacatgagccaccacacccggctaattttttgtatttttagtagaggcggggtttcaccatgttggccaggctggtctcgaactccggacctcaggtaatcctcctgccatggcctcccaaagtgctgggattacaggcgtgagccaccgcgcctggcctgatttctgttttaacaagcctacccaaagattctgaagctcactcacatttgagaaccattaccctgggttgttgggagaatcaaatacattacagagatataaaatgctttgagcagctgagggctgtggctcatatctgtaatcccagcactttgggaggctgagacaggcggatcacctgaggccaggagttcgagaccagcctggccaacgtggtaaaaccccgtctctactgaaaatacaaaaattagccaggtgtggtggtgggcgcctgtaatcccaactacttgggaggctgaggcgggagaatttcttgaatctgggaggcggaggttgcagtgagccaagattgtgccattgggactgtacctctagcctgggtgacagagcgagactccatctaaacaaacaaacaaacaaataaacaataaaatgcttacagtagtgtgcctggcctcgtagcacatactgcactgggcgttcactgctattatgatcttcgaagaggtccaggaccctaacgttgtggggatctggttgtgtcaccttaccccgccttttgggattatgcgtttctggtctctgcaggttggagaccttctcgcctctctgtcaatgatgttgacaataagctgggccacatcaccctgtccctagcgaaaggttatcacttcgctggggacatgagaaaggtcgggttgggggggccgtgcctgtctcccctctgctggagaagataagggaggcactcagctttcttcaggcagagtgtgggggagccacgatgtataaatggggggccaagaggcagcagagacactggcccactctcacgttcaaagcatctccgtccagcatggccaggtacatgctgctgctgctcctggcggtatgggtgctgaccggggagctgtggccgggagctgaggcccgggcagcgccttacggggtcaggctttgcggccgagaattcatccgagcagtcatcttcacctgcgggggctcccggtggagacgatcagacatcctggcccacgaggctatgggtgaggctggggagagagtggatgtagaaggggaacaggtggctggatgggtcccaggagctaaggacagagataagaggaggttgctggaggaggagggtccctgtcctgccacattcagccagggacacctgcccagccttgaaacaagggctcaggagttagcagagctgcagagctgggatggggtgttgcaagccatccatgggggctggaagtctgaggacaggtgggggcggggagcgtgccatttgcaaagacaacaccgaagtgttttccaaccctttccagcaggtaatgtgaagggtgtggtatacacatagctgggtttgtcacctaatgcatgacctctccccagcaagttggtttttcttccgtctctgagtgtcttttttttggagatgtggtctcactccattgcccaggcttgaatgcagtggcccaatcactgctcattgcagcctcgacctcccaggctcaagtgattctcctgcctccgcctccagagtagttgagaccacaggcacctgacaccatgcctggctagttttaaattttttttttgtagaaacaggggtctcactatgttgcctaggctggtctcgaactcctgggctcaagtgatcctcccacctcggcctccctaagtgctgagattagagtctctgagtgtctttatcttcaaatgggagacacagttcctgaatcttgcaggattaagtggtatgattaaatcaaaacagattagggcagagtctcagcagggcagcggcacaatctgggatccatcaggagagtcagagggaacagaagacctagcttcatgaggggcagggacctggcaaatagatattcatgatggtgagaaggaggataggtatgagcgtggacatagaagacacaccacttggattcagatagtagctctacaatgtaatagttgtgtgttcatgtgctactattttttttttttttgagacagaatctcattctgttgcccaggctggagtgcagtggtgcaatcttggctcactgtaacctccatcacctgggttcaagcgattctcgtgcctccagcctcccaagtagctgggattacagatgtgtgccaccatacctcgctaatctttttatttttagtagagacagtttcaccatgttggccaggctggtctccaactcctgacctcaggtgatcctcccacctcagcctcccaaagtgctgggattacaggcatgagccaccgcgcccagccatgcaaattctttactgagtcctgcctcagtggtctcctctggaaaatacgggtgataactgcacccacctcaactggttatcactgagaagaataaagaagttaacctgctaaagcacttaaaacgttgtttgacacaaagtaagtgatcaataaattattattattattattattattattattattatttttgagacagggtcttgctctgttgcccagactggagtgcagtggtgtgatcacagctcactgcagcttcaacctcttgggctcaagcaattctcctgcctcagcctcctgagtagctgggactacaggcttgtgccaacatgtctaactttttattatttgtagagacagggtagtgctgtgttgtccaggctgttcttgaactcctggttctggtgatcctccagcatgtgcccctggaagtgctgggattacaggtgtgagacaccgtgcccggactcaatagtcatttttgagtgctcatcatgttccagacattgttctaagtttttttttttaatgaatattaactccttataaaacttgagaaggttggagtaattatttttttccactttgcagaaaagaacattgaggctccaagaagtaaatttacttgctcacgattagagaagctggattcatgctcagtcagcccagctcccaaatgtaccaggtcctcaattaataaagagtaaggagaaataaatgacagggctgggtgcggtggctcacgcctgtaatcccagcactttgggtggctgaggtgggcacatcacttgaggtcaggagtttgcgaccagcctgaacaacatggtgaaccccatctctataacaatacaaaaatcagccaggcctgctggcagacacctgtaatcccacctactctggcagagccagaatttgaacccaggactgggtggaataaaaactctgaactatgtctatgactgttgtcacaagatcagagctagactggccaggagccatgactgtgggtgcagcagcagctgagccctgatcactaactctgttcatcttttgcaggagataccttcccggatgcagatgctgatgaagacagtctggcaggcgagctggatgaggccatggggtccagcgagtggctggccctgaccaagtcaccccaggccttttacagggggcgacccagctggcaaggaacccctggggttcttcggggcagccgagatgtcctggctggcctttccagcagctgctgcaagtgggggtgtagcaaaagtgaaatcagtagcctttgctagtttgagggctgggcagccgtgggcaccaggaccaatgccccagtcctgccatccactcaactagtgtctggctgggcacctgtctttcgagcctcacacattcattcattcatctacaagtcacagaggcactgtgggctcaggcacagtctcccgacaccacctatccaaccctgccctttgaccagcctatcatgaccctggcccctaaggaagctgtgcccctgcctggtcaagtggggacccccccatcctgacccctgacctctccccagccctaaccatgcgtttgcctggcctacacactccactgccacaactgggtccctactctacctaggctggccacacagagacccctgcccccttcccagtccaaactgtggccattgtcccctgaccagctaaaatcaagcctctgtctcagtccagcctttgcacgcacgcttcctttgccctgctttccatcccctctccctccaactcccctgccagagttccaaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggtgagtgctggagggagctcgtgtcccgggcgctgccgctgcgctccccgcgaaggcgccagtgctccaggataagccacgcgtatgcagagcgaacggtagaggtgcaggcgccactcggctcctcccggggcagggacccggcgacactggggaatgggcggcagcgaggtcgaaccggagccccggggcggggtgggggagctctctgggtggttaacaggatgtggcgagcacagggaaagggggggtttgcacggagcccgggcaggggtgcctagcgcctcccttcctgctgctcatttccctaagcccccccaccttgcaattgtcagaagtccaagttctggggtgtgcaggcggaagggggggattcgaccccctttcctgagaccctctgactccctctccaggcagcgccgggccactgcagtgctacggagttggacccttgggcgacttgaactgctcgtgggagcctcttggggacctgggagccccctccgagttacacctccagagccaaaagtagtgagtacagggaggtgacgtggggaaacaggctttggaggtggccgctcaggccccaggctgctttggttgaaaggttccaggagtcaagcctggccaacatggtgaaaccctgtctatactaaaaatacaaaaaaaaaaaaaaaaaaaaaattacccaggggtggtggcgcgcgcctgtagtccctgatactcaggaggctgagacaggagaatcgcttgaacccgggaggcggaggttgcagtaagcccagatctcgccactgcactccagcctgggggacagagggagactctgtctcaaaaaaaaaaaaaaaaaaaaagaaaagaaaagaaaagaaagtcccaggagtctgcccccctcccccaatactcctccactccttcaattctagcttccctcgtttctttgctgtgtcaccctgggcaagtcactttccctctttgagtctccttttcatttctctattaaatagcaatcatagggccaggagaggtggtttgcacctgtcatcccagcattttgggaggccgaggcgggaggatcgcttgagcccaggaggagttcagagttttagagagcccgtcacttttttttttttttttttttgaaacggagtttcactcttgttgcccaggctggaatgcaatggtgtggtctcggctcactgcaacctccacctcctgggttcaagcgattctcctgcctcagcctccagagtagctgggattacaggcatgtgccaccatgcctggctaatttttgtatttttagtagaggggggaggtttcaccatgttggccaggctggtcttgaactcctgacctcaggtgatccacccgcctcagcctcccaaagttctgggattacaggtgtgagccaccgtgcctggccgagagcccgtctcttaaaaatataaaatataatataaataaagggaaataggccaggcgcagtggttcacacctataatcccagcactttgagaggccgaggtgggcagattacttgaggtcaggagttcaagaccagctgtagtaattccagctactcgggaggctgaggtgggaggatcacttgaacccaggaggcagaggttgcggtgagctaagatcgtgccattgcactccagcctgggtgacagagtgagactctgtctcaaaaaaattttaaaaaataaaagctggcgtggtggctcacgcctataatctcagcactttgggaggccgaggcgggcagatcacgaggtcaggagttcgagaccagcctgaccaacatggtgaaaccctgtctccactaaaaatacaaagattagccgatgtggtggtgcatgcctgtaatcccagttactcaggaggctgaggcaggagaattgcttgaacccaggaagtggaggttgcagtgagctgagatcgcaccactgcactccagcctggccgacagagcgagactccatctcaaaaacactaaaaataaaaaataaaaaagggaaataataacagaacctgcctccgaaggttaagtctgaggattcaaagagttaggtgcttggcaaggagaaagttgcttcataatgtgaacctggtttttattgctgtgtgacattaggcaagtcacttaacctctctgagcatgttaaaagattattcagtgtggtgctggggatgctgcagtgaaagaggtagacagaaagccctgcccacagtccaaggactccatgtgtttcttcatgatgaatcatacctggaaactcataatttcaaattgggctaagtgagggaagaggaaaagagtcaatgaaagataagaatgggagacagaggtcctggatttttttttctttttaatattaatggttaaaatacacacaacaggccctacacggtggctcacgcctgtaatcccagcactttgggaggccgagacaggcagatcacctgaggtcaggagttgcagaccagcctggccaacatggtgaaactccgtctctactaaaaatacaaaaattagccaggcgtggtggcacatgcctgtagccccagctatttgggagtctgaggcaggagaatcgctggaactcgggaggcagaggttggagtgagccaagatcgcgccactgtactccagcctgggtgacagagcaagactctgtctaaaaaaaaaaaaaggccgggcgcggtggctcaagcctgtaatcctagcactttgggaggccgaggcggtggatcatgaggtcaggagatcgagaccatcctggctaacacggtgaaaccccgtctctactaaaaatacaaaaaaattagctgggcgtggtggctggcgcctgtagtcccagctactcaggaggctgaggcaggagagtggcgtgaacccaggaggcagagcttgcaatgagccgagatcgcgccactgcactccagcctgggcaacagagcgagactccgtctcaaaaaaaaaaaaaattcatacaacataaaacttaacgatatttttaaaaatttgttttgggaacagggtcttactcctgttgcccaggctggagtgcagtggggcagtcagttcactgcagcgacttctcaggctcaggtgatcctcccacctcagcctcccaagtagctgggactacaggcatgcaacaccatgcccagctaattttttaaatatatatttttagtagacacagggttttaccatgttgcccagactgctttcgaactactggcctcaagagatccacctcctttgtcctcccaaagtgctgggactacaggcgtgagtcactgtgcctggccaaaatctacgatcttaaccatttttaagtgtccagttcagtggcattaagtacattcccatggtgctatcccggttaccattcacctccagaagggggcctagtttttttttatttgagatggagtttcgctcttgttgcccaggctggagtgcaatggcgcgatctcggctcactgcaacctccgcctcccgggttccagcaattctcctgcctcagcctccagagtagttgggattacaggcacacgccaccacgcatggctaattttgtatttttagtagagatggggtttctccatgttggtctggctggtctcgaactcccgacctcaggtgatccacccacctgggcctcccaaagtgctgggattacaggcagaagccactgagcctggcggggggcctagttttaattggtacagggagggggagtcagagaagccacatcttttctatttttattttagttttattgatttatgtattgattttatttattttgagaagaggtcttgctctgtcacccaggctagagtgcagcggtgcgatcatagctcactgcaacctcaaactcctgggctccagccattttccctcctcggccttcccagtagttggaattacaggaatgtgtcaccatgaccagctaatttttaaaaattttttgtagtggtagctcacgtctgtaatcccagcactttgggaggccgaggcagaaggatggcttgagcccaggggttggagaccagcctgggcaacgtagtgagacccgtctctattaaaaaaaaaaaaaagaaagaagaagaagaagaagaagaggaagaggagggaaaaaagtaagaataattttaaaagtaaataaataaataatttttttggtagagacagagtcttgctctgttgcctagggtagtctcaaactcctgagctcaagcgatcctcccatcttgccctcccaaaataatggaattacaggtgctactatgcccagcctgagattttgtactctttggccatcatcttctccccctagcctctgtagtcaccagtttactctgcctctaggaggagttcagatgttttagattccacgtatcaatgaaaacatgtggtgtttgtctttccgtgtcttatttcacgtaacataatgttcgccatttccatccacattgttacaaatgacaggatttcctttttttttttttttttgagacagaatctggctctgtcacccaggctggagtgcagtggcgcgatctcagctcactgcaacctctgcctccccggtccaagcgattctcgtgcctcagcctcccgagtagctgagattataggtgcgcatctccacatctggctaatttttgtatttttagtagagccgagtttcaccatgtcagccaggctgatctcaaactcttgatctcaagtaatccacccacctcggcctcccaaagtgctgggattacaggcgtgagccaccacgcacagtgtattttcttcttttttaaggttgaatagtattccatcgtgtatgtataccacatttttttttttttgagacaaagtctcgctctgtcgctcaggctggagtgcaatggcgtgatctcagctcactgcaacctctgcctccagggttcaagcgattctcctgctttagcctcctgagtagctgggatgacaggcatgcgccatcacacctggctaatttttgtatttttaatagagacggggtttcgccatgtttgtcaggctggtctcgaactcctgacccgaactctgcctgccttggcctcccaaagtgctgggattacaggcatgagccaccgtgcccggccccacatattcttgatccatacatctggtgatggacacattccatatattggctgttgtgaatagtgctgcattgggaagacacgtccgttggacaaactgatttcatttccttatttatatatttatttttactttttttttttttgagacagagtctcactctgttgcccaggctggagggcaatggagcaatctcagctcaatgcaacctccatctttcgggttcaagtgattctcctgcctcccaagtagctgggactacaagcgtctgccaggacacacggctaatttttgtatttttagtagagatggggtttcacgatgttgtccaggctggtctccaactcctggcttcaagtgatccgcctgcctcggcctcccaaagtgctgggattacaggcgtgagccaccacgcctggccccttcttactatttgttaaacacaccaggcacagtttggcctccaggtctttgcaccctgtgtttcctcttcctggaatgctgttcttctagctactgcatggttctgtcctcatctccttcaggcctttattcaaatgtctcctcaggctgggcgtgatgtccctgcacctgtaatcccaacactgggaggccaagggggatggtgcgggggattgcttgaggccaggagttcgagaccagtctggccaacagagtgagaccctctcgctctctctctctttttttttttttttgaaatggagtcttgctctgttgccaggctggagtgcagtggtgcgatctcggctcactgcaacctccaactccctggttcaagcgattctcctgcctcagccttccgagtagctgggattacaggcacgtgccaccacgtccagctaatttttgtatttttagtagagacgggggtttcaccgtgttggccaggatggtctcgatctcttgacttcgtgatccacctgcctcgggctcccaaagtgctaggattacaggcgtgagccactgcacctggcctgtctctctctttctatatatggtgcttttgttgctgtttttgagacagggtcttatcctgtcacccaggctggagtgcagtggcatgactgcaactcaacctcctgggctcaatcgatcctcccaccccagcctctcaagtagttggaaccacaagtgcgcgccactacccctggctaatttttaaaacattttttgtagacatgggggtctcagtatgtgactgcttgaggccaagagttagaggagaccagcctgggcaacatagcaagaccccatttctacaaaaaatttaaaaattagctgaacattgtgatgcacacctgttatcccagctactctggaggctgaggcaggaggattgcttgagcctaggagttcaaggttgcagtgatctatgatcgcactgctccagttacagagtgaggtcgtgtctctaaaaaaaaaaaaaaaaaaaaagagagagaggaaagggccgggcgcagtggctcacgcctgtaattccagtactttgggaggccgagacaggcggatcacctgaggtcgggagttcgagaccagcctgaccaacatggagaaaccctgtctctactaaaagtacaaaactagccgggagtggtggcgcatgcctgtaattccagccactagggaggctgaggcaggagaatcgcttgaacctgggaggcagaggttgcggtgagccaagatcgcaccattgcactccaagctgggcaacaagaacaaaaatctgtctcaaaagaaaaaaaaaagagagagagaaagcaaggaaggaagggagggagggaggaaagaagggagagggagaggaagggaaggaaagaaagaaaaagagagagagaaaagagcagttatgaccaggtatggtggctcatgcctgtaatcttagcaatttgggaggccgaggtgtgtgcatcacttgaggtcaggagttcgagaccagcctagccaacatggtgaaaccccatcgctactaaaaacacaaaaaaattggccaggtgtggtggcacacgcctataattctagctacttgggaggatgaggtgggaggatcacttgaacccaggaggcagaggttgcagtaagccaagatcacgacattatactccaacctaggtgactgtcttaaaaaaaaaaaagaaaaagagcagttacttttattaccctcattttgtagatgaggaaactgatgcacagagaagttaagtcacttactcaaggtcacacagctctgaagcagcagaggtgggatttgaacccaagcagagcaggctgcagccactctgttggcacaagggtggttatcagtggccctggctctagccgagtgtgcatctcatccccgcctctctcctcacagccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaagtaacgtggcaggagggtgggcgctctatgcggggtgggtgctcttggagggcgtggctcactacaccctagtttccccttccccagtgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctggtgagtgctggggtccttttctccccaccctattccgggcggggactgaggcaacatctcctaatctgagacccagcccaggactcattctgtgcctgcccctgagcctgtatgcctcccactcaaaatgcctgcatgtgcctcttgttcagctacaaattctcctcccatggctgggcacggtggttcacgcctgtaatcccagcactttgggaggctgagggggatggatcacttgaggtcaagagttcgagaccagcctggccaacatggtgaaatcccatctccactaaaaatacaaaaattacctaggcatggtggtgggcgcctgtaatcccagctactgaaagctgaagcaggggaatcactggaacccgagaggcagaggttgcagtgagctgagattgggccactgtgctccagcctgagctacagagtgagactcagtctcaaaaaaaaaaaattttttttctcctgccaaaataatctatcacccggtcacagtggctcatttctaaaatcccagcaccttgggaggctgaggcaggaagattgtttgaggtcaagagtttgagaccagcctgggcaggatagcaagactcgtctctaagaagttaaaaaataatctgaccaggtgcggtggctcacacctgtaatcccagcactgtgggaggccaaggagagtggatcacctgaggtcaggagttcgggaccagcctggccaacatggtgaaaccccatctctactaaaaatacaaaaaagtagctgggcgtgctggtgggtgcctgtagtcccagctaattgagaggctaaggcaggagagaatcacttgaacccaggaggtggaggttgcagtgagctgagatcgtgccactgcactccacactccagcctggcaacagagcaagactccgtctcaaaaaaaaaaagaagaagaagagttcagaattgtgattattcatgcaattcagagcaacactgagatgcagaatttttttttttttttttgagatggcgttttgctcttaattgcccaggctggagtgcaatggcatgatctcggctcactgtaacctccaccatctaggttcaagcgattctcctgcctcagcctcccgagtagctgggattacaggcatgtgccatcatgcccggctcattttgtattttcagtagagacggggtttctccatgttggtcaggctggtcttgaactcctgacctcaggtgatccacccacctgggcctcccaaagtgctgggattacaggcatgagccactgcacccggcccccttttttttttgagacggagtctcactgtgttgcccaggctggagtgcagtggtgccatctcaactcactgcaacctccacctctcaggttcaagtgattcccccacctcagcccctcaagtaggtgggattacaggcatgtgccaccatgcccagctaagtttttgtattttttttaatagagatggggtttcgctatttggccaggctggtctcgaactcctgacctcaggtgatccacccacctccacctcctaaagtgttgggattacaggcgtgagccacctcacccggctgagatgcagactttggaatctgactacctcagtgctcagctccagcacaccagctctgtgaccttgggctagtcactttccctctctgggcctcagttccctcgtctgtaaaacgagataataatagaagttaccacttcctgctatacctagcacatagagtgaccaccttttctctgtctgctcgggactgtggcaatttttttgacaggcccatgttctggaaacccccttggtcctgggcaaatacaaatggttgctcactctgctgatagataagttcaagtaccagctaggcgcagtagctctaatcccagcactttgggaggccgaggtgggcagatcacctaaggtcaggagttcaagaccagcctggccaagatggtgaaaccccgtctctactaaaaatacaaaaattggctgggcttggtggctcacacctgtaatcccagcactgtgggaggccgaggcgggcggatcacgaggtcaggagatcgagaccatcttggccaacatggtgaaactctgtctctactaaaatacaaaaaattagctgggcatggtggcgcgtgcctgtaatcccagctacttgggaggctgaggcaggggaatcgcttgaacccaggaggcagaggttgaagtgagctgagatcgtgccactgcactccagcctggcgacagagcaagactctgcctcaaaaaaaaaaaaaaaaaaattaaccaggtgtggtggtgggtgcctgtaatcccagctactcaggaggctgaggcaggagaattgcttgaacccaggagggagaggttgcagtgagccaagatcacaccactgcactctagcctgggccacaacgagactgtctcaaaacgaaaaacaaaggaaaaaaaaaaagataagttcaaatacccttgactcaggccctgggcccatcacgctcgcctgtctctcccccagctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctggtgaggatatctgggcttgccctcaatccacgcccctcccacccccagaagtctgtccaatcatgtcccactcatttgttccccgtttcctcatccttgccagctccaaaagatgtgtgggtatcagggaacctctgtgggacgcctggaggagaggaacctttgcttctatggaaggtgagcttcag

SEQ ID NO: 810 - DNA, 155597 bp, Homo sapiens
caggagacttgtagatactgtgggtccttttcaagaaacactgggttcaaaaatgccgtggtgaagttcctgagggtggtgccgagtcctaggaggagtgtggacatgtcaatgtctagtgtgtgtgtttgtgagtgggtgggaatactatggtggcacctgtgggaaaagggcgtctgtcatgggagtttctctccgctaagttttcagtccacagttgccctcggagaagacctggaatcacaggacaatgggcagtgtgacagcctgtgtacaggagagcagagcctcccattcccagacacccagagttttattccaggccaggcctccatgatatctttttttctggcaccaaatctgtagcatttgctgaacatcaaacaattctccaacaccaacttacggtctaacatttgaattctgacaccacccacagtcagtacagaccctgattcagggctcggtcccacaacattgtcctcaatgcagatgccagtcataaaccccatgggcccatgtatgtgtctgagctactgtttaaaaacgggagacggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaataaaaataaaaaaaaataaaaataaaaacgggagactcccataacgtccctgaagttcaataatttcatagagctactcacagaactcagcaggaaactgtagttacctttaccggtttaatatataagatgaaggccaggaaaagtcaaatggaaaaaatgcacagaacaaataaaagagatggaaaaagatgaaacacataatcctaaaaaatatttgtgattaataaaatcatcctaggtcgggcgcggtggctcacgcttgtaatcccagcactttggggggccgaggcgggcggatcacaaggtcaggagattgagaccatcctggctaacacggtgaaaccctgtctctactaaaaatacaaaaaattagcggggcatggtggcaagcgcctgtagtcccagctactcaagaggctgaggcaggagaatggcttgaacccaggaggcggagcttgcagtgagccgagatggtgccactgcactccagcctgggcgacagagcgagactctgtctcaaaaaaataaataaataaataaataaataatttaaaatgtctccatcctttgtgtgctccaggaacagtttatggaaggaaacacccttcccattatgacttaagtggtgctctcttttctttcctaaaacacaggctgacacacacactgcacattttctccttttttttttttgagatggagtctctctctgtcgctgaggctggagtgcagtggcgcgatctcggttttctgcaagcgctgcctcccaggttcacgccgttctcctgcctcagcctccggagtagctgggactacaggcgcccaacaccacacccagctaacttttttttttttttgtatttttagtgaagacggggtttcaccctgttagccaggatggtctcgatctcctgacctcgtgatccgcccgcctcggcctcccaaagtgcggggattacaggcgtgagccaccgcgccgagcctggaattcatttttttttttaaacataaatctaatgtttttattttacaaagtttagaaattgcctcaaaacaataaaaacttcatcatcagtaagacctccccagtttcctttcatcttaaccttaactgcatctgcctgtgggatcccagctttccagggctctgtagcttctctcaggataaaggcttcttctatggctggggtgagcaggctgagacagctgcatgggtggctcctcagaaagaactaactgggcctttaataacttcctcttgcatgcttaatattagccctagcttggagttactaggttcaagctttaatttccatgtcagagttattcacttggttttcaaaactaagtgtttgaaaaatccagtgaaattactcacagcgtttacataagaaaaggaaattttaaggtgcttacttttttttttttttttttgagatggaatctcgctctgtcacccacactggaatgcaatggctggatctcagctcactgcaacctccacctcctgggtaaaagctattcttctgcctcaccctcccaagtaggtgggactacaggcatgctccaccacacccagctaatttttgtatttttagtagagacagggtttcaccatgttgggcaggcgggtctcaaactcctgacctcaaggaatcaacccgcattggcctcccaatgtgctggaattacaggcgtgagctactgcacctggctaaggtgcttgcattttatgcctccataagaaaaacaaatatatctacttctttcagacaatatatgtattattttattatttatattaaaaaataatgtagtaaaaaattagtcatatgggaatgcttctaaaagttaccacgtttcatcacatgcaatttagcactaaactcagaaatcaagacaacaggatatagaatggagatattcactgtcacaaatttaccctgcaaaaagaggaactgatgttttgatgaatctgtgtaactcattcaccacattttcctatgaaaatatattcattgtctagagccaaaatggaagagagattttccctattttttcccttggtagctagcattataaagctaaggcttagaattctgtctgaaatcactaagacataaaaaccacacccaagaaaattcctaaactcactcttggaaagaaaaatgtaaatgagttattaacaaatggaatatatgattaaatattaattttttgaaactcatcttttattttctttgtaaatattttcttacctttcaagccctactaataaaatgcaaattacagataaaaaactgattcaggtgggtgctgtggctcactttaatgccagcactttgggaggccaaggcaggcagatcaattaagattaaaagtttgagtggggcacggtggctcatgcctgtaatcctagcactttgggaggcctaggtgggcggatcacctgaggttgggagttcgaggccagcctgaccaacatggagaaaccccatatctactgaaaatataaaaattagctgggcatggtggcacatgcccaaggctgaggcaggagaatctgggaggctgaacctgggaggcagaggttgtggtgagccaagatcacgtcatcgcactccagcctgggcaacaagagcaaaaatccatctcaaaaaaaaaaaaaaaatgactaaaagtttgggaccagcctggtccatctctactaaaaatacaaaaactagccaaatacagtggtgcacacgtgtagtcctagctactccggaggctgaggcatgagaatcacttgaacccagaaggtagaggttgcagtgtgccaagatcaagtcactgcattccaacctgtgcaacagagtcagactgtcttaaaaaaaaaaaaaaaaaggcagaatcaacaacaacaacaaaaacacctgaggtcaaaataagtgaacaaatctttcaaggtagatatccaatcactcaccccatcctgttcacatgctcaataaccaccctcccaggagacacagcgcagacacagcgtgactgccccagctgcattttactatgtaagtttttaccccatctcactggggtcattttcttttgtcttttgaaggtttttttcacaaactttttactatttttctttcactccccccaagagcatccagggggcagaaattatttgttttcccctcaataccagcatctgattggctcaccaacaatgtgtctccaagaaatggaagttaggttgggtcaagacaatcttcatgtctcaaggggctagcttttcaaaaaaaaaaaaaaaagtatatcaggagatgcctttcagccccaaggctgccacctgctcccttgagaggctacactctatacttcaggtggtcctaagggagaaagtgacccaagagctaatatccattagacattttagcagacatagccatagtgggtatcttggtttatctccagaaagtactaaaacccaggcccagaataaaactgaaggttagcagaggtcacatcaccctataatgtttccagagggtaatgttaacctaaaaacattctggtaagttctctggaaaaataaaagaaaaaaaggtacagatattttttacaatacagtgtcaggggattattctttgctttcttctcatgggaaatatttaaaaatagaaaacaaatcttttcaatagtgctatgcaatgctttaaacaatgattgaggaacgtggggtacaggaggccctgctggggacacatgtgaaaaatgccagagaaaatcagccccttgtgggttgtgaaaataattaagcggcaggcaattagactgagaaggctctagtcctcagattcctacttgtaaaaaaatgtaaactcaagttgatttgttaataaattactacatttggggaaacaaatttcaggcttaaacaactataaactgccaaataagctctgattacataaccaggaaatttccaccttgattatacaaattaagaagctacgtaagtacacctaaccaattgttgaatttggttttcttcatcactgattttacaaatgtctttccttcaagcccctcccatggaccacagactacaaactataactgggtgctctacaattcttgaatcactctttgattaaattacttgattttttgcagtgactcccataattttttttttttttgtaaaggacatatcatatttattcatacacatgctggaattattggtgcagacatttaaatacattttctttgagaaagtccttttttttttttttttggatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaattttttttatttttagtagagacggggtttctccgtgttggtcaggctggtcttgaactcctgatctcaggtgatctgcccgccttggcctgccacagtgctgggattacagtcgtgagccaccacagctggcctgggaaactccattctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaattaaaagtctcccatgtctacttctttctacacagacacggcaaccatccgatttctcaatcttttccccacctttcccgcctttctattccacaaagccgccattgtcatcctggcccgttctcaatgagctgttgggtacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgaccccccaacctccctcccggacggggcggctggccgggcggggggctgacccccccacctccctcccggacgggcggctggccgggcagaggcgcccctcacctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgatccccccacctccctcccggacagggcggctggccgggcggggggctgacccccccacctccctcccggacggggcggctggccgggcagaggggctcctcacttcccagtaggggcggctgggcagaggcgcccctcacctcccagacgggacggctggccgggcggagggctgacccccccacctccctcccggacggggcggctggccaggcggggggctgacccccctacctccctaccggacggggcggctggccgggtgggggggctgacccccccacctccctcccggatggcacggctggccaggcggggggctgacccccccacctccctcccggatggcacggctggccgggcgtgggggctgaccccccacctccctcccggatggggcggctggccgggcggggggctgacccccccccccccacctccttcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcgtagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcagctgctccttgccctcgggccccgcggggcccgtccgctcctccagccgctgcctcccgggcggcgctcgccggcgccgactcccataatttactttttctagacagagtctttctctgtcgcccaggctggagggaagtggcatgacctcagctcactgaaacctactccttccgggttcaagcgattctcacctctgcctttggagtagctgggactacagacattcaccatcacacccagccaatttatgtatttttagtagagatggggtttccccattttggccaggcttatcttgaactcctgacctcaagtgatccacccgcctcggcctcccaaagtgctgggattacagacgtgagccaccgcgccaggccccataaattttttcttttccttctttcttttttttttgagacagagtctcgctctgttgccaggctggaatgcagtagcacgatcttgtcttactgcaacttccgcctcccaggttcaagcgaattctcctgcctcagcctcctaggtagctgggactacaggcccccgccgctatgtttggctaatttttgtgttttagtagagacagggtttcaccatgttggccaggatggtctcgatctcttgactttgtgatccacccgcctcggcctcccaaagtgctaggattacaggcatgagccaccacacctggccacccgtccccataaatttttaataagagaaaacagaaactgtgaaccccacagaccaaagctcttcccattcatgaacccacaccccgagtcagggttcccccccaaagatcctcctggagtccccgcacaatctaggagagacgtggcactgtgggtgcagggctgccctgagaaggtttcaggccagggcacagtcaccgcgcagggaagagacaggacacccctggaccgcctgtcagcgcagctgccatcttagggctgaaggggactgaggccgagctgggcaaggagaacttgtggcacagattgtggagctgactgaggagaggcctgagtcctgccactgccacttgtcaccggttccaaccatcccctcccgctcactcaggatgtcggaccggcactctcactgtttctaggcttccaggaggtcctggtgtcttagctgtggatctcccaatacctgcaggtcacagggctatagaggttgcgcctctaggagcagaggacacagactagtgaagaggagacccagagctcaggctgcagccagagacaaaggctgcagccaaacactgaagacgtcctgttcactccagctgcgtgcctgattgggcagttttcaggccagcgtttcttttttcttttttttttttattgatcattcttgggtgtttctcgcaaagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcataggtcaacaggatcccaaggcagaagaatttttcttagtacagaacaaaatgaagtctcccatgtctacctctttctacacagacacagcaaccatccgatttctcaatcttttccccacctttcccccttttctattccacaaaactgccattgtcatcatggcccgttctcaatgagctgttgggtacacctcccagacggggtggtggccgggcagaggggctcctcacttcccagtaggggcggccgggcagaggcaccccccacctcccggacggggcggctggctgggcggggggctgacccccccacctccctcccggacggggcgtcagcccagcgtttctgattggataatgcttaaggcccccgccccctcaggccctgagtaacagaaaatgtgatcaggactgagtgaagaaaaagtcacagcctaagctgcagcgtttttcaggcagggcttcctccctgagctgagccaggcccaacccagatcatgggaaaattctatctttttttttactctctctctttttgaatatattcaaaaggtgaacagaagtattttgctgtcatattaataatacataaaatttttttcaagagaaaatcagcttttactttggtaatagtgtattatcaatactaaagctaattttaataaaccttataaataaatcaaatttgtcatttttgaccactccggttttacatgtatattttgtaatctcttgtaatttttaaaaactgtttacattttatttttatccaaattctttttattttttcaatttgaaaccacctttaagtaatttcaaattgttataggagatagaaagaagtcatttagggccaggttcactggcaagtgcctgtaatcgcaacactttgggaggccaaggtgggtggatcacttgaggtcaggagttcaagaccagcctggccaacatggtgaaaccccatttctactaaaagtacaaataactagctgggtgtggtgctgcacacctgtagacccagctagtccggaggctgaggcaggagaattgcttaaacccagaaggcggaggttgtgtaactgcccaaggggttcaccttgccctatgtctagacagagctgattcatcaagactgggtaatttgtggaggaaaagttaaatactaaatttgaacttaattgaacgtggacaaactcagtagtcaccaagttctcaaacaggttgtgtgaggcccttgaggcattcattcagcgctgtttcagagaaatctctatttcaatctatttctatatattagttgttgaaaaacaatagacaatcgcaaaaacaagttgacagttttgtgttccttgaccccagttgcaaatggccctcatgactgggccttatgccaaacaactcgttacaaaagagctagggtatcagattgtgctgaagcttcattagaccctcctcatctgtgcaggaatgagtagctgactctggagcccaagctgttgcttcccagtctggtggtgaatcctccatagtctggtgagtgtaaatatatatatctcttttcctttctcctcttcccattgcaatttgcttattatatcaacatgcttattatatcaatctggttattacattgatttgcttattatataatttgctaattatatctgcatttccatttacgtggcacaaagcttatttacccttaaaggtattgtgtgtgtgtcttttcttctccccttgaatgtttcccacacagaatatttttggcgtcacgaacaggattcaaaaaccaaactgtgccactttttggccacaaggacagggctggaaactcgaggaaatcccaaatccagggatgggaactccccaatatcactgtcaattcctacaggattgaacgaaggggacgaatgcagaaatgaagacaaagacaaaagatttgttttaaaagaaggggtcaggcagggcgcagtggctcaggcctgtaatcccagcactttgagaggccgaggtgggtggatcgcgaggtcaggagagcgaaaccatcttggctaacacggtgaaaccccgtctctactaaaaatacaaaaaaatttagccaggtgtggtggcagacacctgtagtcccagctacctgggggggtgggggggtggggctgaggcaggagaatggcatgaacccaggaggcagagcttgcagtaagccaagatcgtgccactgcactccagcctgggtgacagagcgagattcggtctcagaaaaaaaaaaaaaaagaaggtatcaggggctccttgcttctagtgagcagaaggcagccctgtttctacaggccttagtatttattaggtagaatcaatagggagggagaggtaatggttggtcagctgcttgatttatcacaggtacatataattgctttctttgtacaacaggcttcagatattcctatagataaccacaaggaacactgcgcctggggcataactgccctcagcacccgttctggcagcagatgcagtttgtcagttttccaacatcctgctttcatgagaagagttttcccatatagcctctgtcaggcctctgagcccaagccaaatgaaatttggtgccatgactcggctcgggggacctcccttgggagatcaatcccctgtcctcctgttctttgctccgtgagaatgacccacctgtgacctcaggtcctcagaccgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacacgttttatccatggacccaactccggcaccggtcatggactgggaaggcagccttcccttggtgtttaatcattgcagggacacctctctgattatacactcacgtttcaagggtgtcagaccacacagggacacctgccttggtccttcacccttagcggcaagtcccgattttctgaggaagggacaagtacccctcaaccccttctctccttgtctctaccccttctctgcttttctggggcaggggcaagaacccctcaaccctttctccttcacccttagcggcaagtcccgctttcctggggcaggggcaagtacccctcaaccccttctccttcacccttagtggcaagtcctgctttcctagggggcaagaaccccccaatcgcttatttccataccctaacctcttatctctgtgccccaatcccttatttctgcaccctgacctcttatctctgtgccccaatcccttatttctgtgccccaacaccttctctgcttttctggagggcaagaaccctccaccccttctccgtgtctctactcttttctctgggcttgcctccttcactatgggtaagcttccaccttccattcctccttcttctcccttagcctgtgttctcaaaaacttaaaatctcttcaactcacacctgacctaaaacctaaatgccttttcttctgcaatgccacttgaccccaatacaaactcgacagtagttccaaatagccagaaaatggcactttgaattttttcatcctgcaaaatctaaataattcttgtcgtaaaataggcaaatggtctgaggtgcctgatgtccaggcattcttttacacatcaatcccttcctagtctctgtgcccagtgcaactcgtcccaaatcttccttctttctctcccacctatcccctcagtaccaaccccaagcatcactgattctttctaatcttccttttctacagacccatctgacctctctcttcctccccaggctgctcctcaccaggccgagctaggtcccaattcttcctcagcctccgctcctccaccctataatctttttatcacctcccctgtaggggtgggttgcccctccacacctgtgggtgtttctcataaggtggaacaagagacttaggaaagaaaaagacacaaagtatagagaaagaaataaggggacccggggaaccagcgttcagcatatggaggatccccccagcctctgagttcccttagtatttattcatcattcgtgggtgtttctccaagagggggatgtgtcagggtcacaagacaattgtggggagagggtcagccgacaaacacgtgaacaaaggtctttgcatcatagacaaggtaaaggattaagtgctgtgcttttagatatgcatacacataaacatctcaatgctttacaaagcagtattgctgcccgcatgtcccacctccagccctaaggtggtttttccctatctcagtagatggaacatacaatcgggttttataccgagacattccattgcccagggacgggcaggagacagatgccttcctcttgtctcaactgcaagaggcatgccttcctcttatactaatcctcctcagcacagaccctttacgggtgtcggggtgtcgggcggggggacagtcaggtctttcccttcccatgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtttgacacagcacatgtttcagagagcacggggttgggggtaaggtcacagaatctcaaggcagaagaatttttcttagtacataacaaaatggagtctcccatgtctatttctttctacacagacacagtgacaatctgatctctcttgcttttccccacatcccctcctcacacctggtccggcttacagtttcgttctgtcccccacctgcccagcaatttactcttaaaaaggtggctggagccaaaggcatagtcaaggttaatgctcctttttctttatcccaaatcggatagcgtttaggctctttttcatcaaatataaaaacccagcccagttcatgacttgtttggcagcaaccctgagacactttacagccctagaccctaaaaagtcaaaaggccgtcttattctcaaaatattttattacccaatctgctcccgacattaaataaaactccaaaaattaaattccggccctcaaaccccacaacaggatttaattaacctcgccttgaaggtgtacaataatagaaaaaaattgcaattccttgcctccactgtgagacaaaccccagccacatctccagcacacaagaacttccaaacacctgaaccacagtggccaggcgttcctccagaacctcctcccacaggagcttgctacacgtgccggaaatctggccactgggccaaggaatgcccgctgcccaggattcctcctaagctgcgtcccatctgtgtgggaccccactgaaaatcggactgttcgactcacctggcagccactcccagagcccctggaactctggcccaaggctctctgactgactccttcccagatcttctcagcttagcggctgaagactgacactgcccgaacgcctcggaagccccctagaccatcacggatgctgagcttccggtaactttcacagtggaaggtaaacccatccccttcttaatcaatacagaggctacccactccacattaccttcttttcaagggcctgtttcccttgcctccataactgttgcgggtattgatggccaggcttctaaacctcttaaaactccccaactctggtgccaacttagacaatactcttttaagtactcctttttagttatccccacctgcccagttcccttattaggctgagacactttaactaaattatctgcttccctgcctattcctggactacaactatatctcattgctgcccttcttcccaatccaaagcctcctttgcatcctcctcttgtatccccccaccttaactcacaaatataagatacctctactccctccttggtgaccgatcatgtaccccttaccatctcattaaaacctaatcacccttaccccactcaatgacaatatcccatcccgcagcaggctttaaaaagattaaagcctgttatcactcgcctgctacagcatggccttttaaagcctataaactcttcttacaattcccccattttacctgtcctaaaaccagataagacttacaatttagttcaggatctgcgccttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcatttctcataaaaacccacatgctctccctgccaatcgtgtccaactgatctctcaaacccaagcaccttctacaaaacaacaactactttccttcctaggtatggttagcatggtcagaattcttacacaagagccaggaccacaacttgtagcctttctgtccaaacaacttgaccttactgttttagcctagccctcatgtctgcgtgcagcagctgctgctgctttaatacttttagaggccctcaaaatcacaaactgtgctcaactctctctctacagttctcataacttccaaaatctattttcttcctcatacctgatgtatatactttctgcttcccggctccttcagctttactcactctttgttgcatctcccacaattaccattgttcctggcccagacttcaatccagcctcccacattattcctggtaccacacctgacccccatgactgtatctctctgatccacctgacattcacatttccccaaacttccttctttcctgttcctcaccctgatcacacttgatttattgatggcggttacaccaggcctaatcgccacacaccagcaaaggcaggtgatgctatagtacaagccactagcttgcctcttagaacctctcatttccttcccattgtggaaatctatcctcaaggaaataacttctcagtgttccatctgctattctactactcctcagggattattcaggccccctcccttccctacacatcaagctcgaggatttgccccacccaggactggcaaattagctttactcaacatgacctgagtcaggtaactaaaacacctcttagtctaggtagacactttcactggataggtacaggcctttcctacagggtctgagaaggccaccacagtcatttcttccattctgttagatataattcctcagtttagccttcccgcctctatacagtctgataacagatgagcctttattagtcaaatcagccaagcagtttttcaggctcttagtattcagtgaaacctttatatcccttatggtcctccatcttcaagaaaagtagaatggactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccaacttagactgtgcccccgaaaaacttgtcatccctactatcttctgtctagtcatactcctattcacctttctcaactactcatacatgccctgctcttgtttacactgccagtttacactgtttttccaagccatcacagctgatatctcctggtgctatccccaaactgccactcttaactcttgaagtaaataaataatctttgctggcaggactatgctgaatctccttaggcattctctaatcagatatcctgagtcatcccaattcttagaccttttatacctgtttttctccttctgttattccatttagtttctcaattcatccaaaaccatatccaggccatcaccaatcattctatacgacaaatgtttcttctaacaaccccacaatatcaccccttaccacaagacctcccttcagcttaatctctcccactctaggttcccacgccgccccaatcccgcttgaagcagccctgagaaacatcgcccattctctctccatatcaccccccaaaaattttcaccgccccaacacttcaacaccattttgttttatttttcttattaatataagaaggcaggaatgtcaggcctctgagcccaagccaagccatcgcatcccctgtgacttgcatgtatatgcccagatggcctgaagtaactgaaaaatcacaaaagaagtgaatatgccctgccccaccttaactgatgacattccaccacaaaagaagtgtaaatggcctgtccttgctttaagtgatgacattaccttgtgaaagtcattttcctggctcatcctggctcaaaaagcacccccactgagcaccttgcgacccccactcttgcccgccagagaacaaaccccctttgactggaattttcctttatctacccaaatcctataaaacggccccacccttatctcccttcactgactctcttttcagactcagcccacctgcacccaggtgaaataaacagccatgttgctcacacaaagcctgtttggtggtctcttcacacggatgtgcatgaaagcctccagtggtatactgagttggtcaggacccccattttctctgcgtccaacatccccagttctcctctttggtgattgagtggttcagggaaactggcctttgtaagaactgagaatctaaattaatgcaatttaaacctttgactgtgtatgtgagaggagagaaagaccctctcacattgttttatattgttttatattcagtaaaaacaacaaggaagtaaaaccaaagacaggcagcctggcgccaggcctgaaaccaggcctgggcccacctggcctaaacccagtagttaaaaatcaacttatgatttagaagctgatgttattcatagattccttacattgtatagaagaacacggtgaaactccctgccctgttctgttcctccctgaccaccggtgcatgcagcccctgtcatgtaccccttgcttgctcacatcaatcacgaccctttcatgtgaaatctttagtgttgtgagcccttaaaagggcagaaattgtgcactcagggagctcagattttgagacagtagctggccgatgctcccagctgaataaagcccttccttctacaactcggtgtctgagagattttgtctgcggctcatcctgctacatgtgaagtgcagcaggggattccagtcagcaaaggagatgctgaaggatctccccgagtgaatggtgtttgcttactctttataagttaatgtatcaggataggggatagttgctacaagagaaataagagctggaaaagaaaaatgccaatccaactgccagactgaccctggcccaatgccaggcctatgtcttaactgttcagactcaaagatatcagcctattgatgaaaaaagtggctgtcccaatggccccatcagggtaaaattgaagaactagtcagtcaggtcttggagcaggtaaaaacacagctcctatctcaaggatgggaaattaaccttagtaaaattcaaggacaaattgtaaaattccttggcatcctgcacaaactataaaattccttggcatcctatgaaatgcagggaaatagtccattttaccaaagactaaggctaaaatactaaaaattgcaacccttaccactaaaaaggaggactagaaatttattggcttgtttggattcgggagacattatattcaccacttgggtaacattttacaacctctgcatgcagtcactagaaaatgctgtgactttcactggggagagaaagagagcatggcttttgaacaagctaaacaagcagtgcaactggccctggacctatggcccatatgagatgggccagtagaactgcaaataactgtcctaaatcaacatgctaattggagccttaggcagaaacaagatgggaagagggtacactttgggttttgaacccagaaattgccagaggccagcaaagcttatacccctttcaagaagcaattgttaccttgctattgggctttgctggaaatggaacacctctgcttcaaccgtgatgtctttataaggtctgaaattcctattatgacttgagtcatgagttcccccaaaactcaccaaatagggcatgcccaagaaagtaacatcataaaatggaaatacaacatagaagaccaggctaagccaaaaccaaagggggtatcatttttacatgaggatgtacaaaacttgccagctcaggaaaccactgaggaagtgctgcacatagggaaggaaaccgcccctccccccactcaatggtgcagttcctttaaagaactaagcccagaggatcagaaacatgcttggtttactgatcgatccagcaaacatattggtgggacccaatgctggaagggcatggcttataatcctgttaaaaacgtaagcatttctgatgaaggaaggggtgggagcagccagttagctgaactagtagccaacctccaagatattcaggaggaagccagagggatttgtcacttgtataccaactcttggtcagtagcaaatggtcttactacctggatgctccaatagtgacaaaacaaatggttaattgggaataaagaggtttggggaaaaaaatactgagaagatatctgaatcctggtgcacactaccattgttgctgttttccatgttgatgctcatccatctctgctttctcttgacagactatttaatcaccaggaagatcaacaggccaaaatttttattataactgcaaacttgaatgcggatgaattgatttcctgttcaagccttgcaatgactggcattataatgtgtggtggtataattgatagtgattagtggcctaaatattccacttaaaagatacagaatggtagaatggagaagagtttaccaaccaaatatctgcggtctttaagagactcacccaacacataaaaactcacataaagttaaggtaaagggttgggaaaagatagtcatgcaaatgtaccccaaaagcaagcagtagtagccattcttacatcagacaaaacagacattaaagcaaaaacagttaaaaataaaaaaagacaaagagggacattatataatgataaaaggactagtccaacaggaaaatatcacaattctaaatatatatgcacctaacactggagctcccagtttattaaacaattactactagacctaagaaatgagataaatggcaacacaataataatggggaacttcaatactctactgacagcactagacaagtcatcatgacagaaagtcaacaacaacaacaacaacaaaaacaatggacttaaactataccgtagaacaaatggacttgacaaatatttacagaacattccacacaacaactgcagaatatacatttcattcatcagcatatgaatcattccctaagacagacatatgatgggccacaaaacaagtctcgataaatttaagacaatcaaaattatatcaactactctgtcagactacagtggaataaaagtgaaaactccaagtgaaccctcaaaaccatgcaaatccatggaaattaaataaatacatggaaattaaataaaaataaaatttaggatcaacttgtttctgaatgattgttgtatgaaatcaagatggaaatttaaaaattctttgagctgaacgataataatgacaatctattaaaatgtctgggatacagcaaaagtcgtgctaaaaggaaagttcatagcatcaagtgcctactaaaaagtctgaaagctcataagtagacaatctaagataacacctcaaggaactagagaaacaagaacaagccaaacccaaacccagtagaaaaaaagaaataacaaagatcagagcagaaccctagggggaggggtggctgcagtctctgtggaccagcagacttagcctttcctcctgctagttttgaagaatttgagcagcccagatgagtggattttcccccagtgaaacacccccctccaccaaaggacagtcaaagtgcttcattaaatgagttctgcttcctgtgccacccaactggatgagacccttcaacagggattgtcagacaccctatagaggagcaattctactggcatcaggtttgtgcctcttgaggtcagagatcccagaggaaggagcgggcactcttctttgctgttctccaacttccttgagtgacatctccaggcacggcggtgaaccagatgaataggtcctgaagttagcccctagcaaactgcagcagcgctacagaagatggacctgaccattgaaagaaaaacaaacagaaagcaacaatgcatcaacaagaaaaaaatgtacccacaaaaacctcatccaaagccacacatggtggctcacacctgtaacccaatactttgggaggccgaggcagtgggcagagcacttgaggtcacgagttcgagactagcctggccaacatggtgaaaccttgtctctactaaaaaatacaaaaaaaaatagccaggcgtggtggtgcatgcctgtagtcccagctactaggtagtctgagacatgagaatcacttgaacctgggaggcagaatttgcagtgagctgcgattgtgccactgcactccagcctgagtgacagagagagagactgttaaaaaaaaaaaatccaagtgtcagaagcctcaaagatcgaaactagacaaactcatgaagatgagaaagaatcaacaaaaaacagctgaaaggccagagtgcctcttctcttccaaatgatcaaaatgtctcttcagcaaggtgcagaactggacagaagatgagatgcatgaattgatagaagtaggcttcagaagatggttaataacaaactctgctgagctaaagaaacatgttcaaacccaatttgaagaagctaagaacctcgataaaaggttagaggaactgttaactagaataaccagtttggagaggaacataagaggatgagatgcatgaattcacagaagtaggcttcagaagacggttaataacaaactctgctgagctaaagaaacatgtttgaacccaatttgaagaagctaagaaccttgataaaaggttagaggaactgctaactagaataaccagtttggagaggaacataagaggatgagatgcatgaattcacagaagtaggcctcagaagatggttaataacaaactctgctgagctaaagaaacatgttcgaacccaatttgaagaagctaagaaccttgataaaaggttagaggaactgctaactagaataaacagtttggagaggaacataaatgacctgatggagctgaaatgtttggcatgaggcccagtcactagggccctttgcgactgggctcaaggaacacaaaaacgttatcttgtttttcaataactaacatataggaatagattgaaacagagatttctctgaaatgacactacatgaatgcctcaatgaatgcctcaagggggtcacacaaccggttctgagacttggtgaccattgtttgtgtctgtgttcaatttatttcaaaattaatatttaacttttcctccacaaattcccctgtcttgatgaatgggctctgtctaggcaaaaggcctgtctttatgaatcagctctgtctagacaaaaggcaaggtaaaacccttgggctgttacacaacctccgcctcctgggttcaagcgattctcttgcctcagcctccggagtagctgggactacaagtgcacaccagcacacccagataattttttgtatttttagtagaaatggggtttcaccatgttggccaggctggtcttgaactcctgactcaagttatccgcccaccttggcctcccaaagtgctggaattagaggcgtgagccactgcgcctggttctaaatgatttctatttcctgtaacaatttgaaattacttaaaggttgtttcaaattgaaaaaaagaatgtagataaaatataaaaagttaaaaaaattacaagtgattatgaaatatatgtgtaaatctcgagaggtcaaaagtgacaaatctgatttatatataaggttttattaaaattagctttagtattgataatacactattaccaaagtaaaagttgattttctaacaaaaattttatgtattattaatatgacagcaaaatacttctgttcaccttttgaatacatgcaaaaagagagagagtaaaaaagagatagaattttcccttgctctagggtgggcctggctcagctcagggaggaagccctgcctgaaaaggctgcagcttaggctgttactctttcatcactcagcccagcatctgatcacatcctctgtcactcagggactgagtgggcggggccttaagcattatccaatcagagacgctgggctggaaaccgtccaatcaggcaggcagctggagcaaagaggacggcttccgggtttggcgcggcctttgtctctcgctgcatctggagctctaggtcgcctcttcgctactctgtgtcctctgctcctagaggcccaccctctgtggccctgtgtcctgtaggtattgggagatccacagccaagatgccgggaccccttagaagcctagaaatggtgagagtgcccattggacatcctgagagaggggagggactggttgatgggaagtggctgtggagggactcaggcctccccgtagtcagctccacaatctgcgtccggacttctccttacccagctcggcctcagtccccttcagccataagatggtggctgcgctgacagccggtcccggggcgtcctgtctcttccctgcgcagtgaccgtgccctggcctggcgccctctctgtgcagcagctctccacccgcagcttcgggtctctcccagatggtgcgggaaccacgagaaggtcatcaggggagaatcttgactcggggtgcgggttcacgattcggaagagctttggtccgtggggttcacagtttctcttttcttttgttaaaaatttatggggccgggcgcggtggttgacgtctgtaatcccagcattttgggaggcgaaggctggcggatcacttgaggtaaagggttgctaggacaactaaattcctcttcaaagactcaacttcctgatcagaagttgtaaaagttgtaaaacaaccctacccctttttctcccttttccttttctcgcaaatcgctcgtttatcctatttggaaaaagtttgggtctaagccaaccgggatcagcttagattgtgcggtctgaccccagccaataggggaaggacacaaaaacaaaaactacgttggggttaaaaacccattcctggtcgggcgcggtggctcacgcctgtaatcccagcattttgagagacctaggcgggaggatcttgtggtcaggagttctagaccatcctggccaacaccgtgaaccccgtctctactaaaaatacaaaaattagccaggtgtggtggcaggcacctgtaatcccagctacttgggaggctgaggcacgagaattggttgaacccaggaggcggaggttgcagtgagctgagaccgcgccatcgtacttaagtgtgcgtgacagagcaagactccttcacacacacaaaagaagggccaggcgcagtggctcacgcctgtaatcccagcactttgggaggccaaggcaggcggatcacctgagttcgggagttcgagaccggcctgactaacatggagaaaccctgtctctattaaaaatacaaaattagctgggcttggtggcgcatgcctgtaatcccagctactcgggaggctgaggcaggagagttgcttgaacccgggaggaggaggttgcggtgagccgagatcgtgccattgcactccagcctgggcaacaacagcgaaactccgtctcaaaaaaaaaaaaaagtaagaatcttaaaattttcttcctttatgtaaacactgtttgagtaatttcactggatttttcaaacacttagtttcaaaaaccaagtgaataacactgacatggaaattaaagcttgaacctagtaattccaagctaaggctaatatgaagtctgcaaaaggagggggttaaaaaaaattttttttttttgagacagtcttgctttgtggcccaggctggagtgcagtggcgcgatctcggctcactgcaacctccgcctccggggttcaagcagttctcctgcctcagcctcccaagtagctgggactacaggcactcgccaccacgcccggctaatttttgtatttttagcagagacggggtttcaccatattggccaggctggtgtcgaactcctgaccttgtgatccgcctacctcagcctcccgaagtggtggggttactacattttttttattttgacatggagtttagctcttattacccagtctggagtgcaatggtatgatctcggctcaccgcatcctctacctcctgggttcaagggattttcctacctcagcctctggagttactgggattgcaggcacgcgccgtcacgcccggctaattatgtgtgtttactaggggtttctccatgttggtcaggctggtctctaactcccaacctcaggtgatccatccgccttggcctcccaaagtgctgggattacatgcttgcgccaccgcgcccggccaacaggaggttattaaaggcctagttagttttttctggggagcctcgcctgcagatgtcccagcctgctcaccccacccatggaaggagcctttatcctgagagaagctacggagccctggaaagctggagccccacaggtagttaagattaaggtgaaaggaaactgggagggtcttactgataataaagctattgttttgaggcactttttagactttttaagataaaaacgtcagatttatgtaaaaaaatgaattagtattggaacaggagaaagtaccaactaattataaggtctctgtggcttgcaaaaatgtaggcagaaaagggcttttttcctagggaggagcaaacgagattagaaaaaagcggggaggggaatgacaaatggagggtgaaaaagtcagattttagctcagagaatgtcttaccctgaaatcaccgtgttcttagaagggacataagatggggttgtatgttttttttttttttttttttttgagacagtctcactccgtcgcccaggctggagtgcagtggcgcgatctcggctcactgcaagctccgcctcccgggttcacgccattctcctgcctcagcctcccgagtagctgggactacaggcgcccgccaccacgcccggctaatttttttgtatttttagtagagacgggtttcaccgtgttagccaggatggtctcgatctcctgacctctgaccttgtgatccgcccgcctcggcctcccgaagtgctgggattacaggcgtgagccaccgcgcccggccaaaatggggtgtatgttgactcagactgagggtagctcaaaattcaggagcctgagggagggagataaataaagtttgattaagaaatattttattttaggccaggcgcgatggctcacgcttgtaatcctagcaccttgggaggctgaggcaggccgaacacctgaggtcacagcctggccaacacggtgaaaacatggtgtctactaaaaatacaaaaattagccaagcgtcttggcaggtacatgtaatgccagctacttgggaggctgaggcaggagaattgcttgaacctgggaggtgaaggttgcagtgagcagtgagtcaagatggtgccactgcactccagcctgggcagcagagtgagacttcatcacaagaaaaaaaaaagaaatttgaccactgaagacatattcagctgatttttctaatgagaaaaaggagaaaatgtgcagtgtatgtctggctgtgtgacaggtaagaaaagagagcaccatctaagtcataatgggaagggtgtttctgtccatcagctttttctggagtacacaacaaatggagaattttattaatcacaaatgttttccatgattatctatgtgtttcatctttcctcatgtcttttctttgttgtatgcatttcttccttttggcttttcctgggctgcatcttatatattaaaccggtaaacataactacagtgttttgttcagttctgtgaatagctctaccaaattattgaacttcaggaaggtttcaggagtcccgagttttcaaacattagttcaaaagaatagatgggcccatagggtttgtgactggcatctgcagtgaggacaatgttgtgggaccgagggtctatgctgactttaggtgctgtcagaattcaaatattaggcaataagtttgtgttggagaaatgtttgatgttcagcaaactctacagatatggtgccagtaaaaagatatcacagaggcctggcctggaacaaaactctgggtgtttgggattgggaggctccactctcctgtacacaggctgtcacactgcccattgtcctgtgattccaggtcttctcccagggtgacagaggactgaaaacttagagaaaaggagctctgattacagacccccttttattgcagctatcaccacggtgttcccacccactcacaaacacacacactagacattaacgtgtccacactcctcccaggactaggcatcaccctcagaaacttcaccacggcatttttgatcctagtgtttcttgtgtttcttgtcaagaacccacaagtctctacaagtctactggcatgtctccaccccagacactgaatctgcagcagcaacctgttttctccaccatcctaggatctgggccacatgtttataatttcatctgcctacatgcacacagaaataaatcagagtacagccccacctgggccactatctgtagtgaaaatcattccattcacctacattgcactctctcccacccaggaattattttttttcttttagcttttatttttggttcgatgtacacatgtgggtttgttatacagttaaaattatgtcatggggatttgttgtgcagattattttgtcactgaggtactacccatagcaccaaacaggtgtgttttctgatcctcttagtcctcacaccctccaccctcaactaggcctcagtgtctgttgttctcctctttgtgttcatgtgttcttattatttagctcttaataacatgcatttggttttctgtttctacgttagtttccttttttttttttcctttcattttgttttgtcttttgagctggacttttgctcttgttgtccaggctggagtgcaatggtgcaacctcggctcaccacaacctcaacttcctggttcaagtgattctcctgcctcagcctcccaagtagctgggattacaagcatgcaccaccatgtctagctaattttgtacttttagtagagacaggatttctccacgtgggtcaggctgatcataaagttccaacctcaggtgattacccggcctcagcctcccaaagtgttgggattacaggtgtgagccactgcacctagcttttgcctactttttttttttgagagagagttttgctcttgttgcccagactggattgcaatagcgtaatcttgaccaactgcaaccttcaccttcgagtgattctcctgcctcagcctcctgagtagctgggattacaggcacctgcaccactcccagctaattttttgtacttttagtagaaagggggtttcaccatgttggccaggctggttttgaactcctgtcctcaagtgttctgcctgccttggctttccaaagtgctgggattacatgcatgagccaccatgcccggcctgcctactttttaatgaggttgtttgtttttttcttgtaaacttgtttaagttctttttttttttttgtgagatggagtcgcttagactggagtgcagtggcactatctcggctcactgcaacctctgcctcctgggttggagtgattctcctgcctcagccttctgagtagctgggattacagacatgtgccaccaccacaccctgctaatttttgtatttttagtagagacgaggtttcaccctgttggtcaggctggtcttgaactcctgacctcgtgatacacccgccttggcctcccaaagtgctgggattacagtcatgagtcaccacgcccagccaagttcttaataaattctggatattaggcctttgtcagaggcaaagtttgtaaatatttttgtttattttgtagattgtttactctgttgatagtttcctttgctgtaaagaagctctgaagttcaaataggtctcatttgtcaatttttgcttttgttgcagttgctttgggtagcttcctcatgaagtctttgccagtttctgtgtctagaatggtatttcctaggttatcttgcagggtttctcataattttgttttacatttaagtctttaatttatcttgagttgatttttgcatatggtgtaacgaaggggtccagctttagtcttctaaaaaatgctggctagttattctagcaccatttattaaagagagaatccttcccacatttctcttgtcagctttgtcaaaaatctgatgattataggagggtgacattatttctgggctctctattctatttcattggtcttgtgcactcatggattttatataacatctttctctcttctggttttaaccccactaacgttctttcaagcgcatacagtatgcaaaactcaggtgtccaagagttcaaaactccttaaaaacttccaaaaaaaggccaggtgtggtggctcatgcctgtaatcccagcacttttggaggctgaggtgggtggatcacgaggtcaggagatagagatcatcctggctaacatagtgatacccatctctactaaaaatacaaaaaaaaattagtcaggcgtggtggcgggcgcctgtagtcccagctacttgggaggctgaggcaggagaatggcgtgaacatgggaggtggggcttgcagtgagctgagatagtgccactgcactccagcctgggggacagagcgagactccgtctcaaaaaaaaaaaaacttccaaaaaaatttttgccattgtctcatttcttaagggatttagattatatatagttatttttctctgatttttaaaaatatatgtaaattatattaacagctaaataccttttgtcttttttctgactccagattatctagaacttcagatttattgctttgtttttggttccaaaaagtttattttttaatttttagtcctttaaatagacacagatttatttagataaaagctaattttaagggcacacagaagcttagcacaaagataggatcaaatttagcaatacataatggtaaacattaaaagatactatgtttctttgacagaaaccagattatccaaggaaattatccaatatttgcaggctgaagtacttatactgcaaaaagaagaacagttcagtgcgtaaactgaacagtggagtctgtagttgtgcctggctttctatttattacttcagaataattagcatagttatgtgtaatgtttgtagacaagctgcatttatatacatttaacagtattttgtttttctttctttctttcttcttttttttttttgagagagtctctgttgcccaagctgcagtgcagtggcatgatctcatctcactgcaactgctgcctcccgggttcaagcgattctcctgcctcagccttccgagtagctgggattacaggcatgcatcactgttcctggctaagtttttgtatttatagtagagatggttgtcaccatgttcgccagtttgatcttgaacttttcacctcaggtgatccacccatttcagcttcccatagtgctaagattacaggtgtgagccataaacagtattttctaaaatagtatgaatataaagccacaatacttactttgaatgaatcacttaaatggttattttaatattgtaatttatacttttgaaatatagtgttttggctgaagtatagttttaattattaaaaatgctacatatattatgactagtgagtaaacacaattttagtgtcttttatttcattaaattggtatgctgctattacaggacaaataaagacatgtgatgtggccacccaaaaaccataatagctcttcagtttgctatgttgcaagttctaatatattccactatatgaacatagtcagattctatttcttcatcaaaaagtgttgttggaagttgtcagatgtatttcaatatagaacctccattcaatggctaggagatgacagaacagcagagatgggaaagaaactttataaaaattcttctgaaaatctgccacctttcttcataatgctcatgtttctcttgctgagagtagctgtgcgctttgggtgtttagagagaaattgcttttaggagaatattttctggcagacatgatcaattttatatctaatctgagctttttcctaatatcattttaacttttttctctccagtgctttgggtgtctgtttcagaagccctattaatttttttttttttttttttattgatcattcttgggtgtttctcgcagagggggatttggcagggtcataggacaacagtggagggaaggtcagcagataaacaagtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaacactgagtggacacagcacatgtttcagagagcacagggttgggggtaaggtcagagatcaacaggatcccaaggcagaagaatttttcttagtacagaccaaaatgaaaagtctcccatgtctacttctttctacacagacacggcaaccatccgatttctcagtcttttccgcacctttcccccctttctattccacaaaacagccattgtcatcatggcccgttctcaatgagctgttgggtacacctcccagatggggtggtggccgggcagaggggctcctcacttcccagtaggggcggctgggcagaggcgcccctcacctcccggatggggcggctggccgggcaggggactgaccccacctccctcccggacggggcggctggcctggcgggggctgacccccacctccctcccggacggggtggctgccgggcggagatgctactcacttcccagatggggcggctgccaggcagagggtctcctcacctctcagatggggcggccaggcagagacgctcctcacctcccagacggggtcgcggctgggcagaggcgctcctcatatcccagacggggcagcggggcagaggcgctccccacatctcatacgatgggcggccgggcagagacgctccttgcttcctagatgggatggtggctgggaagaggtgctcgtcacttcctagatgggatggcggccgggcagagaccctcctcactttcagactgggcagccaggcagaggggcccctcacatcccagacgatgggcggccaggcagagacgctcctcacttcccagacggggtggcggccgggcagaggctgcaatctcggtactttgggaggccaaggcaggcggctgggaggtggaggttgtagccagctgagatcacgccactgcactccagcctgggcaacattgagcactgagtgaacgagactccgtctgcaatcccggcacctcaggaggccgaggctggcggatcactcgcggttaggagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttcggctcggcatcagagggagactgtggggagagggagagggacagggagagggagagtcgaagccctattaattaatcccatgatttctgattaagctaggctgtcacagtgagaacttttggagctatctctatctggactcatgctggaaattcagcagtattttttccttgtcaccattataagtagaaactgaggttgaaacactgctctcattttcattattgtgaatgtgtaattctacccaggaggcctgcaggctctcctcctgcagctcaggcctcactctctgatgtgacactagagtgctgctgtggcaaatggggttcatataaaatgtgagctgtgctctgggctgtgcctcagtggcagatggtagaggtcaagagagcatactagcaaccaggagaaagcaagcaggagtgctgtagcccactgccagtgagtacagagccactcctctaaactgtaactagccaaaatatagaacactattcaaccatttttgtagcagagtgaaatcttagcttcagcaggtacctgacttcaagctgctaaaataactcctgttatgaagatgtgaaaagtttatttgtcattgaatataagcaattagcatacacagatggcctcttcaatttccaggtagatttaagatgaacgatgtatgacatggtgctttaaattcttctacttatggactaattatgttgaccatctttctgtcattgcagtctcttaagcagatggactatgatgcatgtcacattcaagtttaattgtaaaataaaaacgtttgttttttgagatggagtttcactcttattgcccaggctggagtgcaatggtgcgatctcagctcactaaccccgcctcccaggttcaagtgattctcctgccttagcctccctagtagctgggattgcaggcatgtgccaccatgcctggttaatttttgtattttttagtagagagggggtttgtcagtgttggccaggctggtctcaaactcttgacctcaggtgatccacccgcctcggcctcccaaagtgctgggattacaggcacgagccaccacacccagccaaaacgttttctttctgttctattattgtggagtttttctggggctgtaaacatttgttctttttttttgagacgaagtctctcatcccccaggctggagtgtgatggcgcaaacttggctcgctgcaacctctgcctcctgggttcaagagattctcctgcctcggccctttgagtagctgggattacaggtgcctgccaccaggcccggctaattttttttttgtatttttagtagagatgggttttaccatgttggccaggctggtctagaactcttgacctcaggtgatccacccgcctaggcctcccaaagtcctgggattatagacatgagccaccatgtccagcgaagaaaattgttcttctcttttttttctttttgagacaaagtctcactctgtcacccaggctggagtgtgctgtggtgccttctcggctcactgcaagctccacctcctgggttcatgccattctcctgcctcagcctcctgaatagctgggactacaggctcccaccaccacacctggctaattttttgtatttttagtagagatggggtttcactgtgttagttagatggtctcgatctcctgacctcatgatctgcctgtctcggcctcccaaagtgctgggattacaggtgtgagccaccgcgcctggccaaagaaaattgttcttctaattattgtttccaaacactgtctagaattaccagacatgatataaacacataaggtgccaaccagaatttagcaaggcctttccctgtcaggcttccagtcaattcacacttgtgcagcaaagtgcatgctgtcccctaaatatgcaggcagaattgtgtctctatttgttatctatagtcctgtacattcacttctagagaggctagatcagatttctacaaatttcatagggcagcaatcaatcattttatctctttcaatgactcctgtatcttcagacttgaaacagattcagagaccatggggcccacaaacccagttagagtaacatgtgtgcattgagtagacatgttgacaagagaatctccactttcaccttcctcctcttgctaaaatgctcacaaatgtgcaggtaacacctgctgctcctcctgccattcaggccctaaatctacagctctatattttgaatccagatcttgagatttgggaaataaaaaacttttgtctaaataaagcaggttcttttggttatcaaactcagagacatgttaaaatgaaagtgcagttatgtctttctcccactttgaacgatgtattcatctattgaaactgttcactattggcacaagtgactataaattaaactaatgatgccacattggacactatcccatgccctaaaacataatgatagatatctaatcaataatcaatgttatttatgtaaataaataaaaacttttgacaaacaactctgcatcagcccactttctgtccctgtcttgtcttgacatatcttcctgtaaatactactaatcaaagtgtagattccaggcaacttgaatctttgctcccaggttataacccttaagcttgacccaaataaactgtctacttatattcatgttatgtcaccttttttttaaatgtagacttattatttagaatgtgttagagcagcctctatgagagctctcttttgactgtactccacttggtgtaacacaaaaggatgcagagccaagttgatcctacctagaatttgcagataaggtctgccctctgcctgggatttaaaaaaaaaagccagactttggatagagaatgtacagaaaattaacaaaagtcattttctgcattgtaagttgtcaagatagatatcttacaggccccatttgggagtgtggcattttgagatttttcacatcttgttcattggcctgctacagtgatgtgagaggctccaggaggaaatagaatctgatggcagaatctgtaagtgtaaataatcatcttaggagtgagagatcaaggccacaaagtatccagagccttgatcacaactataattacctgtaaaatgtgatactggagtagagtatttttgtttctttctctcatccaagagctagcaaatcaggacagatgatgtaggttctggagctccaccaaggcagttgttttctattcagaatcagcctgagtttctccagatggcttatcattgggccaacagccctggttcaccaggaattccctcacaatcacctaggtgtctttgaggcatttgaggatgtccagagcagaattgtgttaggctgacaagagtggttaattctgcttctgtctcagtgtaagagaaatgagtcatcctgtgttcattcatgccctcatacaagaggtgccttttttggtacccagatcagagtttctccagtttcctggtacttggatgataaacaaggaggagatctggagacccaaatagataaactagttgcttccatttcatatggccattaaaaaaatacgtgaagcagtcatggttcctacagtccagaaacttttagtctagaccagcaactggataaataattgaattgtgcattgtatggttggcacaatatatagatgtgtccagaaccttgggttttatttaggccactttatgccgttatgacttctgaattgtacacctgaagggatatttatgaatagaataattgttattataattttttttctttagtcagaatctcactgtgttacccaggcatgagtgcagtgacatgatcttggctcaccgcaatttctgccacttgggttcaagcgattctcctgcctcagcctccaaagtagctgggattgctggccccagccactgtggtcaggctggtcttgaactcctgacctcgtgatccacccaccttggcctcacaaagtgttgggattacaggtgtaaggcagtgcacccagctgtataatttctacttttttttaccttctaaagtgtacatattgattttctaataaaattaccctagaaaaccttaagggatttgtttaaattgtgtattagtatatagtataaagttgacagggcagtggctagaaaaattaaaattataggaactctgggatttaagtttcttttaggtaagcttagaagaaacaaaactggaagtaccccagtggcatagagaacagaattctacataagtcctcacactgcctgagacctgatcagattcatgctttttggaggcgttatttaggtctgaccctaccctggagtcttgcctcacaggactgattagtagagatcagagttttggctggtgaatcctgctgcctttctagagctggtgctcacaattccctgaatcccaaaagcagatgaaagggaaaaatagtccgggcgcggtggctcacgcctgtaatcccagcactttgggaggccaaggcgggcagatcatgaggtcaggaaatcgagaccatcctggctaacacggtgaaaccccacctctactaagaatacaaaaaattagctgggtgtggtggtgggcgcctgtagtcccagctactgaggaggctgaggcaggagaatggcgtgaacccaggaggcggagcttgcagtgagcccagatcgcgccactgcactccagcctgggtggcagcgagactccatctcaaaaaacaaaaaaaaaaaaagggaaaaataaagtacgtattttagggtcttagtttttaaattttctgttaaagccagtgtttgcagagacattctatttagcaacttgttttctattcttgcagatccagtagttgctccacaagtcacagaaaagtaaatatgaacagaataaaattttctctaaattacattaaattattcctttctatctctttcatctgtctatattttgcttttacagtgttttaaaaaaattcatgacagagaaacagaagaagaaataaaaatgccgcaccctttacctaaatcctaaagtttattaaacacttagtaccagctttcagggtgttatgagaattaaatcacagaatgtgctatgcccagcacagtgctctgtatcattctcttgagcacaaagtacctgcttaataaacattgcattagtacttgtgtacatgttgttttttaaatacagacttactctgtcatttctgccttcagtttcctctataaactttaaagagccagcgaagcatataaaactttagggtggagatgcgttgtccctatttgtatcagaagtatttggttgtgaaaagagtgctaaatgtaagggaccctgtgctgttcctgctttctctaactaatgctaataatgagccaaggggaagcaacttcagcattgacaggggacttgtttaaaacacccattcatggacccttttcaagcctccagaatcacattacataaagtggacccaaaattaccaagtgatttataagcccattaaagcttgagaggcaatgcttagcttagtgattaccagcccaggcttttccttaggaacacatggccaatttgcagaaacctcttgtgccctccccacagcttctgtttgttctgcatggaagcacttatgttgttttaatgaagggtctcatgtgactctaaggtgaggccagaatcaagtatgagcacttcaaaatacaatacaaaggagttaagttccacctttgcactaaagggtggtcacagggcctgttctgtttgggtttggtacagacaggtcagtgtggtgcataattccattactggaaattgctggtgtctgtggcagggagggcacctgaggacaggaaatgagaaacttatatttctatcttcatggagcaattcattgttccctgaatctcttctgtttcaaaggacagaaataggtgggctttttctgtcattttgccagttgatgtcatgccagcaggtaatcatgtgttactgatacctttaaaggcatgttctcaagatgcaggtgtaatttttccagagaatctcatctgagaaggaattccagaggaggaggaggagaaaaaaaagtggctcttcttaaggtaaacgtgtctcagatgaagagctgtgtccactctgcctcctggacccccatgagtttagtactcacaaacctttacttctctacttgtgttttccctccctgagtttggttttactacttaaaattcttatgatagtcaagggtctctgaaaaatatttctttcctatatcccagagctttctctgcattctctatgtcatagcttcttatatgccatgcagaattctcagcaagaatttgtaatctgcaatattaaaaatgttccctttgtggctgttgaacatggaaagatgtggatactcaagatttctgttggggaaaattgtggtccttagtatagatgaagaacatgtaatgttgaggcttcatctgtatgttccattagctctatgcagaacaggattaagaaaatgcttttttatatggaatggcatttattatccagaaagttctgaaagaaattattaggagatacctgctctcttgggtgctaaatgaagcctacttaaaattactactaaaaattacagaacataggagttatcaaaaactttgaagttagcataaaacatgtttctttatggttaaattcagattttatttactttctttgggaggaatatttcaacagtgatgctgtgttcttctgtgtgaattaggacatcataaaaatttatcgtagtgcagttaatggttaatgattcagttggtgaaatagctctctgacagatttttttcactatagagataattatttttctattcattattatgtttatgcagctgatatgcataaacctcacattaaatctggcagctttcttttttaaacatatttttcttagggaaatgaagcctcttatctttgtttacaggctagaaaatctgaaaaaaacacaggctcttgcacttactgcatttgacaaaatatcatttttgggacaaaaacattaacattattggtgagcttgttagaaattcaaaaaatcagactttatgccagatcttttggaaaaaaaaatcctgcataagaaggacttcagcttattgtacatgttaaaattggagagatgacttctaactcaacatgtcttttctgtctgaaaaatattcataactgattctgtatgatgtaaatatagcactcaaaaatgtacatgttcatgttcatgccctttattttatactttattatctagaaaaatatcattatatgaactaatgttgtggatcttaggctgctcttttttttcagagatagagaatacattagaaaatatttctgtattgaaaattattttattggataattttagtcaatcctataagtaagaatcagttctcttactctctcatttcaccttaaattaaaaattccaccaacggcgacttggtgaaaatgtgtgtgtgtgtgtgtttttcaggaatcattgcaatttagagatgtggctgtagaattctctctggaggagtggcattgcctggacactgcacagcagaatttatatagggatgtgatgttagagaactacagacacctggtcttccttggtgaggataacttaaatacataattcataaaaaaccccaaaagttttatttctcttttttgcagaatgattttagtaatttatcctttgcataaaagagttccagatgtcctttttccagaaaatcttcagaatttgtttatttagaaaagaatttcttcaagatgtttcatcttaatccaaactttccacattgctgagttgagctttattcttcactctaaattagtggtaatttcagaaatttagtggcataaaatagtgttgccctcagctgaaaatctcattgccaccatcagtttttgattcagtagtatcaggtagtaaatttaaaaagccttcatgcagggccaggcgcagtggctcatacctgtaattccagcactttgggaggctgagacgggcagatcacctgaagttgggagtttgagaccagcctgaccaacatggagaaaccccgcctatactaaaaatacaaaattagtcgtttatggtggcatagtcctgtaatcccagctactccggaggctgaggcaggagattcccttgaacacaggaggcagaggttttggtgagccgagactgagccattgcactctagcctgggcaagaagagcaaataccactctaattttgataggaagtttattgaatctatagatcactttggataatgtggcaatttaaaaatctatttggatcttctcttcgtagatttttattgtaaagattttttaccttcttagtaattttttaaagaaatttattatttaatggtatagtaaataagattttttctttctctattttatcagatagtttaagtgtttgagaccatacatatacttgtatgttaattttatgttttgctaatttgctgagtgtatttgtcagtttagaaaggttttaaggtattgtttatgttttttttttttttttttttttttgagatggagtctcgctctgttgcccaggctggagtgcaatggcatgatctcagctcactgcaacctctgcctcctgggttcaagcaattctcctgtctgagcctcctgagtagctggtactactacaggcacgtgccgctgcacccagctttttgtattttagtagaaatggggtttcaccatgttggccaggctggtctcaaactcctgaccttgtgatccacccatcttggcctcccagagtgctaggattagaggtgtgagccactgcaactggccctatttatggtttttaaagtactgcttaatgttttttaaatataagattgtatgatctataaacagcaactttttacttattttactccatctccaaaaaaaaaaaaaagaaaccttaaagttgaaagtattttctaaatatttagaaatttgttatgaattagtattttggtattaatttactagaatattttattacattctttctgctgagcacattactagcttgtaattgagaaatataagcaagattaatgctatttatttttaatgaaacaggtattattgtctctaagccagacctgatcacctgtctggagcaaggaataaaacctctgactatgaagagacatgagatgattgccaaacccccaggtaggtgcgaatgaaaatgaacacaacagacaatgcagataagaggtcccaaggtcaaaaagaaagccagtccttaaaatgtgatctgggaagctgtgttccaaaggaaatagttcctgggcagctgttttatttatttatttatttatttaatttttctctcacaaagggacatctgtctcatgcttttaaattctctaaggattctactattctttcggtgagcttccttcaagttcacagtgagagcgaaattcctctttatggcatataagtgattgcacaatctggctgcttttccgttgccttggggacacacaaatatctgcgtgattttgagaaactaaaacccttttttaagttgtctttttgcttcagatctgaaatgtgtgacagtattagtttttgttgcattttttgttcattttttctgcacagtccattctgtttttattactatatagtcttgaaatatagtttgaaattataagtatgatatccttctgctttgatctttttcctcaagattgctttggctatcaaagttattttagtatcacgtaacttttagaaatgtattttccattactatgaaaaaaataccactgcaattttgataggaggtttattgaatctatagatcactctggttaatacggcaattttaaaatttatttggatcttctctaatattttcataggtttttttttttttttttgagaaggagtcttgctctgttgcccaggctggagtgcagtggtgtgatcttggttcactgcaaactctgcctcctgggttcaagcaattctctgcctcagcctcctgtgtagctgagattacaggtgcatacaaccatgcctggctaattttttttgtattttttgtagagaggggtttcaccatgttggccaggctggtcttgaactcctgaccttgtgatccacccacctcagcctcccaaagtgctgggattacaggcatgagccaccccgcccggcccatagtttttttattgtaaagatttttttacctccttggtttttttctaagaagtttattacttaatgctatagtaaataagatttttttcttcctctattttatcagtttgttttaagtgtatgagaccatacatacacttgtatgttaattttatattttgctaatttactgagtgtatttatcacttcagacaggttttaatgtactatttattgatttttaaatacaagattatacgatctacaaacagcgactttttacttatttttctttaatttcaatggatttttttatttctttgactaattcttctgccacatgcttccagtgctacattaaaatagaagcattgacaatgggcacaatatagttttgtattggtgcctaaatttgatggagcaaacacctcttcaagtttttttttttttttttttttgagagagtctcactctgttgcccaggctgcagtgcagtggtgcagtctcagctcactgcaacctccacctcccgggttcacgccattctcctgcctcagcctcccgagtagctgggactacaggcgcccaccaccacacccggctaattttttaaaaatttttattagagacagggtttcaccgtgttagccaggatggtctcgatctcctgacctcgtgatccatccgcctcggcctcccaaagtgctgggattacaggtgtgagccaccacgcctggccttcaagtttttataaactgattttagaaggtaaagatcttttgttgggcccttagggtgatgagatgccctctgaatttgtagtggagagggggtgtagcttggtgacaaggctgctgggtctgcactagggtccacctttagttggcttgttacaggggcttgggtagttgtacttctcattttatttttggacagactgcatatccttcagggctttgctccgtagttaaaacactagggtatgtttttgtagtcaggtctgcatatggtgggccttatatctggatattgatgagtatggcttttattgagtatcagagagcattccctcagataactgtgggtttctatataggcagaactgaccataaactatcttgtttaagtgagtagtcatggagatagtcttttttttcaccatgtgtttaatgatgaatatatatttccttttgtgagagaaatacttgtttgatttgaaggtaattttcaaaaagatttataattctggattttttttcagtttttctttaaaaaaattgttttaaaaacacataacataaaatttaccatcttaattcaagtgtacattttcagggccaggcatggttgtggctcccatctgtaatcccaggattttgggaggccaacacaggaggatccctggagcccaaaagtttgagaccagcctgggaaagatatggagacccctctttataaaaataatttaataattgccaggcatggtggtatgcagctgtggtacctgctacttgggagatggagggggagtcaaaattgtgccactacactccagcttgaatgacagagtgagaccctgtctccaaaaaacaaaaaaaagctgttcatttcaggcatgttaagtatattctcattgttatgtaaaatacttctagacactttacatcttgtaaaactaaaactcaatacccattaaataacaactgctcattttaccctctctcaccctcgacagacaaaccttccactttctgttttatgatttgactacttaagatatccataattttgttactggattaattcaagtgacataatattctcaatgttcatcttaaaatgtgacaagattattctttttaagatggaataatattccattgtatgtatatgttacatattttgatgtgtttataaatcaagagacatctgggttgcttcaaccttttggcttttgtgaatactggtgcaataaacatggattttcaaatatgtcttccaggtcctgtgttgcttttctttttttctagagatggattctcactctgtcacccaggctgaagtgcagtggtgtgatatcagctcactgaaacctctgcctcctgggttcaagcaattctgcttcagcctcccaagtagctgtgattacaggtgcccaccaacacacccagctaattttttgtatttttagtattatggggtttattatgttggccaggctggtctcaaactcctgatctcaggtaatcacccaccttggcctcccaaagtgctaggattacaggcttgagcacctgggcctggcctgtgttacgtattttgtaaatagatataataagtgaggaacatttataacatttttaaataatggctgcatctttgttttccagcaagaagcaacatgggtttcatttttattgcaacatcaacagattgggtgtttttaaaaaaatttacagtggccattctaatggatatgaggtgattttgtttgtcattgtgtttttttaatttctctacaaatcagtaattttgtgcattctttcaaatgctttttcccatttgtgtagttttttgatgaaaaatctttttgttcatttttaaatcaagttattgaactttattgattagttttaagagtttttatttattttgaacattaacttccttcacatgaaatctgcaaatgttttcatccattttctaagggatgttgccacttttgaattttcttttgatgtacagaaattttgatgtctagtgtagttaaacttttcttgtatttgttgctcatgcatttaatgtcgtatctaagaaaatggtggcaagaccaatgtaatgtccttttcctgtattttttctaatagatttgttagtttctttatgtctaagtattttgtttaaaatatatttttgtatcgttcaaggaaataacccaattttattttatcagtgttgatattcagttttcaacatcattttttgaagatattacttttctctattttgtactcatagcaactttttgaaagaccatttgatcatatatagaagggttcatttctgagctctctattctggtctttcatctgtttatctttgtgtcagtatcacattgtttatgttactgtagcctttaactgtaggttgtattgacatctgtgaagaataaaattttttgacccctgagcaagaatatgttgaatcagagtgttttatattcacatatttttgaatttgccaatttaccttttgcttttaattcctagtgtcattcagtttttgttagaaaacacacaatgtataattttagtgtttttaaattgatttgttgttgttttaagacaagatcttaccaacaccaaggctggagtgctgtggcataattttggctcactatagcctcagcctcctgggctcaagtgatcctttcacctctgttttctgaccagcttggactacagacatgtactaccatgtctgcctaattgtttgcttgtttgcagtgttaggatctcattatgttgtccaggctggtctcaaacttttggccctaatggatcctcttacctaggtctcccaaagtgttagggttataggcaagagccactgcaccccgtcagtacttttaaatttaataaaacttggtatgtgtcctaacagattataccagatgcaaataagaatattgtgtattatcttggttttgactggagagttttgcttgtgtctgtgaagcctagttggtctataatatggtttccatgttcatgttctccagacctcatgctgcaaaataaatcttcaatgttggatgtgggacctggtgggacatgtttgtgtcatggaggcaaatttctcatgaacggcatggtacatcctcttggtaaccaaaactttacactctattaattcaaatgagagctggttcattaaaagaacctggatccttcacctcacacttgctctgtttcattaacatatagtatgtccaattactctttaccttccaccatgattgtaagtttcctgaggccctcaccagaagcagatgctagcacacacttcttatagtctgtcaaactgtgagccacataaattatttttctttaaaaattatgcacttggctgggcacggtggctcatgcctgtaatccctgcactttgggaggccgaggcgggtggatcatgaggtcaggagatcgagaccatcctggctaacatggtgaaaccccgtctctaccaaaaatacaaaaagccgggcgtgctggtgggcacctgtagtctcagctacttgggaggctgaggcaggagagtggcgtgaatctgggaggcggagcttgcagtgagctgagattgctctactgcactccagcctgggcgacagcgagattccttcaaaaaaaaaaaaaaattatgcactcggctgggggcggtggctcacacctgtaatcccagcattttgggaggcccaggtgggtggatcacgaggtcaggagatcgagactctcctggctaagacggtgaaaccccgtctctattaaaaatataaaaaaattagccgggcatggtggtgggcgcctgtagtcccagctactcgggaggctgaggcaggagaatggcgtgaacctgggaggcggagcttgtagtgagctgagattgcgccactgtactccagcctgggcaaaagagcaggactctgtctcaaaaacaaagaaaaaaagaaaaagaaattatgcagtctcaagtattcctctgtatgcaaaataatatggtctataatgttgcgtaagttgtctgtttctcattttttctctgaattttctatttattattgcaaatggggtcttgatgtctacaatttttatgttgctatgtatgccttgcttcacttttgtcaatatttgctttatatattttggagccctgatgttatatacacatatacatatagatagataaataatatagttaccgattcctggtaaattaactcactttaccataatataatatcattctttgtctaatggtagtatttgacctatagcatattatgtctaatataattgtgaccacctcactcaattgtggttactatttttatgatatacacatttttttccttctgttactttcagcctatttgactcaatgctacaatgagtctcttgtaggcagcatactgtatgcttttaaagaaaccactgaggcattctatagctttttcttcatatgtatatatttatttatgtatttattttgagacagagtttcacttttgttgcccaagctggagtgcaatggcgtgagctcactgcaacctctgcctcccaagttcaagtgattcttctttgtcagcctcccaagtagctgggattacaggcacctgtcaccatgcccagctaatttttttgtattttaggtagagatgggattccaccatgatggccaggcttgtcttaaacttctgacctcaggtgatctgcccgcctctgcctcccaaagtgctgggattacaggcatcagccaccacgcctggcctcatttaactttgagatagggtctcactctgtcaaccaggctgatttgcatgattcactgatgccagaacctccaaaactcagatgatcctctcattttagcctctcaaacagctgggttacaagtatgtgtcatcatagccatctatgttttttgtattttttgtagagacagagttttgccatgttgcccaggctggtcttgaactcatgggatcaagtgatgagcctaccttggccttccaaagtcctaagattacatttgattttattaagtagtataattaatttatatttacaatgaataaacaaatgaagttgtcattagcagttagattgttactgttttatgtgtttctagtagttatatttttctcatctcctgttttactttcttaattttcattttattttgtactggcatgctttcattactttttatcttcttttgcatactttctataaatattatctttgtaatcatcttgaaaactggagattacatacatcttaaagttaaaacaatatgtttcaatctcataacttcaactgaatacaaaaactatgcctctatattttatggtttgttactgatataaaaattattttatatggtgtatctattaacatttatgcagatttacatatttcttatattttattaaaaaactttaaagtttttatgtaccatcttttttttttttttgaaactgggtctcactctattgcccatgatggagtgcagtggtgtaatcttggctcactgtaacctccaccaggcatggtggctcatgcctgtgttctcagcactttgggaggccgaggtgggtgaatcagaaggtcaggagttcgagagcagcctggccaacatggtgaaacgctgtctctactaaaaaatacaaacattatccgggcatgctggcaggtgcctataatcccagctcctcaggaggctgaagcaggagaattgcttgaacctagaaggcggacgttgcagtgagccaaggtcacaccactgtactccagcctggacaacagagcgaaactccgtctcaaaaaataaaaaaaaatatgtcttttgattggaaagatgattatatatatatttaaatcgttttctgcaatagaaaaacttactgttatttttattaattgttttatttgattcttctatctttttcactcattttctgtcttttttgtgtttttttaattttttgtattgatatgctttcagtttcttattttcttttgtgtatctatacagctattatcttagtggtaacatgggggattacataaaacctaaaagatccaacaatatatttgaatgtggtaaaaaaattaacttcagttatatactgaaattcttcatcattacatttgccttcaactttgttactgattttgctaattatattttttatgttgtatatttattaacagatgttaacaataatttctatacttttatcttttaaatttagagagtattaaaaatgttttctgtaccattatgatgttaagaaattccatttttgtgtatgtggatatcttttccagaaagttatgtattttcatagattatctgttgttttcttgcattatgttattttcagtggaagaaactccttttagcatctttgatgtgtatggtgtatgcagtgccaatatactttctcaggatttggttattttggaagcacttgttttatttggtagtacaattttgctgatggcattattgcatttgacagctttttaaaaaaattattataactttagcaatatcacagtttttttctgacgtgtaagaatgttttaaataaattcactggtgccggttgtggtggctcacgtctataatcccagcactttgggagactgagacgggcagaccacctgaggtcagaagtttgagaccagccaggctaacatggtgaaaccctgtttgtactgaaaatacaaaaaagtagccaggcatggtggcgcacgcctgtaatcccagctactcaggacgctgaggcaggagaatcccttgaacccgggagttggaggttgcagtgagccaagattgcatcattgcactccagcttgtgcaacaagattgaaactctgtctaaaaaaaaaaaattctctggttatctcatgagactatgcttataaatggaacatcatttttatcttgtagcacccaaaattctattcttatatgtgatttttgaaattttgcttatatatgtgtttgttataaatatatttgtgtgtatctaagtttgttcattcagctttttcatgtttacatcatattttcttttaataaatttttcagttttttatattttttatatccacgattttcggttttttggtattttagtatttctttttatagttgtctgggtttctatttttttcttatacagagtctttttctgtcaccgaggctggagtgcagtggcgtgttctcagccaggctgatcttgaactgctgacctcaaatgatccacccacctcagcctcctaaagtgctgggtttacaggcatcagccactgcacccaacctttttaattttatttttgagacagtgttgctctgtttcccaggccgcagtacagtggtacaatctccactcactgcaacgtttcccgcctggattcaagcaattctcctgtgtcagccttacaagtagctgggattacaggcacatgtcaccatgcccagctaatttttgtatttttagtagatacagggtttcaccatgttggccaggctggtctcaaacttctgacctcatgtattttcccaccttgatcttccagtgtgttgggattacaggaatgagccaccaacagtgggatgttcaattcatttggaattttaaaaattactttgtatactttttatggttgcttttgaaaagtttataatttttttgatggggccatgttctaatatttggtatacattatcatctttgatagagatttggaaattaacaaaaagctacctgttacaatctttataatatagctttgtcctggcgtagcatgaaatcaattgtcttggctagagattctgggaatttttcaaacatgtttttaggatgagtcttgtctaaaattttgtgtttattgtttagttaaatcagcttattcatatctcttcttaatagtcagtaatcacctgctacacccattccctgtttgcagtttctctgcttctctataatttacctttagactcagcaaactcaaactgtcattccaatgtatatcaccatttttttttagcattttatgtcatgggacacattatctggtgtctaaaaaagcccctagaagacaaataaagatgtatgtgccaatgtttcttgttttttaaaaaggaaaccaggagttggcaatttacatttttgtgtgtatgtgtgagacagagtctcattctgttacctagtctcaagtgcagtggcatgatcttggctcactacattctctgcctccacagttgaagcaattctcctgcctcagcatcccaaataggattacaggtaactgtaaccatgcctggctaatttgtttgtattttagtagagatggggttttaccgtgttggtcaggctggtctcaaactcctgacctcaggtgatcctcatgctttgccctcacaaatttctggaattacaggcatgagctatcatgccttgttggcaatttactttaaaaaaaaatttttttttgagatgaagtcttgctctgtcgcccaggccggagtgcagtggtgcaatcttggcttactgcaacctccgtctcctgggttcaagaaattctcatgcctcagcctcctgagcagttggaattacagcggcccatgaccatgactggctaactttttgtaattttagtagagatggggtttcaccatcttggccaggatggccttgaactcctgacctcaagtgattcacccatctcagcctccgaaagtgctggtattacaggaatgagccactgcaccaggttggcaatttacttttaaaggcacaatgttatactggagagcaggaagagctgttgcatataagtaacagaattttctttatcttctatgtgactgtttgcattgtgctcacctagggactttcacacacttaaaactcacttataaattttttacaaatgtattttggtcagtatgtttttgttacctttatatgtccaggaagaaattacagcttgtggcattttgctatgtcatcttgcttatgtagtttgtataattttataggttagatttgtaaagtatatttatctgagtctagcaattgaagtaatgtgtttttattgtttctttcagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcacaccttactacacataagataactcatactagagagaaaccctacaaatgtgaagaatgtggcaaagtctttaagtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaaccatcctgcaactctttcttcacataagaaaattcatactggagagaaaccgtacacgtgtgataaatgtggcaaagcctttatttcatcctcgatccttagtaaacatgagaagattcatacgggagagaaaccctacaaatgtgaagaatgtggcaaagccttcacccgctcctcacaccttactatgcataagataattcatactggagagaaaccatacaaatgtgaagaatgtggcaaagcctttacatggtctgcaggcctccataaacataggagaactcatactggagagaaaccctacaaatgtgaagaatgtggcaaagcgtatactacatcctcaaatctaactgaacataagacaactcatactggagagaaaccttacaaatgtaaagaatgtggcaaagcttttaactggtcctcagaccttaataaacataagagaattcatattggacagaaaccaagaacgtgacaaaggattattttattattattatttttttgagaggtaattctgctgttgtttcccaggctggagtgcaatggcataattttggctcaccacaacctccaccttctgggttcaagtaactctccttagtagctaggattacagggctgcaccaccacacctggctaattttgtatttttagtagagatggggtttctccatgttggtcaggctggtctcaatctcctaacctcaggtggtctgcctgctttggcctcccaaagtgttggggttacaggcatgagccactgtgcctggctgacaaagctttttaaggaagttctcaacccttattacacataattcatactggacagaaaccctacaagtgtgaagaatgtggcaagcctgtaacaagttctcaattcttttatttttatttgtttatttattttttgagatgcagtttcactcttgtgacccgggctgtagtgcaatggcatgatcttggcttactgtgacctctgcctcctgggttcaagccattctcctgcctcagcctcccaagtagctgggattacaggtgccaccaccattcccagctaatttttgtatttttagtagagatgggcttttgccatatttgccaggctggtctcaaactcctgacctcaggtgatccactcgcctcggcttcctaaagtgctgggatgacaggcatgagcctcaattcccagccataagctcttaattcttaagagacatggcgataattcatggtgaagaggaactttacaaacctgaaagatgtgacagtgcttttcccaacacctccaacttttctatgcataaaaaaaattatactacaccatagaaatgtatgaaatgtgacaaagcctttatatggttgccacactttattgtaggtaattcatacttccaaaatacctacaagtatgaagaatgtggcaaaacttttaatcagtgcttacaccgtatttcacaggaaagctattatccttgagaaaaattgtacaaatataaagaatatggaaaagccattaatgtccatcacatcttactcaacagaagaaggttcataaaagagcaattactgtgacaaaaatctttcagaaaatataagcctttaaggtgaagaagagtattgattctgaagacaagcattacaaatataaagaggtttgtagtacctttgcttgtattacagatcttattgcccgcgttttgtattagaaggaaaccctaaagcggttgccaaactttgtgcaacatcagggaatgtatattgaagaagattcctgcaaatgtaatgagtttggaaacacttcttagataaattatttgtggctgggcacagtggctcatgcctgtaatcccagcactttgggaggccaaggtgggaggatcacctgatgtcgggagtttgagatcagactgaccaaaacggagaaacccagtctctactgaaaatataaaattagccatgcatggtggcacatgcctgtaatcccagctactcaggaggcttgaaccctggaggcagaggttgtggtgagtcgagatcattgcactccagcctgggcaataagagtgaaactctgtctccaggaaaaaaaaaaatttatttgtgtataactttaaaagcagatttttggaagcattgtaattacattaaaagtatacttgttccagctgcgtgtggtggctcatgcctgtaatcccaacactttgggaggccaaggcaggtggatcacgaggtcaggagttcaagaccatcttggccaagatggtgaaaccctgtctgtactaaaaatacaaaaattagccatgcatggtggccggcgcgtataatcccagctgcttgggaggctgaggcagagaattggaattgcttgaacctgggaggtggaggttgcagtgagccgaggttgcaccattgtccagcctgggcaacagagcaagactccatctcaaaaaaaaaagtgtatttgtttccttaaaaaaatttttctgaaaagtgggtaatgacataatacagctttcaaattactttatgctgttattttattcttattgtattcacatgtgaaagcatgtgatcaatttttgctgcatcagagatattagagatagttttttattaattgggcatttatgaccttttctataaaagtaaggacattaaaatgtaagatgcatgatgaaaatataagtggagaggctctttgtagttaacctatatgaagtaatgtataaggtaggtcagagtaatacttttctacattatagtgcaagaaataattattgataaaagtatattaaactaaattcgtatattttacttattgtacttttatgtaataaaatgcagtgcatttaaaaattgttagattatgtgtgaatttaattttatgttttttaccatgttaagactattgtgcatttaatgaagcattattatgccactaacctatcccaccttactcaaaggtgtaggtaaaagatggtagcaatatactatttggtacataatggaataatgtctctagtaatcactttgccagtggctttaaacagcaaatgaatttaagaatattgttcccataggttaaatttttattctcttttcttactgaaatttattattagtatttgtgagtatatagtatatgtatatatttatgctttatatggcatattttgattcaggcctataatatgtagtaactacattagggtaaataaggtatctatcacctctagcatttatcctttgtattaaaaacagtgtaattatatacttttagttattttaaaatgtacaataaattgttattgactacagggttatttttatgatcataataaaaattatacagaaatataaataaaatacagccaggcccagtggctcatgcctgtaatcccaatactttgggaggacaaggcaggtggattgcctgaggtcaggagttcaagactggcctggccaacgtggtgaaacctcgtctactaaaaatacaaaatatagttgggcattgtggtgcatgtttggaggctgaggcaggagattcacttgtaactgggagctggaggttgcactgagctgagattgcaccacttcactccagcctgggcaacagactcaatctcaagaaaaaaagaaatagaaatcatacatatactgaaaacttattaataaatgtttgttatatggttttctttgaacatgtggtctttgcctgcaaatgtagactttcagtgttaatttacatcagttaaatatacacatattactctgaagataaaccttagatgtaagaaacttatggagtgtgtttgtgtgagcatgagattgtacatattttcagaagaaaagaacaattattggaacaaaacaaattattttaataaggtggctaataaaaaactaagctccttgagaatgctgaaagcaaatctatgctttctgctttgtcttgaatttattaatataaaattttatggcttatgtttcaaatttttttcagaatctgtctattaaagtacaggcagctttgtctccagaaacaacgctcttgagtacaacaataaaagccctcttcaaacagaaaacaaataatcatagttaacacttgttttaatgaaaattcaaccaaaattaaataattagatatatttttattgtcctatgtgtgtgtgaatgtataaaatggtgcataaaggaaaaatatgccagaaaaaaagttaatatttgtaatgaataaaactggaaattagttcattatttgcaggtgatatctttgtttatgtagataacaaaagcagcagaaaactttcacggagtctctctctgttgcccagggtggggtggagtgcagtggtgcgatctcggctcactgcaagctccgcatcccgggttcacgctgttctcctgcctcagccttccgagtagctgggactacaggcgcccgccaccacgcccagctaattttttgtatttttagtagagacggggtttcgccgtgttagccaggatggtcttgatctcctgacctcatgatccacccgccttggcctcccaaagtgctgggattacaggcgtgagccactgcacccggccaaaacctttttttttttttccaaagaattataaatagaagattctaaagagaagtttttaataaataagcatttaaaagaaactagggttacttgttatgtttaaaatatatgctgttctcacacaaaatgaaactgctgaaatccaaatttagaagcaaagaatagacttaaattgttaaacatagaaaatataaatatatactttgaagaacaggattaggcaccttgatacgtgaaagaaaatattaggaaataaactattttattcttcagatacaggctgaagaaagtagatgaaaaccctgtaattcctttttgcctgcagcaaacttaaatttataagtaattattttggtaaatatggagtgcctactaattatgtaatttacttcatgcataacatgcaaattctagcatattgtcataaataaatctaaaattacagacaaatttgaaatagaaaatagtcaaaatgtagagggcgagtgacatcagtaagatgaaagattaaaagttccctaattttatatccccttacagcaaaaaacatcggccatccctgacaaaaatgcctttattggctgggcacagtggctgatgcctttaatcccagcactttgctgagatctgctgagacgggcagatcacgaggtcaggagtttgagaccagcatggcaaacatggtgaaaccctgtctctacaaaaataccaaaaaaataggcagtcatggtggcacacgtctgtaatcctagctactcaggaggctgaggcaggagaattgtttaaacccgggaggcagaggttgcagggaggtgagatggcaccactgcactccagcctgaatgagagagtgtctcagagaaataaataaatgcctttattagaaaaccaggcattatggctcacacttgtaatgacagctacatggtacattaatgatggagaacagcttcaggccaggatttcgagaccagcctgggttatgtagcaagatgtcatctccaaaataagtgcctctatgagagatgtgagatccagggagggagttgtgaaactgttaaagcttaaggttgagaagtgttctattcagaaggcaggccctcattcaggtggaaaactatatgacccctgttctaggctacagaccaggatagggttcacccaacttggtcccactaagaattctgaacttactgtgtaatcatctgaaactcctccagccacagtctggcagaggtcttgccattccagagacctggaggaaggtgcccattcacagccatctaggcaggcctgcagaccttggcctgtacaggggtccctgaagtggttcagtgactcagtttcagttacctgagccacagttcatggccagttcggcctacatagaaagctacagagttacttgaaaaaataatctctggtactcactgaaagccatactcatctacatcctgatacaaggcccaccatatgcagaaccaacttcagaaacattccttatgtctgccctatggagcaaagtcctgaaagatttgcagtctgtccaaaaataaactgggaattacaattacccaagcccctgtaacaagccaactaaagatggaccctagtgcagtcccagcagccttgtgaccaagctgcaacccctcttcactacaaattcagagggtttctcatcatcctaagggaccaacaaaagaagatctttatcttctaaaatcagtgtatgaaaacttgaagaggtgtttgctccatcaacttcagacaccaatacaaaactatactgtgcccattgtcaacacttctattttaatctagcaccggaagtatgtggcagaagaattagtcaaaaaaattttttaatccattgaaattaaagaaaaatgagtaaaaagttgctgtttgcagattatacaattttctatttaaaaaactaagcagtatattaaagcctgtctaataaatgcactcagtaaattagcaaaatataaaagtaacatagaagtatatgtatggtttctttcacttaaaacaaactatctgataaaatacagaaagaggctgggtgcggtggctcatggctgcaataccagcattttgggaggccgaggaaggtggatcatctgatgtcaggagtttgagacaagcgtggccaaaaaggtgaaaccctgtctctactaaaaatataaaaattagctggatgttgtggtgggcaccggcaatctctgctaattggtaggctgaggcaagagaattgcttgaaaccaggaggtggaggttgcagtgagcccagattgtgccactgcattccagcctgggtgacagttggagactccatctcaaaaggaaaaaaaaaaaaaaatagaggaagaaaaaaatcttatttactataacattaaataataaatttctgagaaaaatattaaccaaggaggtaaaaagtctttacaataaaaaaacaaaattagagaagatccaaataaattttaaaatattttatgtctatggattgaaagaataaatattaaagcaccatgttatccaaagtgatctatagattgaagaaacttcttatctaaattgcagttgtattttttcacagtaatggaaaatacaattctaaaatttacatgaaattaaaataaactttgaatagccaaagcaatcatgaggaaaaggaacaaggcagaaggatatcatacttataatttcaaattatatttcaagactatatagtaatgagtggactgtgcagaaaaatgaacagaaaaattcaacagaaataactactctcacacatttcaaatctgatgcgaaaaaaaccttaaaaaatagttttagtttcttaaaatcatgcatatatttgtgagtcccaaaaacaatgaaaaagaagccagattgtgcagtctcttatatgtcatgaagaggaatttggctttcaaatttggcttatatgtcatgaagaggaatttggctttcactcaccccatcgttcctaaccttacaccattcttagcaaaattccatatgatcatcaatggtttacaatgatagatttgaaggatgccttctgggcataccccttgtctgatgatagctgagatatatttgcttttgagtggtaagacccctatttggggcagagacaacaatattgatggacagtcttgccccagggtttcacagactcccccaacctctttgttcaggtcccagaacaagtactagaaaaagtcacagtccctaaacaaatatgtctgcttcagtatgtggatgatcttcttatatctggtaaagacataaaagaggtaggtgacttctctacacacattctcaatcacttgcagtgtgaggggttgctggtctcaaaagggaaaattcagtatgtagaacctgaagctaaatacttaggctacctaattagtgcaggtaaatgaaaaacaggacctgaaagagaattgtttccctacccttgcctcaaactaaacaagaactcaggaaatttttaggactaattggatattgtcatttatggatttgactcatatgcatgaaagagtaaacttctatatgagaaacttgcccagtggaaggctgataatttcttgtggacttcccaagaaatccagcaaattgaggaattgaaagggacactcatagccaccccgttctagctctaccctccctagaaaagccatttcaccttttcattaatgtaaataatggggtagccctaggaatgctaacccaagaacatggaggctgccaacagcccgtggccttcttgtcaaaggtcttagacccactcactcataggtggccccagggtatccaatccattgcagctacagcagtattagtcaaagaaagtaggaaggtaacctttggaggaaagttaacagtaagcctgccccaccaagttagaactatattaaatcagaaagcagggaggtggatcactgactcaataattttaaaatatgaggctattttactggaaaaagatgatttaatattaattgagaatatcatacctagatttagactaatagaaaatattagtctactactactgataattcacttaatccagcaagatttttaacagaggatccaaacttaaaacgagagcatgtatgtttagatctgattgactaccatacaaaagttcgaccagacttaggagaaactcccttcaagacaggttggcacttattcatagatgggtcttcccaggtgattgagaggaaaagacataacaggtattcagtgattgatggagagacgcttgaagaagtagaatcaggaaggctgcctaatgattggtctgcccaaacatgtgaactgtttgcactcagccaagctttaggacatttacaaagccaagggtatactgactgtaagtatgcctttgccaggaaggaactatctatactgactgtaagtatgcctttggggtggcacacacatttgggaaaatttggatgaagaggttcttatcaatagtagaggccaagatttagttcatagctaattgcttgtgtcctcaacaatctccaattgccagaagagatagctatcgtgcatgtcgcagggcaccaaagggactttggtgtctgtagttctctaatatcacatccctatataaattccactgtgcagtgtccaggcaatgccattcctccagagagaattctatggccacatctctaaattgcaatggttcctgaaacacacacacacacacacacacacacacacacacacacacacacacatttttaccaagttgccattggtggaatttttaatttgatttaaggtgaaatgagagagtaaagggaagtgattctgacttacaggactaaaattatccaataaaataattttcaacacagaaatattctctaatatattctctaactctaagaaaaaaagaggagcataacatccacaacatcatttcatatatttttccatataataaagtataaaattaagggcatgaacatgaacatgtacatttttgagtgctatatttacatcatacagaatgagttgtgaatatttttccgatggaaaagacatgttgagttagaaggtatctctcaaattttgttttgagatggaatttcaatctagttgcctaggctgaagtgcagtgatgtgatcttggctcaccacaacctctgcctcccgggttcaagcaaatctcctgccacagcctcccgagtagctgagattacaggcatgcaccaacatccctggataattttgtatttttagtagagatggggttttctctatgttggccaggctggtcttgatttcccgaactcacgtgatctgcccgcctcagcctcccaaagtgctgggattacaggcatgagccactgcacttggctgatttttttaatttctaagaagctcaccagtaatgccaatgtttttggcccaagaaggatattttgtcaaacatccagtaagtggaagagcctgtgtttttcccagattttttagcctgtaagcaaagataaaagccttcattttccaaagagagatatgtagaaaaaaataagaaaaaaggacagctgccagattaaatgtgatggtttatgcacatcagctgcataaacatacttaataatgaagagaaaaataattaaccctatggtgaaaaaaatctgtcagagagctaattcaccaagtgaatcattaaccattaactgcacgaggacaaatttttacgatgtgctaatgcacacaggagaacacagaatcactgttgaaatatacttccccaaaaaactaaattacagtctgaatttaaccataaagaaacatgagttttatgcaaacttcaacatccagataactcctatgttctgtaatttttactagtaattttaaatagggttcatttagcaccctagaaaacaagtatctcctgataagttttttcagaactttctgggtaataaatgccatcccattttaatgagcattttcttaatcctgttctgcatagagctaatggaacacacagatggagcctcaacattacatgttctccatctttactaaggaccacacttttccccaatagaaatcttcagtatccacatctttccatgttcaatagccacaaaaggaacatttttaatattgcagatcataaatccttgctgagaatcctgcgtgacatataagaagctatgatgtagagaatgcagagatggctctggaatataggaaagaaatatttttcagagacccttgactatcataagaattttaacaagtagttaaatcaaacttattagggaggaaaaatacaagtagaaaaataaaggtttgcaagtactaaacgcatggcagtccaggaggcagagtggacacaggtcttcatctgacacaggtttacctgaagaaaagcctttttttttctttttccccttctctggaattccttctcagatgagattttctggacaaattaaacctgcatctgaaggatatgcttttaaaggtgtttacctgctagcatgacatcaactagcagaaaaagacagaaaaagtccacccatttctgtcctttaaaacagaagaggttcaggaaaaatgagatgctccatgaagatgaaagtataagtttctcctttcctgtcctcaggtgccctcccctgccacagacactagcaatttctgctaccttaatggaaatatgcaccacactgacctgtccctactaaacccaaacagaactggccctgtgaccaccctttagtccaaaggtggagcttaactctcatgaatgtattttgagggcctcatacctgattctggcctaaccttagagtcacatgaggcccttcattaaaacgtgatagatgcttccaccgagaatgataaacagaagctgtggggagggcacaagagatttctgcaaattggccatttgatcctaatgggaagcctgggctgataaccactaagttaagcattgcctctcaagctttaatgagattataaatcacctggtaattttggccccacttaatgtaatgtgattctgcaggtttgaaaagggtccaagagtgagtgttttaaacaagtcccctgtcaatgcagttgtttctcccccttggagaattattaacattagagaaagcaggcacagcacagggtcccttacacttagcactcttgtcaccaccaaatacttctggtacaaataaggacaacccatctccctcctaaagttttatagtctttgctggctctttagagtttacagaggaaacaaaagtcagcaatgtctgaataagtctgtatttaaaaaacaacatgtaaacatgtactaatgcaatgtttattaagcaggtactatgtgctcaagggtaagatacagagcactgtgctggtcatccctcattatgtaatttaattctcataacaccctgggagctggtactaagggtttaataatttttaggatttagataaagggcccagcatttttatttcttctgtttctctgtcatcaaattttttaaaaaactgtaaatagtaaagctaaatataggcagatgaaagagatatagaaaggaagagtttaatgtagctcagagaaaattttattctgtttatattcacttttttgtgacttgtggagcaactactggatctgcaggaatagaaaacaagttgctaaagagaatgtctctgcaaccactggttttaatggaaaatttaaaaactggccgggtgcagtggctcacgcctgtaatcccagcactttgggaggccaaggcaggtggatcacctgaggtcgggagttcaagaccagcctgaccaacatggagaaaccccatctctactaaaaatacaaaattagccaggcatggtggtgcatgcctgtaatcccagctactcaagaggctgaggcaggagaatcgctggaacctgggaggtggaggatgcagtgagccgagatcgtgccactgcactccaacctgggcaacaagagcaaaacttcatctcaagaaataaataaataaataagtaaaatttaaaaactaaggctctacaatatatactttatttttcccatttatctgcttttgggtttcaggaaattgtgagtagcagctctagaactgctgcaggattcatcagccaaaattctgataacttctaatcagttctgtgaggcaagactccagggcagggtcagacctaaataaggcctccaaaaagggtgaatctgaacaggtctgggacaaggtgaggaccctatagaattctgttctctatgccactggagtactaacaattttgttttttctaagcttgcctgaaagaagcctaaaatcccagagtttctgttattttcattttttctagccactaccctgtcaactgtatactatatactaatatgcaaattaaacaaatctcttcaggttttgtagtgtaattttattagaaaataaatactgtgcacttaacaacataaaagaaatagattttatatggccgggtgctgtggctcatgcccataatcccagcactttgggtggccgaggcgggtggaacacgaggtcaggagtttgagaccagcctgataaaggtggtgaaaccacgtctccactaaaaatacaaaaattaaccaggtgcagtggcaggcccctgtaatcctagctacttgagggactgaggcaggagaatcacttgaacctgggtggcagaggttgcagtgagccaaggttgcaccactgcactccagccttggtgacagagtaagactccatctcaaaaataaaaaagaaattataataacaatttttctgttcataaatatcccttcaggtgtagacatgagaagttacaacaatataaagaaatagcctaaataaagcctaagattttgggcatatctatttattgtaccaaccatatgatgcataattcaattatttatctgggtgctagtctagactaaaagtttctagatggtaggaaccatgactgcttcatggatttttttaaatggccatatgaaatggaagcaactagtttatctatttgggtctccggattttctccttttgtatcatccaagtaccaggaaaccggagaaactctcatctgggtaccaaccaaagacacctcttgtatgaggggatgaactaacaggatgactcatttctctcacactgagacagaaggagaattaaccattcttgtcagcctgacataattccgctcaggacatcctcaaatgcctcaaaggcacctagatgattgtgagagaattctcggtgaccaggggctaatgtcccaatgataaaccaggctggagagactcaggctgattctaaatagaaaatggaactgtcctggtggagctccagaacctagatcacctattctaatttgctagctccatggtataaaatatttttttggaacttcttaaattttttcaactcttggacatctgaattttgcatactgtatgcacttgaaagaatgtttatgggtgaaaatgcagaagagggaaatatgttataaaaaatccatgaatgaacaatacctatgcaacagaatagagagcccagaaataatgccaccctcctacaacgattagatttttgccaaagctgacaagaggaatgtgggaagaattctctatttcataaatggagttggaataactacctagcactatgcagaagactgaaactggacctcttcattacaccatatacaaaactcaactcaaaataaattaaagacttaaatgtaaaatttaaaattataagacaccctgcaagataacctaagaaataccattctagacatagaaactgggaaaaccttcatgatgagtctatcaaaagcaattgccacaaaagcaaaaatggacaaaagggacctatttaaactaaagagcttcttcacagcaaaggaaactatcaacagagtaaacagacaacatacagaataaagaaaatatttgcaaacattgcctctgacagaggactaatatccagaatttattaagagctcaaacaagtttacaagaaaaaaaacaaataacctcattaaaagtagaaaagaaaaacatgaacatattcttttcaaaagaagacaaatgtgcagttaacaagcatgtgaaaaaaatgctcattgctaattattagagaaattaaaagaaaaaccacaatgagataccgcatcacacccatcagaatggctatttttaaaaagtcaaaaaataatagatgctggcaaggttgcagagaaaagggaatgcttatactctgctggtgagagtgtaaattagttcaacaactgtaaaaagcagtgtggcgattcctcacagaactagaaacagaattatcatttgacccagcaacctcataattgggtatatacccaaagaaatataaattattatattacaaagacacatctatatgcatgttcactgtagcactattcacaatagcaaagacacggacaggcactaaatgcctaccaatgatagactagataaagaaaatatggtatggtcagatgttgtggctcatgcctataatcccagcactttgggaggccatggcaggtgggttgcctgagcttagaagtttgagaccagcctgggcaacaagacaaaatcttgtctccccggaaaaaaaaaatatataaaattgcccagttatggtaatgcacgtatgtagtcccagctacaagggaagatgaggtaggagagaattgcttgagcctgggagattgtggctaaagtaagccaatatcatgccctggcactgtagcctaggcaataagcctgtctccaaaaataaaataaaataaaagatttagtaaaaacaaaatatggtatataaacattacaaaatactgggtagctatttaaaaaaaatcatgtcctttgcaataacatagatgaatctggagaccattattcttagaaaatgaatgcagaggctggacatggtggctcatgcctgtaatgctaacactttgggaggccgaggtgggcgaaccacctgaggttgggagtttgagactagcctgaccaacatggattaaccctgtctctactaaaaatacaaaattagctaggcatggtggtgcctgcctgtaaccccagctactggggaggctgaggcaggagaaccgcttgaacccaggatacgaatgttttgatgagccaagatgttaccatggctctccagcctggacaacaagagcaaaactccctttcaaaacaaacaaacaaaaaaacaacaaaaaaagaaaactaatgcggaaacacaaaaccaaatgcatgttataatttataaataagagctaagaagtaagaacacagaacacaaagagaagaacagacacaggcctagttgaggctggagggtagaaggactcagaagatcagaaaacataattgtttggtgctatgggtagtacctcagtgacaaaataatcggcacaccaaatccccatgacataattttagctgtataacaaacccacatgtgtacccggaaccaaaaataaaagctaaaagaaaaacaaatcccctctccctctccctccgcctccccctccctctccctctccgtctccgtctccctctccccagggtctccctctccctctctttccacggtctccctctgatgccgagccgaagctggactgtactgctgccatctcagctcactgcagcctccctgcctgattctcctgcctcagcctgccgagtgcctgtgattgcaggcgcgcgccgccacgcctgactggttttcgtgtttttttggtggagacggggtttcgctgtgttggccgggccggtctccagcccctaaccgcgagtgatccgccagcctcggcctcccgaggtgccgggattgcagacggagtctggttcactcagtgctcaatggtgcccaggctggagtgcagtggcgtgatcttggctcgctacaacctccacctcccagccgcctgccttggcttcccaaaatgccgagattgcagcctctgcccggtcgccaccccatctgggaagtgaggagcgtctctgcctggccgcccatcatctgggatgtgaggagcccttctgcctggctgcccagtctggaaagtgaggagcgtctctgcctggccaccatcccatctaggaagtgaggagcgcctcttcccggccgccatcacatctgggaagtgaggagcgtctctgcctggccacccatcgtctgagatgtggggagcgcctctgccccaccgccctgtctgggaagtgaggagcgtctccgcccggcagccaccccgtccgggagggaggtggggggggtcagccccccgcccggccagccgccccatccgggagggaggtgggggtcagccccccgcccggccagccgccccgtccgggagggaggtggggggggtcagcccccagcccggccagccaccccgtccgggaggtgaggggcgcctctgccaggccaccaccccgtctgggaggtgtacccaacagctcattgagaacgggccatgatgacaatggcggttttgtggaatagaaaggggggaaaggtgaggaaaagattgagaaatcggatggttgccgtgtctgtgtagaaagaagtatacatgggagacttcattttgatctgtactaagaaaaattcttctgccttgggattctgttgatctcttgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaataaattaaaaaaaaaaagaaaaaaaatccccaggtgagagagagtgcaatgtcagtgaatggacagatttttgctacagatagttgaccaggtggggctgtactctgatttatttctgtgtgcatgcaggcagatgagattatgaaaaggagggccagaaccctaggctggtggagaaaacaggttgctgctgcagattcgatatccggggatgggaatatgcaaggaaacttgtagatacttttggctttttggctagaagtgcttggaccaaaaatgtcatggtgaagtcactgagggtggtgcctagtcctgggaggagtgtggacatgtcaatgtctagtgtgtgtgtttgggagtatgtgggaatcctgtggtggcagctgcaagaaaaggggatgtgtcatcagagctcctttcctgtaagttttcagtcctctgtcaccctgggagaagacctggaatcacaggacaatgggcagtgtgacaatctgtgtacaggagagcagaatctcccattcccaaacacccagagttttattccaggccaggcctccatgatatcttctttctggcaccaaatctgtagcatttgctgaacatcaaacaattctccaacaccaacttattgtataacatttgatttctaacactacccagagtcagcacagaccctgattcagggctcggtcccacaacattgttctcactgcagatgccagtcataaatcccatgggcccatctatggttctgagctactgtttaaaaactggggactcccataacttccctgaagctcagtaatttggtagagctactcacagaactcagcaaaacactgtagttatgcttactggtttaatatataagatgcagcccaggaaaagccaagtggaagaaatgcatagaacaaagaaaagagatgaggaaagatgaaacacatagataattatgaaaaatatttgtgattaataaaattctccttcctttgtgtgcttcaggaacagtttatggaaagaaacactcttcccgttatgattaagatgatgctcccttttcttgcctatcacacagccagacatacactctgcacattttctcctttttctcattaaaaaaaaaacaaaaaaccagctgaatttgccttcagcagtcaaaatcaattatgattttttttttttttgagatggagtgtcactctgtcacccaggctggagtgtagtggggccatctcggctcacttcagctttcacctccagggctcaagcaattttcctacctcagcctcccaagtatctgggattacaggcacctgccacaacgcccagctaatttttgtatttttagtagacagggtttcaccatgttggccaggctggtcttgaactcctgacctctggtgatccgcctgcctcagcctcccaaagtgctgggattgcagacttgagccaccacacccagcctaaaataaaatatttcttaatcaaattttacttaagtttatcttctctcaggctcctgaaattcaagctaccctcagtctgagtcaacatacaaccccattttatgtccctcctaagaacatgctgatttcagggtaagccattctctgatctaaaatctgactttttcaccctccatttgctgttcctctcccacctcctttctaatcttgtttgctcttccctagaaaagaaagcccttttctgcctatatttttgcaagccataaagatattatagttatttggtgcttccttttgttgcaatacttttttggaattggttttttacctgcctcttgagaatatgcctttaagggtgtcagtaccacatgtttacctgcaagcatgacatcaactggcagaaaagacagaaaaagtccatccatttctgtcccttaaagcagaaggtatttgggaacaatgtgctgctccataaagataaaaatatgtttcttcttccctgtcctcaggtgccctcccctgccacagacaccagcaatttctgctacagaacctgcagagaaaaagagaagaaattaaaatgctgggccctttttctaaatcctggaaattagtattaaatccttagtaccagctcccagggtgttatgaggattaaattatataatgtattatgcccagcagagttctctgtatcacaatcttgagcacatagtacctgcttcatacagtaatacaaatatacaccactctgacctgtccataccaagccaaaacagaacaggccctgtggctaccctttagtccaaaagtggaacttaattctcatgaatatattttgaaggcctcatacctgattctggcctcaccttagagtcacatgaggcccttcattaaaacaacatggatgttttcaaccagaataataaacagaagctgtggtgagggtacaagagatttctgcatattggccatgtgatcctaatgagaagcctgggctgataaccactaagctaagcattgcctctcaagctttaatgagcttataattcacttggtaattctggccacactttaagtaatgtgattctgcaggtttgaaaagggtctgtgaatcagtgttttaaacaagtcccctgtcaatgctgatgttactcctccttggctcattattaacattagttagaaaagcaggcaaaccacagggtcccttacacttagcactgttgtcacaatcagataactctggtacaaataaggacaactcatctccatcctaaagttttatattctttgctggctctttaaagtttacagaagaaacagaaggtaattaccaggatttagaaaaagagccaagcattttaatttcttgtttttctgtcatcaaaaatttttaaaaattgtatagaataaaagctaagtatagacagatgaatgagacataaaaaggaagaggttagtttagagaaaattttattctgtttgtatttacttttttttgacttacggagcaactactggatctgcgggaataagaaacaagttgctaaatagaatgtctctgcatccaatggttttcatagaaaattaaaaaacggctgggtgcggtggctcatgcttgtaatcccagcactttgggaggcagaggcgggcggatcacgaggtcaggagatcgagaccatcctggctaacgtggtgaaaccccatctctactaaaaatacaaaaaattagctgggcgtggtggcgagcgcctgtagtcccagctactcggaggttgaggcaggagaatggcatgaacccgggaggcagagcttgcagtgagccgagatcgcgccactgcactccagcctgggcaacggagtgagactccgtctcaaaaaaaaaaaaaaaaaaaaagaaaatttaaaaatgaagaccctcaaatacatactttatttttttgtatttatctgcttttggatttcaggaaattgtgagcagcagctctagaaatactgcaggattcaccagccaaaactgatctctgccaatcagttctgtgaggcaagactccagggtaggtctggacctacataaagcctccaaaaaaggtgaatctgaacaggtctggggcagagtgaggatcctttgtagaattctgttctctatgccactgggatacttccagttttgtttttctaagcctacctaaaagaaacttaaatcccagagtttctgtaattttaatattttctagccacggccctgtcaactttatactatatactaatatgcaatttaaagaaatcccttcaggtttcctagggtaattttattggaaaataaatatgtacagttagcaaggtaaaagaaatagaaactatacggctgggtgcagtggctaagtcccacaattccagcactttgaaaggctgaggtgggtggatcatgagggcaggagttcaagaccagcctgaccaagatggtgaaaccttgcctctactaaaaatacaaaaattagctgggcatcgtggctgtggccagtaatctcagctacttgggaggctgaggcaggagaatggcttgaacccgagtggcagaaattacagtaagccaagatcgtgccactgcactccagcctggggaactgagattctgtctaaaaaaaaaacaacaaaactataataattgttcggttcataaatatattcaggtgtagatatcagaagtcacaacagcataaagtggcataaataaagcccaagactttggacacatctatatattccaccaaccatatgatgcataattcaattattcatgaagttgctagtctagactaaaagtttctggattgtaggaacaatgactgcttcatgtatttttttaatggccatataaaatggaagtaatgagtttatctatttgggtctccaggtctccttatttatcatccaagtaccagaaaactggataaactctcatctgagtaccaaccaaagatacctcttgtatgagaggatgaacaaaaacacaggatgactgatttctcttacaccgagacagaagcagaattaatcactcttgtcaacctgacacaactctgctctggatattcccaaatgcctcaaagacacctaggtgattgtgagagaattcccagtgaccatgggctgatgtctcaataagccaggctggagagactcaatgataagccaggctggagagactcaatgataagccaggctggagagactcaggctgactctaagtagaaaatggaactgccttggtggagctcaagaacctggatcacccattctgatttgctagcatttgggtaagagaaagaatgaaaatattctactccagtatcacattttacaggtaaatatagttgtgcacatggctctggctattttgtggacttgatgtctcactcctaagatgtttatttacacttacagattctaccatcagattctatttcctcctggacactcttacagtctgacccttttttgtaaaccccaggcagaagccataccttatctgcagattctaggtaggacccacctggttctgcatcctttggtgttacagcaagtggagtacaatcagagaagagatcccctaatagaggctgctctagcactttctaagtattaagcctacatgaaaaaaaaaaaaaagctgacacaacatgaatgtaagtagacagtttatttgggtgaagtttaaggattataacctgggagcaaagactgaagttgcctagaatctacactttcattaacagcagttgcaagaggagttgtgaagacaaaaacaaagggacagagagtgggctgatagagttgtcagaaatttttatttaaagaagtaacattggttattgattggacatatatcattatggtttagggtatgagatacagtgtccaatgtggtattatcagtttaatatacatctacttgtggcaatagtgaacagtttcaagagatgaatacatatttcaaaggaggagaaaggcgtaactgcactttcatttcaatgtctgagtttgataaccaaaaggacttgcatttttagataaaaattttctatttcccaaatctcaagacctagatacaaaatgtagagctgcagatttagggcccgaatggctggagtagcagcaggtgttacctgcacatttgtgaacattttaccaagagaaaaaaggggaaagtgaagattctcatgtctgaatgtgtactcaatgaaaacgttactctgattaggtttgtgggccccatggtctctgaatcagtttaaggtctgaagatacaagagtcattgagataaaactattgattgttgccctgtgaagttggtagaaatttggtttagtctctctagaagtgactgtagaggactatagataccaaataggcagaaacacagttctgcttgcatatttaggggacagcatgcactttgttgcacaagtgtgagttgactggaagtctgagagggaaagtcccctctagagtaaattccagttggcaccttatgtgtttatatcatgtctggtaattatagacagtgtttggaaataacaaaagaatgttctccagccccagaaaaactccacaatagaacagaaagaaaactgttttatgtgacatgcatcatagtcaatctgcttaagagactgcagagacagaaagatggtcaccaaaattagtccacaagtagaatttccagaaccatgtcatacatagttcatcctaaattcacatggagattgaagaggccatctgtatatgctaattgtttatattcaataacaaaaaaacttttcacaccttcataacaggaggtagtttagcagcttgaagccaggtacttgctgaaggtaggttttcactctgctacaaaaatggttgaaaagcattctatccttttggctatttacattttacagcagtggctctgtgttccatggcattgggctacagcactttcttgctttttcctggttgctagtgtcctcttgacctctctcatctgccactgagggacagccttgagcacagctcagtttatgtgaaccacatttcccacagcagcactctagtgtcacatcagagaggaaagcctgagctgcaggagagcctgcaggccttgtgagtagaattgcactttcacaataatgggaatgtgaccagtgtttcagcccgtttttaattatcatggtgacatggaaaaaaaatcggatgaatttccagcatgagtccagatagagatatctacaaaagttctcactgtgacagcctacctcattcagacaccatgggatactaatagggcttctgaaacagacacccaaagtattggagagaaaaacagatctccatctgagcaagataattttgagagaaaaaagttaaaaagatcttgagaaaaaagatcttgagaaaaagctcagtttagatataagattgatcaagtcagccagaaaatagtcccctaaaagcaatttctctctaaccacccaaagtgcacaattactctcagcatgagaaacatgagcattatgaagaaagggggcagaatttcagaagaattttataaagctttttttcccatctctgctgctctctcatctcctagtcattgaatgggggttctatattgaaatatatctgacaacttccaacaacactttttgatgcagaaatagaatctgactgtgttcacattgtggagtatattagaacttccaacatagttaactgaagagctatcatggtttttgggtggccacatcaactgtctttatttcatttgtaatagcagcattccaattgagtgaaataaaagatactaaaattgtgtttacttataattatccctattgaataaagtaataaacatgtcagactagtattgactgtaacaatttggtagtaaattttttggggtattagattaaatatctaagtataaataattttaataaactagtagtaatgtatatggcagttaaaaagtttaactatacttcagttaaaatagtttatatttcaaaagtgtaaataacaatattaaaataaccatttaagtgattcattcaaagtaagtattgtggctttatattcatactattgtaaaaaatactgtttatggctcatgcctataatcccagcactttgggagactgaggtgtgtggatcacctgaggtcaagagttcacaatcaagctggccaacacggtgataccccatctctactaaaaatacaaaaacttagccaggcatggtggggtgtgcctgtaatcccagctactcaggaggctgaggcaggagaaatcacttgagcctgggtcccagtggttgcagtgagcagaacacgcccctacactccagcctgggcaagagtgagactctgtctcaaagaaaaattaaaaaaaaagaaaaagaaaactgtttaatgtatatgaatgtattgttatgtgtagtgtctgcaaacactacacataactatgctaattgttctgaagtcatcaatagaaagccaagtacaactacagactctactgttcagtttatgcactgaactctttttgtttttgctgtgtaagtacttcagcctgcaaatgttggataattaccttggataataaagttactttcaaagaaacttagtatcttttagcgtttctcattccatattgctaaatttaatcctatgtttctgctaagcttctgtgtgctcttaaaatgagcttttatctaaacacatttgtgtttactttaaaggactaaaaatgggccaggcatggtggttcatgcctgtaatcccagcactttgggaggctgaggcgggcagatcacttgagtttgggaatttgagaccagcctgaggaatatggagaaaccccgtttctactaaaaaaacaaaattagttgggtatggtggcacgtgactgtaatcccaactactcgggaggctgaggccagagaatcccttgaacctgggaggtggaggttttggtgagtcaagatcatgccattgcactccagcctgggcaacaaaactgaaactccatccaaaaaaaaaaaaagtcctaaaaaggagagaaacaaactttttaaaattagaaataaaccaataaatcagatgtactagaaaagataatctaaagtaaaaaaaaaaaaaaaaaaaaagacaaagtttatttaactgttaatatggtttacagatatttcaagaaagcagagaaaaatatctacacataatctaaatcccttaaggaaaaagagaataagaaaaatttttttggaactttttaaaaagtctttgaactcttggtaatctaagttttgcaaacaggatgcacttgaaagaatgttagcctaggtgtggtggctaacacctgtaatcccagcactttgggaggttgaggcaagcagatcacctgaggttgggagttggagaccagcctgaccagcaaggagaaaccctgtctctactaaaaatacaaaattggctgggcatgatagcatatgcctgtaatctcaactacatgggaggctgaggcaggagaattgcttcaactcaggaggtggaggttgtggtgagccaagatcatgccattgcacttcagcctggcaatagcgaaactccctctccaaaaaaaaaaaaaaaaaatgtttatggggggaaaagcagaagagagaaagatgttataaaaaattcatgtgcacaagaccaatgcaacagaacagagagcccagaaataatgccaccctcttgcaaccatcagatttttgacaaagctgacaaaagaaatgtggggaaaattctctatttaataaatggtgccggaataactaactagtaatatgtagaacacttaaactgaaccccttaattacaccacatacaaaaatcaactcaagaaaaattaaagacttaaatgtaaaacataaaattataagaaaccctgcaagataacataaaagctaccattctagacatagaaacctgcaaacacttcatgatgaagctaccaaaagcaattgcaacaaaagcaaaagctgacaaatgggacctatttaaactaaagagattcttcacagcaaaggaaactatcaacagagtaagcagacaacctacagaataaaagaaaatatttgcaaactttgcctctgacaaaggtctaatatccagaattaatgagaacttaaacaagtttacaagaaaaaaccaaacctcattaaaaagtgggcaaaaaacatgaacagatgcttttcaaaggaagacatacatgtggctaacaagcatatgaaaaacaaagctcaatggtaatcattaaagaaattaaaaagaagccaggcacggtgtctcacacctgtaatcccagcacattgggaggcttaagcaggcagatcacaaggtgaggagttcaagaccagcctgtccaatatggtgaaaccttgtctctaataaaaaaacaaaaattagcctggcatggtggtgggcacctgtagtcccagctagtcaggaggctgatagaggagaatcacttaaacctgggaggtggaggttgcaatgagctgagatcgtgccactgctctccagcctgggtgacagagccaggctccatctcaaaaaaataaacaaataaattaaaagaaaaaccacaatgagataccacttcacatcagtcagaatggctattttaaaaaagtcaaaaaataacagatgctaccaaggttgcagagaaaagagaatgcttatactctgctggtgggagtgtaaattagtttaactgtaaaaagcagtgtggcaattcctcacagaactgaaaacagaattatcatttgactcaggaacctgataattgggtatataccaaaagaaatataaattattataaagacgcatccatatgcatgctatgcatgttcattgcagcactattcacagtagcaaagacatggacaggacctaaatgcccatcaataaagaaaatatggtatggtcagaagcggtggctcatgccttcaatcctagagctttggaaggccaaggcaggtggactgcctgagcttagaagtttgaaaccagcctgaaaaaaatagcaaaatcttgtctacatggaaaatacaaaaagaaaaagtggccagccatagtaacgcacacgtgtagtcccagctacttgagaagatgaggtaagggagaattgcttgagcctgggaggctgagactaaagtaagccaaaatcacaccatggtaatctagcctgggcaataagtgagaccctgcatccaaagataaaataaaataaaagatgtagtaaaaaacaaaatatggcacataatcatggaatactccatggccattaaaaaaaatcatgtcctctgcaataacatcaatgaaacccattaaaaaaaatcagctctgatcttagttttttcttgccttctgctagcttttgaatgtgtttgctcttgcgtctctagttcttttaattgtgatgttagggtgtcaattttagatctttcctgctttctcttgtggacatttagtgctatatatttccctctacatactgctttaaatgtgtcccagagattctggttatgttctgtctttgttctcattggtttcaaagaacatctttatttctgccttcatttcattatgtacccagtagtcattcaggagcaggttgttcagtttccatgtagttgagcagttttgagtgagtttcttaatcctgagttctagtttgattgcactgtggtctgagagatagtttgttatactttctgttcttttacacttgctgaggagtgctttacttccaattatgtggtcaattttggagtaagtgcaatgtggtgctgagaatgtatattctgttgattttgggtggagagttctgtagatgtctattaggtctggctggtgcagagctgagttcaattcctggatatccttgttaactttctgtctcattgatctgtctaatgttgacagtggggtgttaaagtctcccattatcattgtgtgcgagtcttagtctctttgtaggtctctaagggctttctttattaatctgggtgctcctgtattgggtgcatatatatttagtatagttagctcttcttgttgaattgatgcctttaccattatgtcatggccttctttgtcttttatgatctttgttggtttaaagtcttgtttttctcagagactaggattgcaacccctgctttttttttttgttttccatttgcttcagagaccttcctccgtccctttattttcagcctatgtgtgtctctgcacatgagatggatctcctgaatacagcacactggtgggtcttgactctttttttttttttgagatgggtctctgttgcccaggctggagtacagaggcatgatcttggctcactgcaagctctgcctcccaggttcatgccattctcctgcctcagcctcccaagtgcctgggactacaggtgcctgccaccatgcctggctaattttttgtatttttactagagatggggtttcactgtgttagccaggatagtctcgatctcctgacctcgtgatctgcccacttcagcctcacaaagtggtgggattacaggtgtgagccactgcacctgccagggtctgggccctttatccaatttgccagtctgtgtcttttaattggagcatttagcccatttacatttaaggttaatattgttatgtgtgaatttggtcctgtcattatgttagctagttattttacttgttagttgatgcagtttcttcctaacattgatggtgtttacgatttggcatgtttttgcagtgactggtaccagttgttcctctccatgtttagtgcttccttcaggagctcttgtaaggcaggcctggtggtgacaaaatctctcaggatttgtttgtccgtaaaggattttatttctccttcactgatgaagcttaggttggctggatatgaaattctgggttgaaaattcttttctttaagaatgttgaatattggcccccactctcttctagcttgtagagtttctgccgagagatccactgttagtctgatgggcttccctttgtgggtaacccgacctttctctctggctgcccttaacattttttccttcatttcaactttggtgaatctgacaattatgtgtcttggagttgctcttctcgaagagtatctttgtggcgttctctgtatttcctgaatttgaatgtcggcctgccttgctaggttggggaagttctcctggataatatcctgcagagtgttttccaacttggttctattctccccatcactttcaggtacaccaatcagacgtagatttggtcttttcacatagtcccatatttcttggaggctttgttcatttctttttattattttatctctaaacttctcttcttgcttcatttcattcattttaacaatcactgatactttttcttcctgttgatcacattggatactcaagcttctgcattcatcacgtagtttttgggccatggttttcagctctatcaggtcatttaaggtcttctctacactgtctattatagttagccattcatctaatcttttttcaaggtttccagcttctttatgatggattcgaacatcctcctttagcttggagaagtttgtttttactgattgtctgaagaactgaaggagagagagagacacaaaagaaccttcaaaaaaaatcaatgaatccaggagctggtttcttgaaaagatcaacaaaagtaatagactgctagccaaagtaataagaaaagagagaagaatcaaatagacgcaataaaaaatgataaaggggatatcaccactgatcccacagaaatacaaactaccatcagagaatgaatactataaacatctctacacaaataaactagaaaatctagaagaaatggataaattcctggacacataccccctcccaagactaaacaaggaagaagttgaatccctgaatagaccaataacaggctctgaaactgaggatataattaatagcccaccaaccaaaaaaagtccaggaccagacagattcacagctgaattctaccagaggtacaaagaggagctggtaccattccttctgaaactatttcaatcaatagagaaagaaggaatcctcccaaactcattttatgaggccagcatcatcctgattccaaagcctggcagagacacaacaaaaaaagagaattttagaccaatatccctcatgaacattgatgcaaaaatcctcaataaaatattggcaaactgaatccagcagcgcatcaaaaagcttatccaccatgatcaagttggctttatccctgggatgcaaggctggttcaacatacgcaaatcaataaacgtaatccatcatgtaaacagaaccaaagacaaaaaccacatgattatcaatagatgcagaaaaggcctttgacaaaattcaacagcacttcatgctaaaaactctcaaactaggtattgatgggacgtatctcaaaataataagagctacaaaccactgctcaatgaaataaaagaggacacaaacaaatggaagaacattccatgcttatggataggaagaatcaatatcatgaaaatggccatactcctcaaggtaatttatagattcaatgccatccccatcaagctaccaatgactttcttcacagaattggaaaaaactactttaaagttcatatggaaccaaaacagagcccatattgccaagacaatcctaagccaaaagaacaaagctggaggcatcaccatatttgacttcaaactatactacaaggctacagtaatcaaaacagcctggtgttggtaccaaaagagatatagaccaatggaacagaacagagccctcagaaataataccacacatctacaactatctgatctttgacaaacctgacaaaaacaagaaatggggaaaggattcccgatttaataaatggtgctgggaaaactagatagccatatgtagaaagctggaactggatcccttccttacaccttatacaaaaattaattcaagatggattaaagacttaaatgttagacctaaaaccataaaaaccctagaagaaaatctaggcaataccattcaggacataggcatggacaaggacttcatgactaaaacaccaaaagcaatggcaacaaaagccaaaattgacaaatgggatctaattaaactcaagagcttctgcacagcaaaagaaactaccatcagagtgaacaggtaacctacagaatgggagaaaatttttacaatctacccatctgacaaagggctaatatccagaatctacagagaacttaaacagatttacaagaaaaaatcaaacaaccctaacaaaaagtcggcaaaggatatgaacagacacttctcaaaagaagacatttatgcagccaacagacacaagaaaaaatgctcatcatcactagccatcagagaaatgcaaatcaaaaccacaatgagataccatctcacaccagttagaatggctatcattaaaaagtcaggaaacaacaggtgctggagaggatgtggagaactaggaacacttttacactgtttgtgggactgtaaactagttcaaacattgtggaagacagtgtggtgattccccaaggatctagaactagaaataccatttgacccagccattccattactgagtatatacccaaaggattataaatcatgctgctataaagacacatgcacacgtatgtttattgtggcactattcacaatagcaaagacttggaaccaacccaagtgtccatcaatgatagacaggattaagaaaatgtggcacatatacactatgcagccataaaaaaggatgagttcgtgtcctttgtagggacatgaatgaagctagaaaccatcattctgagcaaactatcacaaggacagaaaaccacatgttctcactcataggtgggaattgaacaatgagaacacttggacacagggtggggaacatcacacaccccggcctgtcatgggtgtgtgatggagcagagagggatagaattaggatatacctcatatgaataatgagttaatgggtgcagcacaccaacatggcacatgtatacatatgtaacaaaccagcatgttgtgcacatgcacctagaacttaaagtataataataataataaaaaattaataagtaaaaaaaaaatgaggtctttgcaataacatcaaggcacggtggctcacgcctgtaatcccagcactttggaagaatgagatgggtggatcacctaaggttgggagtttcagaccatcctgaccaacatggagaaaccaaatctctactaaaaatacaaaattagccaggcgttgtggtgcgtacctgtaatcccagctactcggaaggctgaggcaggagaatcccttgaacctaagaggtggaagttgtggttagcggagatcacgctgttgcactcaagcctgggcaacaagagtgaaactctgtctcaaaaaacaaaaacaaaaacaaaaaacaaaccaaaccaaaaagaaaactaatgaagaaaaagaaaaccaaatgcttgttattatttataagaggtaaataataataacacatgaacacaaacaacagacactgaggactagtttagggtggaccctgcaaggactcagaggatcagaaaacatacctgtttggtgctatgggtagtacctcagggacaaaataatctgcacaccaaacccccgtgacacaattttagctgtataacaaacccacatgtgtaccccgaaacaaaaattaaagctaaaagaaaaaaaaaaatcccagggtgggagagtgcaatgtaggtgaaaggactgatttttgctacagatagtggtcccagtggggctgtactgatttatttctgtgtgcatgcatgcagatgagattatgaacaggtggtccagaaccctagtttggtagagaaaacaggttgctgcagcagatttacagtctgaggggatgtaccaggagacttgttttttggcaaaaaacacttggatcaaaaacgccatggtgaagttcctgaggggggtgcctagtcctgggaggagtgtggacacatcaatatctagtgtgtgtgtttgtgagtgggtgggaatcctgtggtagcagctgtgtgaaaagggggtctgtcatcagagctcctttcctctaagttttcaggcctctgtcacccttggagaagacctggaatcacaggacaatgggcagtgtgactgcctgtgtacaggagagcagtctctcattcccaaacacccagagttttattccaggcaaggactctgtcatatcttatttctggcactaaatctgtagtttgctgaacatcaaaaaattctccaacaatttattgtctaacatttgaattctgacactacccacagtcagaacagactctgattcagggctcgggtcccaacattgtcctcactgcagatgccaatcacaaaccccatgggcccatgtatgcttctgagctaatgtttaatatttggggctgccatgacctccctgaagttgaataattttgtatagccactcacagtactcagcgaaacactgtagttatgtttaccagtttcatatataagatgcagcccaggaaaagccaaatggaagaaatgcatagaacaaagaaaagtgatggggaacgatgaaatgcatagataatgctggaaaatatttgtgattaatacaattctccatcctatatgtgctccaagaacagtttatggaaagaaacactcttcccattacaacttagacggtgctcccttttcttacctgtcacagagccagacacacactctgcacattttctcctttttctcattaaaaaaatcagctgaatttgtcttcagtggtaaaaataaaatatttctgtctttttcttgagctggaatctcgctctgtcacccacgcagaagtgcagtggtgtgatcttggctcactgcaacatctgcatcccgggttcaagaaattctcctgcctcagcctcccgagtagctgggattataggcacccaccaccatgcccggctaatttttgtattttaagtagaaacagggtttcaccatgttgcctaggctggtctcaaacttgtgacctctggtgatctgcatgccttggcctcctgaaatgctgggattccaggtgagccaccatgccaggcttaaaataaaatatctccttttttttttgagttggagtattgctctgttgcctaggctggagtgcaatggcatgatctcagctcaatgcaaactctgcatcccaggttcaagctattctcctgccttagcctcctgagtagcaggcattacaggcacgtgcccccgcaggtggctaatttttgtatttttagcagagacaaggtttcaccatctcaggctggtctcgcactcctgaccttgtgatctggaattacagacataagccaccacacccagcctaaaagtaaatacttcttaaactttacttaagcttatctccctccctcaggctcctgaactttgagctaccctcagtctgagtcaacatacaaccccattttatgtccctcctaagaatatgctgatttcagggtaagacattctcttttctataatctgactttttcaccctccatttgccattcctctcccacctcctttctaatcttgtttgctcctccctagaaaagaaagctcttttctgcctacatctatgcaagccgtaaagatcttatagttagttggtacttcctcctgttgcaatacatttttgaaattcattttttttacataaatctaacatttgtattacacaaagtgtagaaggtgcctcaaaacaataacaacttcatcatcattagtaagaccgtcccccagtttcctttcattttaaccttaactgcatctgcctgtggggccccagctttccagggctctgcagtttctctgaggatgaaggctccttccatggctcgggtgagcaggctgaaacatctgcaggaaaggttccccaagaataactaactgggcctttaataacctcctgttgcaggcttaatattagccttagcttggagtcacaaggttcaagctttaatttccatgtgagagttatttacttggtttttgaaactgttcaaaaaatccagtgaaattactcaaacactgtgtttatataagggatggaaattttaaggtgcttaattttttttttgagatggagtcttgccctgtcacccaggctggagtgccatggtatgatctcagctcactgcaacctctgcttcccgagttcaagtcattctcctccctcagcctcccaagcagctgaaactacaaagtatgcgccaccataccctattaatttttgtatttttagtagagatggaatttcactatgttgggaaggctggtgtggaactcctgacctcaagtgatctacctgcctcggcctcccaaaatgctgggattacaggcatgagtcactgcacctggctaaagtgcttgcattttataccttcataagaaaagcaaatatacctacttctttcagacaatatatgtattatcttattatttctattaaaaataatgtagtaacaaattagtcatatgggaacacttgtagaaggtaccatgtttcatcacatataatttagcattacattcagaaatgaagacaacaggatatagacatgagatatttattcactgtcacaaatttacccagcaaaaggaggtactgatgttttgatgaatttatgtaactcaattatctacaacattttcctgtggaaatatattcattgtctacagccaaaatgaaagagagatttttcttattttttcccttggtagctagcattcttaaagttaaggcttggaattctgtttgaaatcactcagccataaaaaacacacctgagaaaattcctaaactcactctgggaaagaaaaagataaatgagaatgattaacaaatggaatatatgattagatattaattttttgaaactcatattttattttctttgtaaatattttcttaactttcaagccctactaataaaatgcaaattttagttaaaaaaacatgtcagctgggtgcagtggctcacgcctgtaatcccagcactttgggaggccaaggcaggtggatcacttaagactagaagtttgggaccagcctagtccatctctactaaaaatacaaaaactagctgggcctagtggtgcgcacctgtagtcctagctacttgggaggctgaggccatgagaatcaattgaacccaggaggtggaggttgcagtgagccgagattgagccattgcattccagcctgtgcaacagattgagactgtctcaaaaaagaaaaaaaaaaagggaggtcaaaataagtgaacagatcgtttcaaggtacaggtcgaatcacccaccccatcctgctcatttacgtgctcaataaccaccctcccaggagacactgcgatatgacccagtgagtcctccaggtgcattttacttcctaaatttttacgccatctcactggggtcagttttttttgtcttttggagtgttttttttttaaacaaatttttcactatttttctgccaccccccccctgcccccgccaagaaaatctaggggacagaaattatttgttttcccctcgataccagcatctggttggctgacaagcaatgtgtctccaagaattggaagctaggttgggtgaagagaatcatgtctcaaggggttagcttttctttattttttgtgagatcgagtcttgctcttgtcgcccaggctggagtgcagtggcgcaatctcggctcactgaaacctccgcctaccgggttcacgccattctcctgcctcagcctcccgagtagctgggattacaggcgcctgccaccatgcccggctgattttttgtattttttagtagagatggggtttcaccatgttggccagcctccaggctggtctccaactcctgatctcaggtgacccacccacctcggcctcccaaagtgctgggattacaggcgtgagacactgcacccagcctcaaggggttagcttttcaggaaaaaaaaaaaaaaaagaaaaaagaagaagtgcaacaggagatgcctttcagccccaaggctgtcacctgctcttttgagaggctacactgtatacttcaggtggtcctatgggagaaaatgacccaagagctaatagtcactagacactctaccagacatagccatggtgggtatcttggtttattcccagaaagtactaaaactcaggcccagaaaaaaaactgaaggatagctgaggacacatcaccctacaaagtttacaaagggtaatcttgacccaaaaacattttggtaagttctctggaaaaataaaagaaaaagaggagccgggcgcggtggctcacgcctaaccccagcactttggaaggccaaggcgagtggatcacgaggtcaagagattgagaccatcctggcccacatggtgaaaccccgtctctgcttaaaatacaaaaatttagctgggcgtggtggcgcgcgcctgtagtcccagctactggaaaggctgaggcaggaggatcgctggaacccaggagacggaggttgcagtaaatcgagatcgcgcgactgcactccagcctggcaatagagccagattccatctcaaaaaacaaaaacaacaaaagaaatgcaggcacagatattttttacaatacagtgtcaggggattattctttgctttcttctgggaaatatttacaaagagaaaacaagtcttttcaatagtgttatgcaatgctttaaaaaaaatgattaattgaggaacgtggggtacatttcaggccctgcttaggacacatgtgaaaaatgctagggaaaaatcagtcccctgtggggtgtggaaataattaagtggcaggcaattagactgaggatgctctagtcctcggattcctccttctaaaataaaaatctaaactcaagtgcagtttttgctaaattactacattcgggaaacaaaattcaggcttaaaaaaccataaactgccaattaagctctgattacataaccaggaaatttccaccttaattgtacaaagaaactacataactatacgtattgaattattgaatatggttttcttcatcatgcaccttatcaatgtttccttcaagcccctcccatggaccgcaaactacaaactatagctgggtgctcttgaatgactgattaaattatttgatatttttgcggtgactcccataatttatgtatttatttatttttttagacaaagtcttaggccgggcgcggtggttcacgcctgtaatcccagcactttgggaggccaaggcgggcggatcacgaggtcaggagatggagaccatcctggttaacacagtgaaaccccgtctctactaaaaatacaaaaaattagccaggcaaggtggcgggcgcctgtagtcccagctactcgggaagctgaggcaggagaatggcgtgaaccccagggggcggagcctgcagtgggccgagatcgcgccactgtactccagcctgggcgacagcgagactccgtctcaaaaaaaaaaaaaaaaaaaaaaaggacaaagtcttgctctgtcacccaggctggaatgcagtggtgtgatatcagctcactgcagcctccgcctcctgggttcaagcgattctctctcctctgcctcccgagtagctgggactagagacattcgccatcacactcagctaatttttctattttctttgtagagatggggtttccccattttgcccaggctggtcttcaactcctgacctcaagtgatcagcccttctcagcctcccaaagtgttgggattactggcatttcgtacctggcaccatactttttttttttctttgagacggagtctccctctgtcgcccaggctggagtggtggtgcaatctcggctcaatgcaagctccacctcccggattccacacatttttaataacagaaaagagaaactgtgaaccccacggaccaaagctcttcccattcatgaacccacatcccgagtcaggattctcccctgacgaccctcccatggtccctgcaaaatctgggagaaacgcggcgctgccgctgcagagctgcctagaaagggctccaggccatggcacagtcactgcgagaggaagagacaggaggcctggcggcccggctgtcagcgcagtcgccatcttaaggctgaagggggctgaggccaacctgggcaaggagaacttggggcgcacattgtggagctgactgcgaagaggcctgagtcccgccacagtcacttcccaccagttccaccctgcccctcttcctgtctcgggatgtcggccgggcactctcaccatttctatgcttccagggtgtcctggggttttagctgtggatctcccaatacctgcaggtcacagggccacagaggctgggcctccaggagaataggacacagaccagtgaagacgagacctgaaacgccggctgcagctagagacaaaggccgcgccaaaagcggaaagccgtcctcgtcgctccagctgcgtgcctgattggacggtttccagcccagcgtctctgattggataatgctttaggtcccgcccctcaggccctgagtgacagaagatgtgatcagatgctgggctaagtgaagagagacagcctaagctgcagcctttacaggcagggcttccttcctgagctgacccaggccccccccagagcatgagaaaattctcttttgtactcactctccttttgaatgtattcaaaaggtgaacagaagtattttgctggcatattaataatacataaaatttttgttcaagagaaaatcaacgtttactttgttagtagtgtattatcaatactaaagctaatgtttttttttttttttttgagacggagtctcgctttgtcacccaggctggagtgcagtggcggggtctcgctcacccgattttcctgcctcagcctcctgagtagctgggattacagctactattgttgaaaaacaatagacaatcacaaaaacaagctgacctttttgtgttccttaagccctgtcctgaagagccctgtgactgggctttatgccaaacaactcgttactaaagagctgtggtcccagactgcaccgaagcttcatgagacctctcctcgtctgtgcacggacgagtggccaactctggagcccaggctgttgcttccctgtctggtggtgaatcctccacagtctgatgagggtggtgtctgactctggagctcaggctgttgcttcttggtctggtggtgagtccttcatagtctggtgagtgcgggtgtcccactctggaacccatgctgttgcttcctggcctggtggagaatcttccagcctggagagtgcggtgtctgactctggagcccaaggctggaaacttggggacgtcccaaatcccggaatggaaactcccccagttctcccccttggcgtgccctatctggtgagtttcgggggaactcatgacccaagtcataataggaatttcaagcctcataaagacatcatggttgaagcagaggtgtttcgtttccagcaaagcccaatagcaagctaacaattgctcctcgaaagggttataagctttgctggcctctggcagtttctgggtccaaaaccagaaatgtacctcttcccatcttgtttctgcctaaggctccaattagcatgttgatctaggacagttacttgcagttctacgggaccatcccaaatgggtcatagatccagggccagttgcactgcttgtttatcttgttcggaagccatgatctctttctctccccaaagtcatagcgttttctggtggctgcatgcagaggttgtaacatgttacccaagtggggaatatgatgtctccagaatccaaacaagccaataaatttctgagcctcatttttagtggtaggggttgcaaattctagtattttaggcttagcctttggtaaaatgaattatttccctgcatttcataggatgcaaccagcccctatcttgacacattatcttataagcagtaaggaaacaccatccactctgggagatcccctcagcgtctcctttgctgactggaattccctgcagcacttcacgcacaaaggtctaaattgcactaatttagattcccaattcttacaaagtccggttccccttgaccattcaattgccaagggagagaactgggggagtttccatccggggatatgggaagtcctcgagcctcccgccctgcccttgttgctaaaaagtggcacacttttgtttttgaatcctgtttgtgacaccaaaagtgttctgtgcgggaaacgcacgagggggagaaggaaagacacacacacaatacctttaagggtaaacaagcttcattccacgtaaatagcaatgcagatataataagcaaattatgtaataagcaaatcaatataataagcagattgatataacaagtagattgatataataagcaaattgcaatgggaagaggagaaaggaaaaaatatatatatatttacactcaccagactatggaggattcactaccagagtgggaagcaacagcctgggctctagcatcggacattgcactcaccagacagtggaggcctcaccaccagatgggaagcaacagcttgggctccagagtcggccgctcattcctgcacagatgagaagaggtctcatgaagcttcagcccagtctggtatcctagctcttttgtaactagttgtttcgcatgaggcctagtcacgagggcctttcatgacccggcacgaggaacataaaaatgtcaacttgtttttgcgattgcctattgtttttcaataactaatgcataggaatagattgaaatagagatttctccaaaacagcactgaatgaacgcttgaaggggctcacacaacctgttctgggactcggtgaccattgtttgtgtccacgttcaattgagttcaaatttattatttaacttttcctccacaaattcgcctgtcttgatgaatcagctctgtctaggcaaagggcaaggtgaacctcttgggccttacacaacctccacctcctgggttcaagcgattcttctgtttcggtctccagagtagctggcactacaaaagtgcaccaccacaacctgctaattttttgtatttttagtagagatggagtttcaccatgttggccaggctagtcttgaactcctgacctcaagtgatccacccacctaggcctcccaaagttctgggattacaggcgtgagccactgaggttatcactaaatgatatctttttgtttcctataacaatgtgaaattacttaaaggtggtttcaaattgaaaaaataaaaagaatgcagataaaaataaaatataaaaagttcaaaaaattacaagagattacaaaatatacatgtatatcttgagaggtcaaaaatgacaaattttgtttatttacaaggttgtatttatttatttatttatatttttattttttgagacaaaatattgctctgttgcccacgatggagtgcagcggtgcgatcttggctcaccgcaacctccacctcacgggttcaagcgattctcttgcctcagcttccctagtagctgggaccacaggctcataccaggaggcccggctaattttttttatgtttagtagagacggggtttcactgtattagccaggatggtctcgatttcctgaactcctgatccgaccgcctcagccttccaaagggccaggattataggtgtgagccactgcaccagctttataaggttttattaaaattggctttagtgttgataatacactattaacaagtaaaagttgattttctcttgaacaaaaattttatgtattattaatatgacagcacaatacttccgttcatcttttgaatacattcaaaaagagagacaatgaaaagagatagaattttcccatgctctggaatgggcctggctcagctcaggtaggaagccctgtttgaaaaggctgcagctaggccaggcccagcggttcacgcctttaatcccaggagtttgggaggccgaggtgggtggatcacctgaggtcggtagttcgagtccaggctgaccaacatggagaaaccctgtctttactaaaaatacaaaaaattaaccaggcatggtgccacatgcctgtaatcccagctacttgggaggatgagatctattatatctcacagggtttacaatttctcttttctcctattataaatttatgaggccagcggctgggcatggtgactcatgcctgtaatcccagcactttgggaggctgaggtgggcagatcacttgaggtcagaagttcaagaccagcctggacaatatggtgaagccccatctctactaaaaaaatacaaaaaaattagctgggcattgtggcgtgtgcctgtaatcccagctactcaggaggctgaggcaggagaattgcttgaacctgggaggtggaggttgcagtgagccaagatcgtgccactgcactccagcctgggcaacagagaaaaactccatctcaaaaacaaacaaaaaaaatttatggggccaggtgcagtggctcacacctgtaatcccagcactttaggtggtctaggcaggtggatcacttgaggtcaggagtttaagacaaacctggccaaaatggggaaaccccatctctactaaaaatacaaaaattagttgggtgtgatggtgaatgtctctagtccaggctactcaggaggtagaagtgagagaataacttgaacccaggagtggaggttgcagtgagctgagatcatgccactgtactccagcctgggcgacagagcaagactctgtctaaaaacaaaaaaacaaacaaaaaaacaaaaaaaagtatgagtgtctctgccaaaatggaaataatttaatcaaacagtgattcaagaattgtcgagcacccagctatagtttgtagtttgtggtccatgggaggagcttgaaggaaagacatttatagggtgcatgatgaagaaaactatattcaataattgctcaggtatggttatgtaggttcttaatttgttcaattaaggtggaaatttcctggttatgtaatcagagcttaattgacagtttatagttgcttaagcctgaattttgtttcccctaatgtaaaactttttttttttttgagacggagtctcactgtatagcccaggctggagtgcaatggcatgatctcggctcactgcaacctccgcctcccaggttcaagtgattctcctgcctcagcctcccaagtagctggaactacaggtgcatgccaccatgcccggctaattttttgtgtgtatttttagtagagatggggtttcaccatgttagccaggatggtcttgatcttctgacctcgtgattcacctgcctcggcctcccaaaatgctaggattacaggcatgagccgccacacccggccctacccctaatgtagtaattaaccaaaaaatgtccttgagtttagatttttttattttagaagtaggaatttgaggactacagcctcctcagtttatttgcctgccacataattattttcataccacataggggactgattttccatggcatttttcacatatgcctcaagggtaccccatgttcttcagttaatcattttaaaaaagcattggctaacactattgaaaagatttgttttctgtttgtaaatatttccagtgagaagaaaggaaagactaatcccctgacactgtaaggaaggagaccacctttctgcttgtctcaagcctcagaaaaagaaaagaggaagcaaaagctaaagaaagtcagaaatgagatcaatagttagacagctcctggccactccccagggctggtagttaaaaatcagctcctgacctaactgcttgtattatccatagatttcaggcattgtatgaggaagcattgtgaaattttctgttctgtccggattaccgatgcatacacgctcagttatgtaccccatgcttgctcaatcaatcatgaccctttcacgtggactcctttagagttgtaagcccttaaaagggacagaaatttctgtctcagggagccggcttttgagacgcaagtctcctgatgctcctggccgaataaagcctcttccttctttaacctggtgtctgaggagtttgtctgtggctcgtcctgctacatttcttggttccctgactgggaagtgaggtgattagtggttggtcaaggcagtcttttaggtgacttaggcctgtcctgtggagcatccccgtaggggactccagccagcctgagagacacggatcctgagagtgctcccaggtaggcaattgccctggtggaatgccttgtcagtgcagtgcatgggaggcccctgtggaggatcaatgcagtggctgaacactgggaaggaactggcaacttgagtctggacatctggaacatggtaagaccggtcttagaaacttgctcactccatttgaggggaagcatggcctgatcacccatgacgtgcctttatcggcattttggttttggttttgattttgtcttggcttaaattgcttggcaccatggttttggttttgattttgatacagtgtgaattaggcaagtgtgtgaccttttaccctttccttcttgtagtgtgagttttgtcttgtctctagagaaaaatgggtcagacacaaagtaagcctaccccacttggaactatgctgaaaaatttcaagaagggatttacaggagactatggggttaccatgacaccagagaaacttagatctttatgtgaaatagattggccagcattagaagtgggttggacatcagaaggaagcctggacaggtcccttgtttcaaaggtattgcacaagatatcttgtaagccaggatacccagaccagttcccgtacatagacacttggttacagctagttttagacccccccacagtggttgagaggacaggcagcagcagtgttagtggcaaaggacaggtagccaagaagaatcccactccacccatcgagggaagtcggttcctaaagttctgtctgaccccatatcagaagactcatggcaggaaatggcaccagtgatgcctcccccttatcgagatgagagacccccacttctgagcccacagcacctgtgcctccacaggacacacacacccctagaccacccagagtaaacaagagaggatgtgaagccatgggagaaacccctcccttggtggctcatttaggacctaagactggaacacagatgcccctgagggagcagtgatatactggagtagatgaggacaggcatgtggtaaaaagtcatgcctttgtgtatcaacctttcacctctgctgatctcctcaattggaagaacaataccccatcttatactgaaaagcctcaagctttgatttgctccaaactattatccagactcataaccctacttgggctgattgccaccaactgctcatgtacctctttaacacagatggaaggtgaagggtgctccaggcagcaactaagtggctggaggaacatgctctggccaattaccaaaatgtccaagagtatgtaaggttccaattaccaggaacagactcccagtgggacccaaatgaagggccagacatgaaaagactaaaatgatatagggaggccctcctagaagggttaaaaaagggagcccagaaggccacaaatgttaacaaagtctccgaggtcattcaaggaaaagaagagagtccagcacaattttatgagagactatgtgaggcatatcgtatgtatactccctttgattcagatagccctgaaaatcagtgcatgattaatgtggctttagttagtcaaagcgccgaagatattagaagaaagcttcagaaacagactgggtttgcaggtatgaacacttcagttattagaaatagccaatcaggcgtttgtgaatagagatgcgacgggtcgtagagaaagccgtaaagaaagtgagcgccaagcccggtgaaatgctgacctgccagccacagctattaaaggggttcccccaaagggctgaggaatgggggaccccggggaaaacacacagtctgactgaccacgtctgcagcgtaaccggtgtgcttactgtaaagaaagcaggtcatttgcaacctaccagaacctaagaccaggaggcaggtgagagagttcttaggagctgtggggatctgcaggttatggatcccaaactttgcagtactggccaaacctctgtaccaagtcacaaaggggggcatccaggaaacttttgaatgggggtctcaacagcagcaagccttccatgaattaaaagagtaactcatgtcagccccagccctgggtctgcctgacctgtcaaagccatttacactatatgtgtcagagagagaaaaaatggcaattggggttttgatccaggctgtggggccctggctaaggctggtggcctacctatctaaacaactggacagggtttctaaagtttggcccccgtgtttgagagccttagcagcaactgccctgctagcacaagaaacagataaattaactcttgggcaaaacctaaacataaaacacctcatgctgtggtgactttaatgaataccaaaggatatcattggctaacgaacgctagactaaccaagtaccaaagcttgctctgtaaaagtctctgcataaccattgaagtttgtaacagcctgaaccccaccaccctgctcccggtatcagagagccctgttgagcataactatatagaggtgttgcactcagtttgctcaggttagcaaacctgacctatgggaccagccttggacatcagtagacttggagttatatgtggatgggagcagcttcatcaacccacaaggagagaggtgtgcaggatatgcacctctggatgcttttattgaagccaaataattgcctccagggttcttcagcccaggaggccgaactcattgctttaacttgggccctagagctaagtgagactgtgaacatttacactgactctcgatatgcctttttaaccctccaagtgcataaagcattatataaagaaacaggcctgttaaactctgggggaaaagatataaagtatcagcaagaaatcttgcaattattagaggcagtgtggaagccccagaagatggcagtcacgcactgcagaggacaccagtgaactcctactacagttgctttagggaactcctgagtggactcggaggctcaaaaggcagcatccaccccttaccgggcatcaatcacagccccctttctccctcaagaacctgaacttttacctacctattctaagggagaaaaaaactttttccaagtggaagggggacaggtaataaaggaaggatggatccaggtatcggatgggagaatagctgtgccacagctacttggagcagaggttgtactggctgtgcatttaactacccatctaggtcaggaatcacttgaaaagttgttaggccggtatttttacatctcccatttatcagctcttgccaaaacagtagcgcagcgatgtgttatctgccgacagcacaatgcaagacagggtccagccgttctgccaggtatacagacatatggagcagccccctttgaagatctccaagtgaacttcacagaaatgccaaagcgtggaggtaataagtatttactagttctactctgtacctggtacctactctgggtgggtagaggcttatccaacatgaactgagaaagctcatgaggcaacccgtgtgcttcttcaagatcttattcccaggtttggactgcccttatggatcagcttggacaacaggccagcatgtgtggctgacttggtacagtaaacatcaaaggtataggagatcacatggacactgcatgcagcctaccaaccgcagagttcggaaaggtggagtggatgaatcagacaatcaaaaacagtttagggaaagtatgtcagaaaacaggattaaagcggtacttttaaccctggtactgttcaagattgatgcaacccttcaaagagaacaggatattctccctatgaaatattatatcataggccccttcctatattacagggactcccaggcactccacaagagttaggtgaaattgagttacagtgacagctacagctacaggccttaggaaatttactcaaacaatttcagcctgtgtaaatgagaggtgccccatcagcttattctccccaattcaccctttctccccaggtgattgagtgtggatcaaagattggaacacatcccccttgcgaccacggtggaaaggagcccagaccatcatcttgaccacccccccacagctgtaaaggtagaaggaatcccagcctggatccaccatagctgaataaaacctgcagcctctgaaacctgggaggtgagactgagcccagacaacccctgcaaagtgattctgagaagtgtttgtgtccctgggtacttgagattagggagtggtgatgactcttaaggagcatgctgccttcaagcatttgtttaacaaagcacatcttgcacagcccttaatccatttaaccctgagttgacacagcacatgtctcagggagcacagggctggggatagggttgcagattaaaatggagtctcttatgtctactttctatatggacacattaacaatctgatctctctttcttttccccacagaaaaatattcacaactcattctgtatgatgtaaatatagcactcaaaactgtatgtgttcttgttcatgccctcaattttatactttattatctagaaaaatatatatgaaccgatgtggcggatcttatgctgctcttttttctcagagttagagaatatattagagaatatttctgtgttgaaaactattttattggataattttagtcatcctataagtcagaaccagttctctttatgctcgcatttcaccttaagtcaaattgaaaattctgctcatggccatttaagtaaaggtgtgtgtgtgtgtgtttcagggaccactgcaatttagggatgtggccacagaattctctctggaggagtggcattgcctggacactgcacagtggaatttatatagggatgtgattttagagaaccacagaaacctggtcttccttggtgaggataacctgaatacataattcataatataccctaaagattttatttctctttttttgcagaatttttttagtaatttattcttttcataaaagagtttcagatccactttttccagaaaatcttcagaatttgttcatttagaaaagaatttcttcaagatgtttcatcttaatccagactttccacattcctgagttgagctgtattcttcactctaaattagtggtaattccagaaacttagtggcataaaatattgttgccccacctgaaaatctaattgccaccaccaatttttgattcagtagtaccagatagtaaaattaagaaaccggcatattgaaagtattcttccttcctttttttttctttctttctctttttctttctttctttctttctttctttctttctttctttctttctttctttctttctttctttctttccttctttgtttctttgtttctttctttctctttctttcttctttctttctctctctctttctctctttctttctttcttctttccttctttttttttccttttttttttttttttttttgaagagtttcactcttgttgcccaggctggagtgcaatggtatgatctccgctcaccacaacatccacttcctgggttcaagcaattctcttgcctcagcctcctgagtagctgggattagaggcctgtgccaccatgcccggctaattttttgtatttttagtagagatggggtttctctatgatggtaaggctggtcttgaactcctgacctcaggttatccaccacctcagcctcccaacgtgctaggattacaggtgtgagccactgcacctggctgaaagtattttctaaatatttataaatttctgttatgaattagtattttggtattaatttactagaatattttattatatctgctctgctgagcacatttagtaatgtgcttataattggagaatatgagcaagactcatgttatttatttttaataaaacaggtattgttgtcctaagccagacctgatcacctgtctggagcaaggaaaaaaacccttgactatgaagagacatgagatgattgccaaacccccaagtaggtgtgagtgaaaatgaatacaagagacgacagagataagaggtcccaaggtcaatgagaaagcaagtttttaaaatgtgattcaggaagctgtgttccaaaggaaatagttcctgggcagctgtgttatttgtttatttatttatttaattttgctcctacaaaggggcatcttctgtcttatgattttaaattctctaaggattccacttttcttttggtgagcttccttcaagttcacagtgagagccaaagtcctcttcatggcatataagagactgcacaggctgggcacattggctcatgcctgtaatctcagaactttgggaggctaaggcagtggatcacctgaggtcagaaattcgagattagcctgaccaacatggtgaaacctcgtctttactaaaaatacaaaaattagccaggggggttgttgggcacctataatcacagctacttgggaggctgaggccaaagaatcacttgaacccagaagacggagcttgccgtgagccaagatcgtgccattgcaccccagcctgggcaacagagtgagactccatcacaaaaaaacaaaacaagacaaacgaaaaagagactgcacaatctggctgcttttccattgttttgcagatatgcaaatatctatttgcattatttagagaaactaaaattatttttcatgttatctttttgcatcaggtctgatatgtgtgagagtaatagtttctgttgcacttttttgtttatttttttcagcacagtctattctgtttttattactataaagtcttgaaatatagtttgaaattataagtatgatatttttctgctttattccttttcctcaagattgctttggctattcaaagtttattttagtttcatgtaaattttagaattgtattttccagtactgtgaaaaaaatgccactgcaattttgataggaagtctattgaatctatagatcactttggataatatggtactttattaatatttattctttcaatccatagacaaaatattttaaaatttatttggatcttctttaattttttcattttttattgtaaagatttttacctccttggtcaatttttttctcagaaatttattacttaatgctacagcaaataagatttttttccctctattttgttagatagtttgttttaagtgtatgaaactgtagccaggcacggtggccaacgcctgtaattccagcactttgggagactgaggtgggtgtatcaactgaggtggggagttcgagaccagcctgaccaacgcggagaaaccctgtcgctactaaaaatacaaaaattagctgggtgtggtggtgcatgtcagtaatcccagctactcgggaggctgaggcaggagaatcacttgaacctaggaggtggaagttgcagttagtcaagatcacaccattgcactccaggttggtcaaaagagcaagactcctcaaaaaaaaaaaaaaaaagtgtatgaaaccctatatatacttgtatgttaattttgtattttgctaatttactgagtgtacttaatagtttagacagattttaatgtactgtttatggttttttatatacacaattgtatgatctacaaacagcaactttttactttttttatttcaatagtttttttatttctttgactaattcttctgccacatacttccagtgctacattaaaatagaagcactggccaggctctgtggctcacagctgtaatcccagcactttgggaggccgaagcgggtggatcacctgaggtcaggagtttgagaccagcctgaccaatatgatgaaaccccatctctactaaaaatacaaaaattagctgggtgtgtcgacatgagtctgtaatcccagcaactccagaggctgagacaggagaatcgcttgaggcaggaggcagaggttgcagtgagccgagatcacaccaatgcacttcagcctgggcaacaagagcaaaactgcatctcacacctacacacacacacacacaaaatagaagcattgacaatgctcacaatatagttttgtattggtgtctgaattcaatgcagcaaatacctcttcaagttttcacaaactgattttagaaggtaaagatcttttgttggcccttagggtgatgagatgccctctgaatttgtagtgaagaggggttgtagcttggtcacaaggctgctgggtctgcactagggtccacctttagttggcttgttacaggggctttggtagttgtaattctcattttatttttagacagactgaatatccttcaagactttgttccatagggcagacactagggcaggtttttgcagtcaggtctgcatatgctgggccttgtatcaggatgtggatgagtgtggctttcagtgagtaccaaagagcatttcctcaggtaactgtgtgggtttctatataggcagaactgaccataaactgtggctcaggtaactgaaactgagtcattgaattgcttcagggaccacagtaaaggccaaagtctgcaggcctgcctacatggctgtaagtgtgtgccttcctccaggtcagggaatggcaggacctctgccagactgtggctgggaaaagtttgggatggttacagagtaagttctgaattttcagtaggaccaagttggatgaatcttatcctggtctgtagccaagaacaggggtcctgtagtttcgcacctgaatgagggcctgccttctgaataaaactcttctcaatcttaagctttgacagtgtttcacaactccctccctggatctcaaatctctcttagaggcacttattttggagatggcatcttgctacataacccaggctggtctcgaaatcctggcctgaagcagtgacataaccttaatgtaccatgtagctgtcattacatgtgtgagccacaatgcataaaggcatttttgtcaggtatggctgatatatatacatacacatatatatatatatatacatacacatatatatttttattgtaaggggatatgaaaatagggcacttttagtcttttcatttttttctttttctttttttttttttgatgtggagttttgctctttttgcccagactgtagtgcaatggcacgatcttggctcactgcaacctccgcctcccaggttcaagcaattctcctgcctcagcctcccaagtagctaggattacaggtacctgccaccatgcctgactaattttttgttatttttagtggagatggggtttcaccatgttggccaggatggtctcaatctcttgacctcatgatccgcacgccttggccttccaaagtgctgggattacaggcatgagccactgcacccagctagtctttttatcttactgatgtcactctccttatacatttttactttctattttctacttcaagtttgtctgtaattttagattcagatatttaaaacaatttgttaaaatttgcatattatgcctgcagtaaattagataattagtgggcactccatatttactaaaatatttacttataaatttaattttgctgctggcaaaaaggaattacagaattttcctctactttcttcagcctatatctgaataacaacatagtttattttctaattgttttacatatcagagggtctaaccctattctgcaaagtagatatatatattttctatatttaacaatgtaaggctattctttgcttcaaagttggattacagcagtttcattttgtgtaagaatagcatatatttaaaacaaatataactctagtttcttttaaatgctatttattagaagtttctcattagaatcttctatttataattatactccttattctctgaaattttactgccacacagtgcatgccaatgattcaaaatactcacatttgatgagtatacagtaatagttaaatattccagttacctagacaattttttttgtttttgtgagtctgagtcacgctctgtcacccaggctggagtacagtggtgcgggcttggcttactgcaacctccacctcccgggttcaagcaattctcgtgtctcagctttccaaggagctaagattacaggcataagccactgtgcctggcctcagtgtaggtttcttaacatcagttttttgtgtctgttggctttactttcgtattacaattttagacaatttgcaattctgtttgtacagtttaagtcaatttgaggtttaattaagagataaattatgcatgtttatcacaatcagattacatatgtctgtgtgtttatttataaatgtgaccccaattttagttatggcttatcctatattctttcttagccgattttcaatggcagttttatcttgtctaagtgagttgtcatggaggtagtcttatttttaccatgtgtttaatgatgaatacatatttcgttttgtgagagaaacactttagtgatttgaaggtaattttcaaaaagatttataattctgtatttttttcagttttttttttaaagaatttttttttgagacggagtcttgctctgtcgcccaggctggagtacagtggcgtgatcttggctcactgcaagctccacctcccaggttaacgccattctcctgcctcaggctcccgagtagctgggaccacaggcgcccaccaccaagcccagctaattttttgtatttttagtagagacggggtttcaccgtgttagcctggatggtctcgatctcctgacctcgtgatctgcccgcctcggcctcccaaaatgctgggattacaggcgtgagccaccacgcccgaacaaaagaaatattttaaaaacacataaaatgtaccatcttaaatctattgaagtgtatatttcatggccaggcatgtttgtggctctcatctgtaatcccaggattttgggaggccaagacagaaggatccctggagcctgaaagcttgagaccagcctgggcaacatatggagacctttctctattaaaaaaaaattaataattgccaggcatggtggtgtgcacctgtggtcccatctactttggagattgagggggagtcaaaattgtgcctctacattccctcttgggtgacagagtgagatcctgtctcaaaaaaaagctgttcatttcaggaatgttaattatattcgcattgttatgcaaagacttctagaaactttacatcttgtgaaacttaaactcagtacccattaagtaacaactgctaattttactctctctccagccctagactggacaaaccttccactttctctttttatgattttgacttcttaagatacctcatataaatggaatcatacagtatccattattttgttactggattaattcaggtgacataatattctcaaggttcatcttaaaatatgacatgatttttttttaaggtgggataatatttcatcatatgtatatgttacattttttgatatgtttataaatcaagagacatctgggttgcttcagccttttgtcttttgtgaatactggcacaataaacatggattttcaaatatgtcattattattatagcaagtggggtattgaaatagcctagtataattatatttctctctatgtgcttattcagttttgttagtatttgctttatatatttgaaaccctaatttgaaacacagacacacacaaatacacacaaatttgtgataagttcccagtgaatgaatctatgtattgtttaatgcccttctgtgtctttttgaagttttgacttaaagtacattttataaaatatgacagtttttgacttaagatgtagcttttgtaatattattttgacctcttctgctctcatttcattaatatttacatgaaatttctacttccatctcaccacttacagtctttgtcattagatctgaggtgactcttgtagaaaggcaagttggatcttgattttcaaattttttttttttgagatggagtctcactctgtcacccaggctggagtgcacgtggtgcgacctgggcttactgcaacctccgccttctgggttcaagtgattctcctgcctcagcctcctgagtagctgggattacaggcaggcaccaccatagttgactaacttttgtattttttgtagagacagggttttgccatgttggtcaggctggtaaaattttttaaaaaggctttttattgaaagtatgtctcttgattggaaagataattatatatatttaaatagttttctgaaagaggaaaacttaataatttgtgtgtgtgtgtgtgtgtgtgtgtgtgacagagtctcactctttcatccatgttagagtgcaatggtgcaatctcagatcactgcaacctctgcctcctaggtccaagggattctcctgtctcagccacctgagtagctgggatcacaggcacctgccaccatgcctggctaatttttggtatttttagtacagatggatttatgccatgttggccaggctgggcttgaattcctgaccttaagtgatccaacttccttggcttcctaaagtgctgggactacaggcataagccgccgcacctgaccaatgttactttattaattgttttatttgattcttgtatctttgtctctcattttttctgcctttgtgtgtgtgtttttttttaaatttttgtattgatatgctttcaattttcttcttattttcttttgtgtatctatacagatattttcttagtagtgtcttggggattacacaaaacctctaaaagatccaacaatatgtttaaatgaggtaaaaaattaacttcagttgaatgcaaaaattcttcatgattacatctgccttcaactttgttattgattttgctaattatattatttatttatttatttatttattttttgagacggagtctcgctctttctcccaggcaatactgcagtggcactatctcggctcactgcaagctccgcctcacgggttcacgccattctcctgcctcagcctcccgagtagctgggactacaggctcctgccaccgcgcccaacctccgcctcccaggttccagtgattctagtgcctcagcctcctgagtagctgagattacaggtgtgcaccaccacacttagctaatttttgtatttttagtaaaggcaggctttcaccatgttgaccaggctaccttttatttgtttgtatatttctttcttcctttccttctttatttctagaagcatgttcgttttaaaatataaattatgaatattaaaaatcttcttttctctgtctttgattactattatggctgatttaaaaataagttttggaagaagagaaaacggcagggcggcagcggctgtaggttgtgcggcggcagcggctcttccctgggtggacgatggacagccagagcaggaaggtggtggtgtgcgacaatgacactgggtttgtgaagtgtggatatgcaggctccaactttccagaacacatcttcccagctttggttggaagatctattatcatgtaatgcccaaccttgttttttcctttatttacctagccttgtttctcccttagctaagagaaccagacaaactccatcttggctctttcactggcagccccttcctcaaggacttaacttgtgcaaggtgactcccagcacatccaagaatgcaattaactgataagatactgtggcaagctgtatccgcactccccaagaattcatctgattgataacgcccaaagccccgcgtttatcaccttgtaatagtcttaaagcccctgcacctggaactgtttactttcctgtaaccatttaccttttaactttttgactacttaacttctgtaaaattgttctaactagacacccctccccttcctaaaccaaggtataaaagttaatcaagccccttcctctgggccgagagaactttgcacgttagccgtctctcggtcgccggctaataaaggactcttaattcatctcaaagtgtggcgttttcctaactcgctagggtacaacaatcagatcaaccaccaaagtgggaaacattgaaatcaaggatcttatggttggtgatgaggcaagtgaattacgatcaatgttagaagttaactaccctatggaaaatggcatagtacgaaattgggatgacacgaaacacctgtgggactacacatttggaccagagaaacctaatatagataccagaaattgtaaaatattactcacagaacctcttatgaacccaaccaaaaacagagagaagatggtagaggtaatgtttgaaacttaccagttttccggtgtatatgtagccatccaggcagttctgactttgtacgctcgaggtttattgactgctgtagtggtagactctggagatggcgtgactcacatttacccagtattagaaggcttttctctccctcatcttaccaggagactggatattgctgggagggatataactagatatcttatcaagctacttctgttgcaaggatacaccttcaaccactctgctgattttgaaacggttcgcatgattaaagaaaaactgtgttacgtgggatataatattgtgcaagagcagaaactggccttagaaaccacagtattagttgaatcttatacactcccagatggaggaatcatcaaagttgggggagagagatttgaaacaccagaagctttatttcagcctcacttgatcaatgttgaaggagttggtgttgctgaattgctttttaacacaattcaggcggctgacattgataccagatctgaattctacaaacacattgtgctttctggagggtctactatgtatcctggcctgtcatcacggttgaaacgagaacttaaacagctttacttagaaagagttttgaaggatgatgcggaaaaacttcctaaatttaagatctgcattgaagacccatcccgcagaaagcacatggtattcttgggtggtgcagttctagcggatatcatgaaagacaaagacaatttttggatgacccgacaggagtaccaagaaaagggtgtccttgtgctagagaaacttggtgtgactgttcgataaactccaaagcttgttcccatcacacccgtaatgctttcttttttcttttattgccaatctttgaactcattcaactccaggatatggaagaagcctttctctaccctttgactggaaaggtcaagttttattctggtgtcttgggggagctttgttaaatttttgttaatgtgggtaaatctgaatttaattcaactgcttccctacatagactagagggctaaggattctgtctgctgctttgtttcttctaagtaggcatttagatattcctgtaggcttcctattttcactttacctctctaatgctgctagtcactaggtggtacgcatttattagcataagaaaaaaactttaacaggagcttttacatattactgggattgggggtggtttgggatgggtgggcagctgctgaaccctttagagcatttcctctgtaatgtggtgctttcaactgtactgctgcagctttaagtaccttaaagcttctcctgtgaacatcttagtgaaatgttaggttcagaactaaagtgttttgggtagattttgttgctggggagggtaacagtgggtggtctgatttttatttttgaggtttttcacactggagtacatagaggaactttatttacagtattttgatttggcaggttttcttctacttgtgctctgcctggagctgtttccatatgataaaaaaagcaagtgtagtattccattactatgtggcttagggatttatttgttttttaaaatcaaccacgttagctgggactagactccctacaatccttcaatggaaaagtaacatttaaaaatccttggccgggcgcggtggctcacgcctgtaatcccagcaccttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaatcctttgggtaattcaaattacagatttgaaagtgcttaagatctggtgttttgttaatgcttctgtttattccggaagcattaaggtaacccattgccaagtatcattcttgcaaattattctcttatataactgaccagtgtgtaataaaacaagcaggtacttataaataattactggcagtaggttataattggtggtttaaaaataacgttggaatacaggacttgttgccaattgggtaattttcatttttctttctttttttttttttttttgagacagcgtcttgctctgtcgcccaggctggagttcagtggcatgatctcaactcactgcaagctccacctcctgggttcacaccattcttctgcctcagcctccagggtagctgggactacaggtgcccgccaacacgccccgctaattttttgtatatttaatagagacggggtttcactctgttagccaggatggtcttatctcctgaccgattgggtaattttcattagttgttttatttgttttgatttgaaacctaatttgactgtttaaaatgttggccaaaaaaatcaagatttaaattttttatttgtactgaaaaactaatcataacttaattttcagccatctttgaagcttgaaagaagagtctttggtattttgtaaacattagcagactttcctgtcagtgtcagaaaatcctatttatgaatcctgttgatattccttggtatctgaaaaaaatatcaaatagtacccatacatgaattatttctaagtttgaaaaataaaaagaaactacatcacactaattacaaaatacaagtttctctcgcatccgtgtggagaccaacaaacaggctttgtgtgagcaacaaggctgtttatttcacctgggtgcaggtgggctgagtctgaaaagagagtcagccaagggagataagggtggggtcgttttataagatttgggtagataaaggaaaattacagtcaaaggggggttgttctctggagggcaggagtgggggtcacaaggtgctcagtgggggagtttctgagccaggatgagccaggagaaggaatttcacaagataatgtcatcacttaaggcaaggactggccattttcacttcttttgtggtggaatgtcatcagttaaggcaggaaccacccatctggatttgtatgtgcaggtcacaggggatataatggcttagctttggctcagaggcctgagaacaaattctggaaaaaaatatttttcttcattttaaaacttttttttaaactaataatggctttgaaagaagaggcttaatttggggtgactaaattcaaaagaaattattgacttgagggtctctgtttggtaagaatacataattagcttaaataagcagcaaaaggttagttttaattatgtaacttctgttaatattaagtgttttttgtctgttttacctcaatttgaaaagataagtttgcctgcatgctggacatgcctcagaacacatgaatagcccatactagatcttaggaacatggatctttgagtcactttagactaagttcttatataaatatccccagctttttgagaacagagcttgttaaaggatgcacatgtagggccagtacctactggcaattgtgttcagggaaatgggattgacttggccatttgtcctttggtcataattttaaaatgtgggagtaaaaaacaacaaagaattgaatggactcttaaaacaatgaaagagcatttatcatttgtcccttgaatgtagaatttgtttttgatttcataattctgctgggaaacgtgacagttaaaatggtgtattatgtatatatattataatttagaaataccattttataattttactattccaaggtgacataatgcatttaaatttgggatttgggtggagtattatgtttaactggagttgttgtcaagtatgaatccctcaggaaaaaaaaaatctgttttaaaaagcaatctgattcttagctcttgaaactattgttacttaaatttccaataattaaaaattttaaatttttaaattagaattgccaatactttgacctttgagaagggtttcttagaaatacatttagtaatgtccccaagacattagtcttacatttaaacttttttctttaaaacatggtattggtggttaacttttacacagttctgagttctgctaatatctggaaagtatcttgagatatcagtggaaagctaaacagtctaaatttaacatgaaatacttctttttgattcagaaaataaaatcagatttttttaatgtcaaaagcattaaaaaattaaaaaaacaaaaataagtttttttgaaattatctgcataaaggtttttgcttcattattgacataacttgagacaatacagaaatgaaaatgaacatttgttagtaaaacagcaattatctagctcctggtagtgatttaatctctcacctagtctttagaacttccatcaagacaagaactctttttttccaagagtgtgtgatgtaaaatcacactcttgtttttttgtctttgtggcagaatttgggtatttatggtaatgaaaaagaattctaggtctcttttcagaagaaagatggtgatgatggaagcaaatataatggtacttggtacttagccacatttcaaagcatgccagtacaaagctaaatgaagaaagtcaaataggaaatgagaaaaaaatagctcctagaaacacataaaatgataacaatataattaacaaacaatttttttttttttttttttggttttagacagagtttccctcttgttgcccatgctggagtgcaatggcacaatcttggctcactgcaacctctgcctccgcggttcaagtaattcttttgtctcagctttcccagtagcttggactacaggcacatgccaccacgcatggctaacttttgcatttttagtagagagagggtttcatcatattgatcaggctgatctcaaactcctgacctcagatgatccacctacctcagtttcccaatgtgctgggattacaggcatgagccacagcgcctggataacaactttatttctttaagcaattattttaaatataagttaattaaactacttaataaaataaaatgaaatgtaattttaggactttggaaggccaaggtaggctgatcacttgatcccaggagttcaagacaggcctaggcaacatggcaaaactctgtctctataaaaaatacaaaaaagctagcctggtgtgacggcacatacttgtaatccaggtatttgagagactgaaatgagataatcagcagactttgagagattcaagcagcagtgaaatatgcaaatcagcctggttggcacagtgagttccattctgaaaaataaatgaggctgggcatggtggctcatgcctataatcccagccttttgggagactgaggcaggcagatcacttgatgtcaggacttaaagaccagtctggtcatcatggtgaaaccccgtctctctaaaaatacaaaaaattagcagggtgtggtggcagacacctgtaatcccagctactcaggaggctaagccaggagaattgcttgaacccaggaggtggagtttgcagtgagcagagattgcaccattgcactccagcctgggcaacaagagcaaaactccgtcgcaaaataaataaatacatatataggctgggtacagtggctctcgcctgtaatcccagcactttgggaggctgaggtgggaggatcatgaggtcaggagttcaagaccagcctggccaatatggtgaaaccccatctctactaaaaatacaaaagatagttgggtatggtggcacgcatctgtagtcccagatattcaggaggctgaggcaggagaatcacttgaacctgggaaatggaggtggcagtgagccaagattgtgccactgcacaccagcctgggcaacagagcaagactccatctctcaaaaaaataaaaaaataaataaaaataaataaataataaaaaaaaggaaatagaatgcttgtgcggttttttaaaaagcatacgctatgctgcctacaagagattcatttaagcattgagtcaaataggctgaaagtaacagaatgaaaaaaatgtacattccatgaaaatagtaaccacgattgagtgcagtggtcataattatattagacataatatgctttaagtcaggtagtaccatgagacaaagattgacgttatattatgttaaagtgagttgatttaccaggaatctataactataatatttacttatctatatatatatgtgtatataacatcagggctccaaaatatataaagcaactattgacaaaagtgaagcaagacatacatagcaacataattgtaaacatcaaaaccccatttgcaataataaatagaaagtttagataaaaaataagaaacagaaaacctagacaccattatagactatattaattattttgcatatagatgaatatttgagagtgcataatttataaagaaaaaaggtttagatggctcacagtttggcaaactgtataagtgtgtgccagcatctgcttctggtgaggatttcaggaagcttaaaatcatggtggaaggtaaagagtaactggatatattatatggtaagagacagagcaagtgtgaggtgaagaagccaggttcttttaatgaaccagctctcatttgaattaatagagtgtaaactttttggttaccaagaggatgtaccaagccattcatgaaaaatttgcccctatgacccaaatgtgtcccaccaggtcccacattcaacattgaggatttatattgcagcatgaggtttggaaaacatggacatccaaaccatattatagaccaactagcgttcgcagacacacacaaaactccccagtcaaaaccaagataatgcacaatattcttattttcatctggtgtattttgttagggcacatagcaggttttattaaattttaaaatactgactgggtacagtggctcttgcctataatcttaacactttaggagaccaaggtaagaggatccaccaggaattatgaatatttttcagatggaaaagacatgttgagttagaagacacctctcaaatttttttttttttttttttttttggagacggagtctcgctctgttgcccaggctggagtgcagtgctgtgatctcggctcactgcaagctccacctcccgggttcaggccattctcctgcctcagcctcccaagtagctgggactataggcgtctgacacctcacccggctaattttttgtacttttagtagagaacagggtttcaccatgttagccaggatggtctcgatctcctgacctcatgatcctcccacctcggcctcccaaagtgctgggattacaggcggagccaccgcacctggccaccttttttttttttttttgagatggagtttcgctctcgttgcccaggctggagtgcagtggcacgatcttggctcaccgcaacctcggcctcacaggttcaagcaattcttctgcctcagcctcccaagtagctgggattacaggcatgcaccaccacaccaggctaattttgtatttttagtagagatggggtttctccatgttgaggctgatctcaaactcctgacctcaggtgatctgcctgcctcggcctctgaaagtactgggattacaggcatgagccaccacgcccggccatacactgtgtattttctaacaaaaactgaattaaactaggaattaaaagcaaaagtcaaactggaaagttcaaaaatatgtatatataaaacacttcaatatatttttgctcaggggtcaaaaaattttatttttcaaaaatgtcaatacaacctaccattaaaagataatacaaagttgtttgtcagaaatgtttatttatttacagaaatagcattgattattgattagatatatatcgttatggtttagggtatgggatatagtgtccaatgtggcattattagtttaatttatagctacttgtggcaatagtgaacagtttcaagacatgaatacatagttcaaagaggggagaaataactgcacttttattttcatctctctgaatttgataaccaaaaggacttgcattttttagataaaagttttttatttcccaaatctcaagatctaaattcaaaatttggagctgcacatttagggcctgaatggctggagtagcagcaggtgttacctgtacatttgtgagcactttggcaagaggaggaaggggaaagtggagattctcatgtctatatgtctactcaatgcacacacgttactctgattgggtttctgggccaaatagtttctgtatcagttccagtctgaagatacaagagtcagtgaaagaggtaaaatgattgattgctgccctgtgaagtttgtagaaatgtgatctagcctctctagaagtgactgcagaggactatgaatgccaactaggcagagacacaattctgcctgcatatttaggggacagcatgcactttgctgcacaactctgagctgactggaagcctgagagggaaagtctcctctagagtaaattctggatgtcaccttatgtgtttatatcatgtctggtaattctagacagtgtttggaaacaataattaaatgaaaatttttctccaccccagagaaactccacaataatagaatagaaagaaactgttttattacacaattgaacttgaatgtgacacggatcttcatcaatctgcttaagagacggaaagatggtcactataattaggccacaagtagaagaatttccagcaccatgtcatacatagttcatcctaaattcacctggatactgaagaggccatctgtgtatgctaattacttatattcaatgacaaaaacttttcacatcttcataataggatgtagtttagcagcttgaagccaggtgcctgctgaaggtaggctttcactctgctacaaaaatggttgaatagtgttctatctttttggctacttacattttagagcagtggctctgtactccctggcactgggctacagcactcctgcttgctttctcctggttgctagtgtcctctcttggcctctaccatctgccactgaggcacaaaccacagctcacattttatgtgaatcctatttgccacagcagcactctagtgtcacatcagagagtgaggcctgagctgcaggaggagagcctgcaggcctcctgggtagaattacaccttcacaatcatgagaatgtgagcagtgtttcagcgtcaatttctacgtatagagatgacaaggaaaagataaagctgaattttcagcatgagtccagatagtgatagctgcaaaaattctcattgtgacagcccaccttaatctgacaccatgggacactaatagggcttctgaaacacacacccaaagcattggagagaaaaatgagatcttgatctgagcaagattattttcatagaaaaatattataaagatcttaagaaaaagctcagattagatatgattgatcaagtcagtcaaaaaatattcccctaaaagcaatttctctctaaacacccaaagtgcacagctactctcagcatgagaaacatgagcttcaggaagaaagaaggcagattttcagaagaattttataaagttttttttccatctttggtgctctctcatctcctagccagtgaatggagttctatattgaaatacatctgacaacttccaacaacactttttgatgaagaaatagaatctgactgttttcatagagtggaatatattagaacttgtaggctgggcgtggtggctcacgcctgtaatcccagcactttgggaggcagaggtgggtggatcacgaggtcaggagttcaagaccagcctggccaagatggtgaaaccccatctctactaaaaatacaaaaaagtagccaggcacggtggcaggcgcctgtagtcccagctactcaggaggctgaggaaggagaatcatttgaacctggagggtggaggttgcagtgagccgagatcatgccactgcactccagcctgggtgacagagtgaaactccatctcaaaaaaaaaaataaaaataaaagaacttgtaacatagttaactgaatagctattattggttttgggtggccacatcacctgtctttatttttcctgtaatagcagcattccaatttagtgcaataaaagatactaaagttgtgttaattcataattatccctattgaataaagtaataaacatgtcacactaatatctactgtaacaatttggtagtaaattttctttggatattaggtataagtatctaagtatgaataattttaatgaactagtcataatgtatgtagcattttaaaaaattgcaactatagccaggcacggtgtctcacatctataatcccagcactttgggaggcctaagcgtgcagatcatgaggtcaggagtttgagaccagcttggcctatatggtgaaaccctgtctctactaaaaatacaaaaattttagccaggcatggtggagcctgcctgtggtcccagctacccgggaggctaaggcagaagaatcgcttgaacccaggaggcagaggttgcagtgagatgagattgcagcactgtggtctagccaggacaaaaaagtgagactccgtctaaaaaaaaaaaaaaaaaaaaaattcaactatacttcagttaaaacactatatttcaaaagtataaataacaatattaaaataacaacttaagtgattcattcaaagtaagtattgtggctttatattcatattatgtagaaaatactgtttacaggtcacgcctgtaatcccagcactttggaggagtgaggcggttggaccacctgaggtcgggagttcaagatcaagctggccaacatgagaccctcatctatactaaaaatacaaaaacttagccaggcatggtggcacatgcctgtaatgccaggtacttgagaggctaaggcaggagagtcgcttgaacctgagaggcggtggtttcagtgatccaagatcatgccactgcactccaacctggacgacatggtgagactctgtctcaaaaaaaataaaatactgtttaatgtatatgaatgcaatttgtttacaaaccctacacataactatgctaatcgttctgaagtaataaatagaaagcaagatacaactacagactctactgttcagtttatgcactgaactgtttttgctttcaccgtataagtccttcagcctgcaaatattgggtaattaccttggataatcagatttctttcaaagaaacttagtatctttcagtctttatcattctgtattgcaaaatttaatcctatctttgtgctaagcatctgtgtgctcttaaaatgagcatttatctaaaccatctgtgtctactttaaaggactaaaaatgaaaaagataaacttttcagaagcaaaaagaaagcaaaaaacctgaagtactagataaagataatctggagtctgaaaaaatgactaaaggtttatttaactgttaatataatttacatatatttcaaaaaagcagagaaaaatatctacatataatcaaaatgccttaagaaaagagagaatagtaaaatagctttttgatactttttaaagagtttttgaactcttggacacctgaattttgcacactatatgcacttaaggtgatgcttatgggagaaaaacacaagagagaatgatgttataaaaaaatccatgcatgcaaaagacctttgcaacagaatagagagaccagaaataatgccaccctcctacaaccatcagatttttgtcaaacctgacaagagaaaagtgggaagaattctctctttaataaatgatgctggaataactacctagcactatgtagaagacagaaactggaccccttcattacaccatatacaaaaatcagctcaagataaattaaagacttaaatgtaaaacttaaaattataagaaaccctgcaatataacctaaaaaatactgttctagacatagaaactggcaaagacttcatgatgaagcttccaaaagctattgccacaaaagcaaaaattgacaaatgggacctatttaaactaaagagcttcttcacagcaaaggaaactatcaacagagtaaagagacaacctacagaataaaagaaaatatttgcaaactttgcctctgacaaaggattaatatccagaatttattaagagctcaaacaagtttacaagaaaaaaaacaaacaacctcattaaaaagtagaaaaaaaatgaacatattcttttcaaaagaagacaaatgtgcagttaacaagcatgtgaaaaaaatgctcattgctaattattagagaaattaaaagaaaaaccacaatgagatactgcatcatacccatcagaatggctattttttaaatgtcaaaaaataacagatgctggcaaggttgcagagaaaagggaatgcttatactctgctggtgggagtgtaaattagttcaacagctgtaaaaagcagtgtggtgattcctcacagaattaaaaacagaattatcatttgactcaggaacctcataattgggtatatacccaaagaaatataaattattataaagacatatccacatgcatgtttattgcagcactattcacaatagcaaaggcatggacgggtcctgaatggctatctatgatagactggataaggaaaatgtggtatggtcagatgcggtggctcacgcctgtaattgcagcactttgggaggctgaggcaggtggatcacacggtcaggcgtttgagagcagcctggccaacataatgaaaccctgtatctactaaaaatacaaaaaattagccaggtgtcgtggcaggcacctgtaatcccagctactcacgaggctgaggcaagagagtcacttgaacccaggaggcagaggttgcagtgagccgagatcacgccagtgtactccaaccgaggtgacagtgtgagactttgtcaaaaaaaaaaaaacaaagaagaagaaattaaaaaaaaagaaaaacgaactggacctttaataacttcctctttctggcttaatattagccttagcttggagtctcttggttaaaactttaatttccatgtcagaggtattcacttggtgttgaaactaactgaaaaatccggtgaaactactcaaagtgtttacataagggaaggaaatttaaagtgctcacttttttttaatggtttttttttttgagatggagtctctctctgtcacccaggctggagtgcaatggcacaatctcagctcactgcagcctccacctcccgtgttcaagccattctcctgcctcagtcttccaagtagctgggactacagtcatgcgccaccacactcggctaatttttgtaattttagtagagacggggtttcgccatgttgggcaggctggtctcaaactcctgaccttaagtgatcaaaccgcctaggcttcccaaagtgttgggattacagttatgagccagtgtacctggctaagatgcttacattttattcctccataagaaaagcaaatatatctacttctttcagacaatatatgtattattttattatttctattaaaaataatgtagtaaaaaattagtcatatgagaaaacttgtagaagataccatgtttcatcacatataatttagcatttaattcagaaatcaagacaacatgatatagaactgagatattcactgtcacaaatttaccctgcaaaaagaggaactgatgttttgacaagtctatgtaactcatcaattatctaccacattttcctgtggaaatatgtttattgtctacagtcaaaacagaagagagattttctttctttcttttttttttttttttatggagtctatctctgttgcccaggctggagtgcagtggtgtgatcttggctcacggcaacctccacctcccaggttcaagcaattctctgcctcagcctcccaagtagctgagattacaggtgcctgccatcgcgcctggataatttttgtatttttagtagagacagggtttcactgtcttggacaggctggtgttgaaatcttgaccttgtgatgcatccgcctcgtcctcccaaagtgctaggattaccggcatgagccactgcgcttggctgatagctagcattcttaaagctaaggcttggaattctgtttgaaatcactcagccatagaaaacacctggccaggcatgggggctcatgcctgtaatctcagcactttgggaggctgaggcaggcagatcacgaggtcaggagttcgagaccagcatgaccaacatggtgaaacctgtctctactaaaaattaaaaaattagccgggcatggtggcatggtacctgtaatttcagctactcaaaaggctgaggcaggagattcccttgaacccgggtggcaaagctgagatcatgccacttgttggggtgatcagacccaataccagaccattgtggctatgaagtccagtggagtcaaaggaatgagaaaagacaggttaagagtacataaggtgggtccagagggccaaagctagtatggaaactgtgagggccccaagctttggaagcccacactatttattggtgatcaaacaaagaagcaggtggtgaggatgtgtggatgtgggggtaaacaggtgaggacataaggacgtgagggtagaaaggtaacagtgcatcaagtgtagctgtgacggtttagcattttctttgacacataaagagtatgctctgctgcttgagataatggagaacatatttatgagcctgggagagcaaccaacaagtctgtgcacattctagaggccacgaggggttttatgccctgagccttggattccatccaagccgtgaggggttttatgccctgggctcagatttgtgttttgtcagggcagccttccaccatttggcacagagtttgatgttccaaaggccatgagggattttagaccctggacccaggacatcttccaagactcttttatattatgacagacaagccagtcctgcctcagctcttctaccaacaccactgcacttcagcctggttgacagagctagactccatctcaaacaaaaacaaacaatcaaacagaaaaacacctgaaaatattcctaaggttactctgggaaagaaaaaggtaaataagaattattaactaatagaatatatgattaaatactaatttttgaaactcatctctattatgtcttttgtaaatattttcttatttttcagcccctactaataaaatgcaaatcacagtaaaaaatactgatacagctcagtgcagtggctcatgcctgtaatcacaacactttgggggccaaggcagggagatcacttcacaccagaagttttggagcagcctggtccctctctactaaaaacacaaaaactagccaggcaaagtgttgtgcacctagctacttgggaggccaaggaatgagaatcacttgaacccaggagggggaggttgcagtgagccgagatcaagccactgcattgcagcctgtgtaacagagtgaaaccgtcaaaaaaaaaaaaaaaaaaaaaaaaaacccgaaaaaacgaaaaaacctgaggtcaaaataagtaaagaaatcttttcaatgtacagacccaatcatccaacccatcctgttcacttacatgctcaataaccaccctcccaggagacactgctctatgccccagtgagtgccccaggtgcattttactttgtttttatgccatctcactggggtcagtttttttgtcttttggaattttttatttttattacaaaattttcactgtttttatttcactgtttttctgcccccactcaagaaaatccagggggcagaaattatttgttttgccctcaataccagcatttgattggctgaccagcaatgtgtatccaaaaaatggaagctaggttgggtgaagaaaatcttcatgtctcaaggggttagctttaaaaaaagaaaaagaaaaataaaaacaaacatgcaccaggagatgcctttcacctccaaggctgccacctgctcccttgagaggctacactccatacttcaggtggttctatgggagaaaatgacccaagagacaatagtcactagacacatagccatagccatagtgggtatcttggtttatccccagaaagtactaaaacccaggcccagaaaaaaaaaactgaaggatagctgaggacacatcaccctatgaagtttccaaagggtaatcttaacctaaaaacattctggtaagttctctggaaaaaaaaaagcaaaagagggacagatatttttacaatacagtgtcaggggattattctttgctttcttctcagggaaaatatttacaaacagaaaaaaatctcttcaatactgttatgccatgctttgtataaaatgattaattgaggaacatggggtacacttgaggcgctgcttggggcacatgtgaaaaatgccaggaaaaatcagtcccctgtgggatgtgaaaataattaagtggcaggcaattagactgaggatgctctagtacccagattcctacttctaaaaaaaaaaaaatctaaactcaagtgcattttttggtaaattactacattaggggaacaaaattcaagcttaaacaactataaactaccacttaaactctgattaaataaccagggaatttccaccttgattgtaccaattaagaaactacgtaactgcatctaaccaattattgaatttggttttcttcttcatgcaccttataaatgtcttttcttcaagaccctcccacggagaacaaactacaaactatagctagctggtctacaattcttgaatctctctttttgaggctgggcacggtggctcaagcctgtaatcccagccctttgggaggctgaggcgggcagatcacaaggtcaggagatcgagaccatcctggctaacacggtgaaactgcctctctactaaaaatacaaaaaattagccaggcacggtggcaggagcctgtagtcccagctattcaggaggctgaggcaggagaatggtgtgaacccaggagatggagcttgcagtgagccgagattgcgccactgcactccagcctgggtgacagagcgagactccgtctcaaaaaaaaaaaattatttgatatttttacagtgactcccaaaattttttttttaagacagactcttgctctgtcgcccaggctggagtgcagtggcatgatctcagctgacaacaacctcggcctcccaggttcaagccattctcttttctctgcctcccgagtacctaggactacagacattcgccatcacacccagctaatttttgtatttttaggagagatggggtttccccattttgtccaagctggtcttcaactcctgacctcaagtgatctgcccccctcagcctcccctagtccccacacaatctgggagagatgccacactgcgggtgcagagtcacctggagagggctccaggccagggcacagtcactgagcagggaagagaaaggacggccgggagcccagctgtcagcatagcggccatcttatggctgaagggtactgaggctgagctgggcaaggagaactcggaaagcagattgtggagctgactatggggaggcctgggtcctgccacagccattttcctgccaagggaggctgtgactgagcgggctacccagcctgggaaactgctttttccatggaactgtgcaacccacagttcagaagattccacttgtgaacccttgccactggagcctgagatctgaaccctggaggtgagcaattctcaacagcctctctcctagaatctgcttaagcctgccaagatcccgggggaggggtgtggggaaaagagagatcagactgctactgtgtctatgtagaaagaagtagacatgagactccattttgttctgtactaagagaaattcttctgccttgagatgctgttaatctgtaaccctagccccaaccctatgcttcctgagacatgtgctgtgttgactcaaggtttaatggatttagggctatgcaggatgagctttgttaaaaaagtgcttaaaggcagtatgcttgttaaaagtcatcaccattctctaatctcgagtacccagggacacaatacactatggaagttggcagggatctctgcctaggaaagtcaggtattgtccaaggtttctcctcatataatagcctgagttattgcctcatgggaagggaaagacctgaccatcccccagcctgacccccataaagggtctgtgctgaggaggattagtaaaagaggaaggcctctttgcagttgagacaagaggaaggcatctgtctcctgcttgtccctgggaatggaatgtcttggtgtaaaacctgatcacacattctatttactgagataggagaaaactgccttatggctggaggtgagatgtgctggcggcagtactgctccttaatgcactgagatgtttgtgtaaagtcaaacataaatctggcctacgtgcacatcaacgcacagtgtctttccttaacttatttatgacacagagatcttttctcacgtgttttcctgctgaccctcttcccaccattaccctatagtcctgccacatccccctctctgagatggtagagatagtgatcaataaatactgagggaactcagagaccagtgccagcgcgggtcctctgtatgttgagtgccggtcccctgggcccactgttctttctctatactttgtctctgtgtcttatttcttttctcagtctctcatcccacttgatgagaaacacccacaggtttggaggggcaggacaccccttcatctggtgcccaatgtgggtgcttttctttaggttgaaggtatgccagagcgtggtcattgaggacaagttgatgagagattcccgagtacatctatggtcagccttgcggtaagcttgtgcgctcagaagaacctagggtaacaatgggataaactgaaagtaaatatgcctcttagctttattaaaattcttttaagaagagggggagttagagtctctacagaaaatctaatcacgctacttcaaacaatagaacaattctgcccatggtttccagaacagggaactttagatctaaaagattgggaaaaaattggcaaagaattaaacaagcaagtagggagggtaaaatcatcccacttacagtatggaatgattgggcccttattaaagcagctttagaactgtttcaaacaggagaagatagtttcagtttctgatgcccctgaaagctgtgtaatagattgtgaagaagaggcagggatagaatcctagaaaggaacggaaagttcacattgtaaatatgtagcagagtctgtaatgactcagtcaatgcaaaatgttgactacagtcaattacaggaggtaatatatcctgaaacattagaattagaagaaaaaggtccagaattagtggggccatcagagtctaaaccatgatggccaactcctcttccagcagttcagatgcctgtaacattacaacctcaaatgcaggttagacaagtacaaacctgaagagaataacaaatagagaaagatagagtatctgtcacagcaatgccaatccaaatacagtatccacaatatcagctggtagaaaataagacccaactgccagtagcctatcaatactggccgccagccgaacttcagtattggccgcccctagaaaatcagcatggacagccaggaatgtttccagcaccacagggcagggcactatatccgcagcctcccactatgagacttaatcctacatcaccacctagtagacagggtggtgcattacataaaattattaaagcaagaaaacaaggagatatcgaggcgtggcagttcccagtaatattagagccgataccacctgaagaaggggcccaagagggagagcctcccctagctgaggccagatatgagtccttttctataaaaatgctaaaagatgtgaaagagggagtaaaaagtatggactcaactccccttatttgaggacattattaaattccattgctcatggacatagactcattccttttgattgggagattttggccaaatcatcactctcaccctctatcttttacaatttaagactttgtggattgatggggtacaagaacaggtccaaaaaaatagggctgccaatcctccagttaacataaatgcagatcaactattaggaacaggtcaaaattggagcactactaatcaacaagcaataatgcaaaatgaggccattgagcaagttagagctatctgccttagggcctgggaaaaaaatccaagacccaggaaccacttgcccctcattcagtactataagacaaggctctaaagagccctaccctgattttgtggcaaggctccaagatgctgctcaaaagtcaattaccggtgaaaatgcccataaggtcatagtggagttgatggcatatgaaaacaccaatcctgagtgtcaatcagccattaagccattaaaaggaaaagtcccagcaggatcagatgtaatctcagagtatgtaaaatcctgtgatggaattggaggagctatgcataaagctatgcttatggctcaagcagtaatgggagttgctttaggaggacaatatttgggggaaatattataattgtggtcaaattggtcatgtaagaaagaattgcccagtctcaaataaacaaaatataacaactcaagctactacaacaacagataaagagccacctggcctatgtccaagatgtaaaaaaggaaaacattgggctaatcaatgtcattctaaagttgataaaaatgggcaaccattgtcgggaaatgagaagaggggccagcctcaggccccgcaaaaaacggggcgttcccagttcagccctttgttcctcagggttttcagggtcaacaatgcccactgtcacaagtgcctcagggaatgagccagttaccacaatacaacaattgttccccaccacaagtggcagtgcagcagtagatttatgtaccatacaagcagtctctctgcttccaggggagcccccacaaaaaaatccccacaggggtatatggcccactgcctgaggggactgtaggactaatcttaggaagatcaagtctaaatctaaagggagttcaaattcatactggtgtggttgattcagactaccaaggcgaaattcaattggttattagcccttcaattccttggagtgccagtccaggagacagaattgctcaattattactcctgccttatattaaggttggaaatagtgagataaaaagaacaagagggttgggaagcactgatccaacaggaaaggctgcatattgggcaagtcaggtctcagagagcggaccggtgtgtaaggccattattcaaagaaaatagtttgaagggttagtagacactggagcagatgtctctatcattgctttaaatcagtggccaaaaaattggcctaaacaaaagactgttacaggactcatcggcgtaggcacagcctcagaagtgtatcaaagtactatgattttacattgtttagggtcagataatcaagaacgtactgttcagccaatgattacttcggttcctgttaatctgtggggttgagatttattacaacactgggatgcagaaatcactatgcccactccattatacagccccatgaatcaaaaaatcatgactaagatgggatatgtaccaggagagggactaggaaaaaatgaaaatggcatgaaagtcccaattgagactgagagaaatcaagaaagaaaaggaatagggtatccttcttaggggtggccactgtagaacctcctaaacccattccattaacttggaaaacagaaaaactggtatgagtaaatcagtggccactaccaaaacaaaaactggaggctttgcatttattagcaaaggaacaattagaaaagggacatactgagccttcattctctccttggaattctcctgtgtttgtaattcagaaaaaatctggcagatggcatatgttaactgacttaagagccataaatgccataattcaacccatggggcctctccaacctgcattgccctctccggccatgatcccaaaagactggcctttaattataattgatctgaaagatcgcttttttaccattcctctggcagagcaggattgtgaaaaatttgcctttactataccagccataaatagtaaagaactagccaccaggttgcagtggaaagtgttacctcagggaatgcttaatagtccaactatttgtcagaatttcataggtcaaactcttcaaccagttagagacaagttttcagactgttatatcattcattatgttgatgatattttatgtgctgtagaaacgagagacagattaatttattgttatacatttctgcaagcagaggttgccaacacaggactgacaataacatctgataagattcaaacctctactccttttcattatttagggatgcagatagaaaatagaaaaattaagccacaagaaatagaaataagaaaagacacattaaaaacattaaatgactttcaaaaattgctaggagatattaattggatttggccaactctaggcattcctacttatggcatgtcaaatttgttttctatcttaagaggagacccagacttaaacagtaaaagaatattaaccccagaggcaacaaaagaaattaaattagtgaaagaaaaagttcagttgcacaaataaatagaatagatcccttagccccactccagcttttgatttttgctactgcacattctccaacaggcatcattgttcaaaatactgatcttgtggaggggtcattccttccccacagtacaattaagacttttacattgtacttggatcaaatagctacattaattggtcaggcaagattacaaataataaaattgtgtggaaatacccagacaaaatggttgtccctttaaacaaggaacaagttagacaagcctttatcaattctggtgcatggcagattggtcttgctgattttgttggaattattgatcatcattacacaaaaacaaaaatcttccagtttttaaaactgactacttggattttacctaaaattaccagacataaacctttagaaaatgctctgacagtgtttgctgatggttccagcaatggaaaggcagcttacacagggccaaaagagtgagtaatcaaaactcagtatcaatcggctcaaagagctgagttggttgtagtcattatagtgttacaagattttaatcaacctattaatattgtatcagattctgcatatgtagtacaggctacaaggggtgttgagatagctctaattaaatatagcctggatgatcagttaaaccagctgttcaatttattacaacaaactgtaagaaaaagaaatttcccatttatattactcatatttgagcacacactaatttaccagggcctttaactaaagcaaatgaacaagctgacttcctagtatcatctgcattcataaaagcacaagcactttgtgctttgactcatgtaaatacagcaggattaaaaaacaaatttgatgtcacatggaaacaggcaaaaaatactgtatgacattgcacccagtgtcaagtcctacacctgcccactcaagaggcaggagttaatcccagaggtctctgtcctaatgcgttatggcaaatggatgtcacacatgtaccttcatttggaagattatcatgtgttcatgtaacggttgatacttattcacatttcataagggcaacctgccagacaggaaacagtacttcccatgttaaaaaacatttattgccaggcgcggtggctcatgcctgtaatcccagtactttcgaaggccaaggcgggtgaatcacctgaggtcaggagttcgagaccagcctcaacatggagaaactctgtctgtactaaaaatacaaaattagccaggtgtggtggtacatgcctgtaatcccagctacttgggaggctgaggcaggagaattgcttgaacctgggaggcagaggttgcggtgagccgagatcgtgccattgcactccagcctgggcaacaagagtgaaactccgtctcaaaaaaaaaaaaaaaaaaattattatcttgttttgctgtaatgggaattccaaaaaaaaaaaaaaaaaaaaaaattaaaactgacagtgggccagaatactgtttttaagctttccaaaaattcttaaatcagtggaaaattatacatacaacaggaattccctataattcccaaggataggccatagttgaaagaagaaatagaacactcaaaactcaattggttaaacaaaaagaagggggagacagtaaggagtgtaccactcctcagatgcaacttaatctagcattctatacttcaaattttttaaacatttatagaaatcagactactacttctgcagaacaacatcttactggtaaaaagaatagcccacatgaaggaaaactgatttgatggaaagacaacaaaaataagacatgggaaatagggaaggtggtaacgtgggggagaggttttgcttgtgtttcaccaggagaaaatcagcttcctgtttggatacccactagacatttgattctacaatgaacccatcggagatgcaaaggaaagcacctccacggagacggaaacaccgcaattgaacaccattgactcataagatgaagaaaaaggtcatgtcagaagaacagatgaagttgccatccaccaagaagacagagccgccgacttgggcacaattaaagaaggtgacaccgttagctaaaaaaaagcctggagaacacaaaggtgacacaaactccaaagggtatgctgcttgcagctttgatgattgtatcaatggtggtaagtctccccattcctgcaggagcagctgtggctaattatacctactgggcctgtgtgcttttcccgcccttaattcaggcagtcacctggatggataatcctattgaagtatatgttaataatggtgtatgggtacatggccctacagatgatcgttgccctgccaaacccaaggaagaaggaatgatgataaatatctccactggatatcgttatcctcctatttgcctagggagagcactaggatgtttaatgcctgcaatccaaaattggttggtacaagtacctactgtcagtaccatcagtagattcacttatcacatggtaaggggaatgtcactcaggccatgggtaaattatttacaggacttttcttatcaaaggtcattaaaatttaggcctaaagggaaacattgccccaaggaaattcccaaaggatcaaaagacatagaagttttagtttgggaagaatgtgtggccaagagtgcagtgatattacaaaatgatgaattcagaactattatagattgggcaactcaaggtcaattctaacacaattgcacaggacaaactcaatcatgtcccagtgcacaagtgagtccagctgttgatagtgacttaacaggaagtttagacgaacataagcataaaaaattacagtctttctacacttgggaatggggagaaaaaggaatctctactttgattggacttcagcgaagactccaagatggcaatcgccacctcggataccctaactcagcatttccgggttcacctttcctgttcccaccaccccgactaacgcacatgcccactagggcgtgtcacactcagaagtgtgaaactcaaccgatcccgcccctaccccgaccactcctcacccagcatccataaaagcgcgctgcacctttcgcacagcgtgacttcccctggcggaccagtgaacctcaccggagagctcaataaagaagatttttgccctctttgtcttgcctcttggccttattgatccacggtgcctttccattgcctttcatactccaagaccaaaaataataagtcctgtttctggtcctgaacatccagaattacagaggcttactgtagcctcataccacattagaatttggtctggaaatcaaactgtagaaacaagagatcgtaagccattttatactatcgacctaaattccagtctaacagctcctttacaaagttgtgtaaagcccccttatatgctagttgtaggaaatatagttattaaaccagacccccaaactataacctgtgaaaattgcagattgtttactagcattgattcaacttttaattggcagcaccgtattctgctagtgagagcaagagaaggtgtgtggatccctgtgtccatggaccgactgcgggtggcctcgccatccgtctgtattttgactgaggtattaaaagacattttaaatagatccaaaagattcatttttactttaattgcagtgattatggggtggcaaaagaattctacaagattgtggaattcacaatctggtattgatcaaaaattagcaaatcaaattaatgattttagacaaactgtcatttggatgggagataggcttatgagcttagaacatcatttccagttacagtgtgaatggaatacttcagatttttgtattacaccccgagtttataatgagtctgagcatcactgggacatggttagacgccatctacaaggaaaagaagataatctcactttagacatttccaaattaaaagaacaaatttttgaagcatcaaaagcccatttaaatttggtaccgggaactgaggcaatcatgggagttgctgactgcctctcaaatcttaaccctgtcacttgggttaagaccatcagaagtactactattataaatttcatattaatccttgtgtgcctgttctgtctgttgttagtctgcaggtgtacccagcagctccaaagagacagggaccatcaagaacgggccatgataacgatggtggttttgtcaaaaataaaagggggaagtgtggggaaaagaaagagagatgagactgttactatgtctatgtagaaagaagtagacataagagactccattttgttctgtactaagagaaattcttctgccttgagatgctgttaatctgtaaccctagcctcaaccctgtccttgcagagacaagtgctgtgttgattcaaggtttaatggatttagggctgtgcaggattactttgttaaacaagtgcttgaaggcagcatgcttgttgaaagtcatcaccattctctaatctgaagtacccagggacacaatacactgcggaagcccgcagggatccctgcctaggaaagccaggtattgtccaagggttctccccatgtgatagtctgaaatatggccttgtgggaagggaaagacttgaccatcccccagcccgacacccataaagggtctgtgccgaggaggattagtaaaagaggaaggcctctttgcagttgagataagaggaaggcatctgtccctgggcaatggaatgtcttggtgtaaaacccaatggtatattgtatttactgagataggagaaaaccgccttagggctggaggtgagacgtgctagcggcaatactcctcttcaatgcaccaagatgtttatatacgtgcacatcaaggcacagcatctttccttaaaattatttatgacacagagacctttgttcacatgttttcctgctgaccctctccccaccattaccctattgtcctgccacatcccctctccaagatgatagagataatgatcaataaatactgagggaagtcagagaccagtgctggcgcaggtcctccatatgttgagtgccagtcccctgggcccacttttctttctctatactttgtctctgtgtctctttcttttctcagtctcttgtcccacctaacgagaaacacccacaggtgtggaggggctggccacccctttagctgtgtgatagataagtaaaaacagcaccatctaattcataatgggaagggtgtttctttccataagctgttcctagagtacacaaaggatggagaattttaccaatcacaaatattttcctggattatctatccattttatatttccccatgtattttctttgttctatgcatttcttccatttggcttttcctggggtgcatcctatatattaaaccagtaaacataactacagtgtttttctgagttctgtgagtagctctaccaaattactgaacttcagggaggttttgggagtctccagttttcaaacagtgtgtcagaagtataaatgggcccatggggtttgtgactggcatctgcagtgaggacaaggttgtgggactgagccctgaatcagggtctgtgctgactctgggtggtgtcagaattcaaatgtaagacaatgagctggtgttgaagaattgtttgatgttcagcaaactacagattttgtgccagaaaaagcatatcatggaggcctggcctggaacaaaactctgagtgtctgggaatgggaggctctgctctcctgcacacaggctgtcacgctgcccgttgtcctgtgattccagctcttctcccagggtgacagaggactgaaacttacaggaaaggagctctgatgacagaccccttttctttcaactgcatccacaggattcccactcactcacaaacatacatactagacattgatgtgtccgcactcctcccaggactaggcaccaccctcaggaacttcaccatggcatttttgatccaaatgtttcttgccaagaactcacaagtgtctacaagtctcctgtcatatcctcactcccagacattgagccttgagcagcaacctgttttctccaccaacctaaggttctggacctcctgtttataatctcatctgcctgcattcacacagaaataaatcagagtacagccccacctgggccactagctgcagtgaaaatcagtccattcacctacattgcactctatcccatgcagggattttgtttttttcttttagcttttatttttggttctgtgtacacatgtgggatatacagctaaaattatgtcatgggggtttggtgtgcagattattttgtcactgaggtactacccgtagcaccaaacaggtctgttttctcatcctcttagtcctcccaccgtctaccctcatctaggcctcagtgtctgttgttctcctctttgtgtttttgtgttcttattacttaactcttacttataaataataacatgcatttggttttcactttctgcattagttttcttttatgtttttgttttgttttgatttttgagacagagttttgctcttgttacccgggctagagtgcgatagtgcaatcttgacttactgcaaccttagcctcccaggttcaagcaattctcgtgcctcagcctcttaagttgctgggattacaggtgcatgccactacccctggctaattttgtatttttagtaaagacagggtttttccatgttagtcaggctggtcttaaactcccaacctcaggtgattaccccgcctcggcctcccaaagtgctgggattacaggtgtgagccaccgctcccagcctctgaattagttttctgagaataatggtctctagcttcattgatgttattggaaaggacatgatcgttttgttttttaatagacacagagttttccatgatgtttatgtaccatattttgtttttactaaatcttttattttattttacttttttgaggtagggtctcgcttattgcccaggctacagtgtcatggcatgatattggcttacttcagggtcaagcaattctctcctatctcatcctcacaagtagctgtgagttcacatgtgcgttaccacgtctggccaatttttctttttttttttttgaggtggagtttcactctgttgcactccgttggagtgcagtgatgcgatctcggctcactgcaagccccgcctcccgggttcatgacattctcctgcttcagcctccagagtagctgggactacaggctcccgccaccacgcccagctaattttttgtatttttagtagaaacggggtttcaccgtgttagcgaggatggtcttgatcgcctgacctcgtgatctgcctgccttggcctcccaaagtgctgggatgacaggcatgagccactgcgcctgatcaatttttctttttgtattttccgtggacacaggattttgccatgttgcccaggctggtctcaaacttctaagctctggcaatccacctgccttggcctcccaaagtactgggattacaggcatgagccaccagatctgaccataccatattttctttatccaatctactactcataggcatttagggcctgtccttatctttgctattgtgaatagtgctgcagtgaacatgcatgtggatgtgtctttataatataataatttatatttctttggttatatacccaattataagattcctgggtcaaatgataattctgtttttagttctgtgaggaatcaccacactgctttttacagttgttgaactaatttacactccctccagcagagtataagcattcccttttctctgcaaccttgccagcatctgttatttattgactttttaaaaatagccattctgactggtgtgaggtggtgtctcattgtggtttttttaaaaaaaattttctctaatgattagcaatgagcatttttttccatatgcttgttagccacatatgtatcttcttttgaaaagcatctgttcatgtattttgcctactttttaatgaggttgtttaggtttttcttttaaacttatttaagtttctaataaattctggagattagacctttgtcagaggcaaaacttgcaaatattttcttttattctgtaggttgtctttttcctctgttgatggtttcctttgctgtgaagaagggttttagtttaaataggtcccatttgtcaatttttgcttttgttgcaattgcttttagtagcttcatcatgaagtctttgccggtttctgtgtctagaatagtgtttcttaggttatcatgcagggtttcttataattttaagtttacatttaagtgtttaatttatcttgagttgatttttgtatatggtgtaatgaaggaatctagtttcagtcttctacatagtgctaggtagttattccagcaccatttattaaatagagaattcttgctacattcctcttgtcagctttgtcaaaaatctgatggttgtaggaaggtggcattatttctgtgctctctattctgttgcattggtcttgtgcactcatggatttttttataacatctttgtctcttcttttttttttttttttgagacagagtttcgctctgtcgcttaggcagagtgcagtggcgcgatctcggctcactgcaagctccgcttcccgggttcacgccattctcctgcctcagcctcccgagtagctgggactacaggccacagcgcccggctaattttttgtatttttagtagaggcggggtttcaccgtgtcagccaagatagtctcgatctcctgacctcttgatccacccacctcggcctcccaaagtgctgggattacaggcgtgatccaccgcgcccggcctcttctcctttttctccataaccattctttgaagtgcatacagtgttcaaaattcagatgcccaagagttcaaaaactctttaaaaagtttgaaaacaaattttgctattctctctgcttttaagggattcagattatatgcagatatttttctctgcttttttgaaatatatgcaagcgatattaacagctaaataaatcttttgttattttttatgactccagattttctttttctggtacttcagatttattgctttgttttagcttctgaaaagtttatttttttcatttttagtcctttaaagtagacacagatttgtttagataaaagctaatttaagagcacacagaagcttagcacaaagataaaattaaatttagcaatacagaatgataaacactaaaagatactaaatttttttgacagaaacctgattatccaaggaaattatccaatatttgcagactgaagtacttatactggaaaaacaagaacagttcagtgcataaactgaacagtggagtctgtagttgtaccttgctttcaatttattacttcagaacaattagcatcattatgtgtagtgtttgtagacaacctgcattcatataaataaaacagtattttctttttttcagacagagtctcactctgttgcccaggctggagtgtagtggcataatataaagccctaccatcttggtcaggctggtctcaaactcctgatgtcatgatctaccaacgttattcttccaaagtgctaggattacaagtgtgagccaccacatctggccatataatttctacttcttttactttactaagtgtacatatttattttctaataaaattacctaagaaaggctgggcattgttgctcatgtctgtaatcctcgcactttgtgggactgaggcaggtggatcacaaggtcaagagttcgagaccagcctggccaatatagtgaaatgctgtctctactaataatacaaaaatttgccgtgtgtgttggtgcacacctgtagttccagctacttgggaggctgaggcagaagaatcacttgaaccctggaggcagaggttgtagtgagccgagatggcaccactgcactccagcctgtgcaacagagtgagactccatctcaaaataaaataaaaagccataaaaaaccctagcaaagcttaaaggatttgtttaaactgtgtattagtatgtagtataaatttgacagggcagtggctagaaaatattaaaattacagaaactctgggatttaagtttttttttttttttttggtaagcttagaaaaaacaaaactactagtactgcagtggcatagacaccagaattctatgtagggttgccaccttgccgcagatctgttcagattcaccctttttggaggacttatttagttctgatcctaccttggagtcctgcctcagataactgattagaagagatcagagttttggctggtgaatcctgttgcctttctagagctggtgcttacaatttcctgaaagccaaaagctgataaatgggataaataaggtatatattttagggtgctactatttaaatgttctattaaaaccagtgcttgcagagacattgtatttagaaacttgttttctatttctgcagatacagtacttgctccataagtcacaaaaaagtaaatataaacagaataaaatcgtgtctaaactacattaacctctttttatatctgtttcatctgcctatatttagcttttattctttataattttttaaaaaatttgatgacagagaaacacaagaagaaataaaaatgctgggccctttatctaaatcctggaaattattaaacccttagtaccagctcccatggtgttatgagaattaaatcacataatgtgttatgcccagcacagtgctctgtatcacactcttgagcacatagtacctgcttaataaacattgcattagtacatgtgtacatgttgttttttaaatccagacttattcagacattgctgcattctgtttcctctgtaaactttaaagagccagcaaagaatataaaactttaacatggagatggattgttcttgtttgtaccagaagtatttggttgcaacaagagtgctgagtgtaagggaccctgtgctgtgcctgcttctgtaactaatggtaataatgaaccaatggggagcaacaccagcatttataggggattgtttaaaacacccattcatggacgcttttcaaacctgcagaatcacattacataaagtggggccaaaattaccaagtgatttataggctctttaaagcttgagaggcaataattagcttagggattatcagcccaggcttctcattaggatcaaatggccaatttgcagaaatctcttgtgccctccccacagcttctgtttattgttctgggtggaagcatccatgttgttttaatgaagggcctcatgtgaatctgaggtgagaccagaatctggtatgaggatttcaaaatacattcatgagagttaagttccacctttggactaaagggtggtcacagggcctgttctctttgggtttagtagggacaggtcagtgtggtgcatatttccattactgtagcagaaattgctggtgtctgtggcaggggagggcacctcaggacaggaaaggagaaacttatattttcatcttcatggagcagctcattgtttctgaatctcttctgttttaaaggacagaaatgggtggatttttctgtctttttctgctggttgatgttacgctagctggtaaacatgtggcactgacacctttaaaggcatattctcaagatgcaggggtaatttttttagagaatctcatctgagaaggaattccagagaagtaggagatagaaaaaacaaaaaaggcttttcttcaggtaaacatgcctcagctgaaatgctgtgtccactctgcctcctggaatgccatgcatttagtacttgcaaacttttatttctctacttgtgtttttccttcctaagtagtttggtttaagtacttcttaaaattcttatgatagtcaagggtctctgaaaaatgtttctttcctgtatcccagagccttctcttctttctctacacaataacttcttatatgccatgcagatttttcaacaagtattcatgatttgcaatattaaaaatgttccctttctggctgttgaacatggaaagatgtggatactcaagatttctattggggaaaactgtggtccttagtaaagatggagaacatgtaaagttgaggctctattcctgtgttccattagctgtatgcagaacaggattaagaaattgcttatatatgtcaggtgtggtggctcatgcctgtaatcccagcactttgggaagtcgaggtgggaaggccacctgagatcaggagtttgagaccagtctggccaccatggtggaaccctgtctctactaaaaatacaaaaattagccaggcttgttggcaggtgcctgtaatcccagctactcatgaggctgaggcaggagaaccacctgaacccaggaggtggaagttgcagtcagccaagattgcaccattgcactccagcctgggggacaagagtgagacttcatctcaaaaaaaaaaaaaaaaaaaattgctcatttaaatgtgatggcatttattactcagaaatttctgaaaaaaattattaggagatacctgctctctagggtgctaaatgaagccgacttaaaattactactaaaaattacagagcataggatttatctgtattttgtggtttccataaaacaaatgattctttatgattaaattcagattttacttacttttttaaaagaggaatatttcaacagtgatgctgtgttctgtgtgcattagcacatcataaaaattagtcctaatgcagttaatgattcacttgcttaaatagccctctggcagattttttcactatgtagctagttatttttctcttcattattaagtatgtttatgcagctgatgtgcataaaccatcacatttaatctggcagctgtccttttttcttatttttatctatatatttttctttggaaaatgaaggttcttatctttgtttacaggtcagaaaaactgggaaaaacacaggctcttccacttactggctgtttgacaaaatatcctccttctttggccaaaaacattgacattattgatgagcttgttagaaattcaaaaaatcagactttattccagatcttctggaaaaaaaaaccctgtataacaaggtattcagcttattgcacatattaaaatttgagaagtgtcttctaactcaacatgtcattttcatctgaaaaatattcacaactctttccatatgatgtaaatatagcactcaaaaatgtacctgttcatgttcatgcccttaaatttatactttattatctagaaaaatatatgaactgatgttgtggatcttatgcttctcttttttctcagagttagagaatattttggagagtatttctgtgttgaaaattattttattggataattttcatcagtactataagtcagaaccaggtgtctttactctctcatttcaccttaagtcaaattaaaaatttcattcatggtcacttggtgaaaatgtgtgtgtgtatttttcagaggacattacaattcagagatgtggccatagaattctctctggaggagtggcattgcctggacacagcacagcggaatttatatagggatgtgatgttagagaactacagaaacttggtcttccttggtgaggacaacttgaatatataattcataatatacacaaaaggtttatttctcttttttgtagaatgtgttttagtaatttgttctttttataaatgagtttcagatccagtttttcaagaaaatcttcagaatttgtgcatttagaaaagaattacttccgtgcctcatgcctgtaatcccagcactttgggaggctgaggcgggggattacctgaggccaggagcttgagaccagcctggccaactaacgaaagtacaaaaaattagctgggggctgtggcacacacctgtaaccccagctacttaggagggtgaggcaggagaatcgcttgaacccaagaggcagaggttgcagtgagttgagatcatgccattacactccagcctgggtgacagagcaagtttccatctcaaggaaaaaaaaaaaagaaaaaaatttcttcaacatgtttcatctaaatataaactttccacatttctgagttgagttgtatttttcactctaaattagtggtaattccagaaatttattgacataaaatattgcaacctccctctcccctctcccctctgcctctctttccacggtctccctctgatgccgagccgaagctggactgtactgctgccatatcggctcactgcaacctccctgcctgattctcctgcctcagcctgcctagtgcctgcgagcgccgccacgcctgactggttttcgtacttttttggtggagacggggtttcactgtgttggccgggctcgtctccagcttctaaccgcgagtgatccaccagcctcggcctcccgaggtgccaggattgcaggcggagtctcgttcactcagtgctcaatggtgcccaggctggggtgcagtggcgtgatctcagctggctacaacctccacctcccagccgcctgccttggcctcccaaagtaccgagattgcagcctctgcccggccgccacccagtctgggaagtgaggagcgtctctgcctggccacccatcatctgggatgtgaggagcccctctgcctggctgcccagtcggaaagtgaggagcgtctctgcccagccgccatcctgtctaggaagtgaggagcgtctctgcctggctgcccatcgtctgggatgaagtgaggagcatctctgcccggctgcccatcgtctgagatgtggggagtgcctctgccccgccgccccgtctgggatgtgaggagcgcctctgccccgccgccccgtctgggatgtgaggagtgcctctgcccggccgcgaccccgtctgggaggtgaggagcatctctgcccggccgccccatctgagaagtgaggagaccctccgcccggcaggggccccgtccgggagggaggtggggggggtcagccccccgcccggccagccgccccgtcctggaggtgaggggcgcctctgcccggcggtccctactgggaagtgaggagcccctctgcccggccaccaccccgtctgggaagtgtacccaccagctcattgagaacgggccatgatgacaatggcagttttgtggaatagaaaagggggaaaggtggggaaaagattgagaaatcggatggttgctgtgtctgtgtagaaagaggtagacatgggacacttttcattttgttctgtactaagaaaaattcttctgccttgggatcctgttgacctatgaccttacccccacccctgtgctctctgaaacaggtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaatacaaaaaaaaataaataaaaaataaaaataaataaaagattaaaacacacacacacacaaaaatattgcagcttccacctgaaaatctaattgccaccaccaatttttgattcagtagtaccaggcagtaaaattaagaaacctacaaattgaaagtattttcttttttttttttttgagatggagtcttgctctgttgcccaggctggagtgcagtggtgcaatcttgggttactgcaacatccacttcccaggttcaagcaattctcctgcctcagcctcccgagtatctgggactacagatgcacatcaccatgctgggctaatttttgtatttttagtagagatggggtttctccatgctggccaggctggtctcaaactcctgaccttgtgatctacctgtcttggcctcccagaatgctgggattacaggcatgagccactgcaccaggcaaattgaaaatattttctaaatatttagaaattgctgttataaatttgtattttggtattaatttaccagaatattttgtcacatcgtctttgctgagcacattactagcttgtaattggagaatatgagcaagattcatgttatttatttttgataaaacaggtattgttgtcttaaagccagacctcatcacccatctggagcaaggaaaaaaacctttgactatgaagagacatgagatggtagccaacccctcaggtaggtgtgagtgaaaatgaatacaacagatgacacaggtaagaggtcccaaggtgaaagagaaagccagtccttaaagtgtgattcaggaagctgtgttccaaagaaatacttcctgggcagctgttttatttatttatttatttattttttaaattttgctctcacaaaggggcatcttctgtcttatgcttttaaattctctaaaaattctacttttctttcagtgagcttccttcaagttcacagtgagagccaaagtcctcttcatggcatataagagactgcacaatctggctgctttttcattgttttggggacacacaaatatctgcatgattttgagaaactaaaactattttttagttctctttttgcatcaggtctgaaatatgtgagagtagtagtttctgttgcatttttttgttcatttttgttcacagtccattctatttttattatgacacagtcttgaaatatagtttgaaattttaagtatgatatccttctgctttgttctttttcctcaagattgctttggctattcaaagtttgttttagtttcatgtaaattttagaattgtcttttccattactgtaaaaaaaaccactgcaattttgatgggaagtttattgaatctatagatcactttggataatatgaaactttaatgatattctttcaatccgtagacataaatattttaaaattaattttgatcttctaatttttttatttttttactgtaaacattttttacctccttggttaatgtttttctcagaaatttgttatttaatgctacattaaataagattttttcttccttatcagatagtttgttttaagtatatgaaaccatacatatacttgtgtgttaattttatattttgctaatttactgagtttatttattagtttagacaggttttaatgtactgtttatggttttttaaatataggattctatgatctacaaacagcaactg

SEQ ID NO: 811 - DNA, 80765 bp, Homo sapiens
cggcccaaagatctaagatcgattgctggaagtagtattcatcttgataacataaaaaggtttaggtctgctctgaattccagttggatcacattatgctcaaagaaaggtgctgaagatggtttggaattagcaactccctgggtagtgggaggcatgtgcattctgttgggaggacaggattgatcagagagaaagtcttaggtgtgtcaattacataaagtgaggaatgacgccaaattaagagaagtgatgtgtgttatgttagtgaatttagaaagagctccctgcttctaatttctgtgcagttaggcaaaaaggggaggagcccaaaagaggcatgtgaaatgctttcatcattttctcttgatctcaagaaacactagagtttgattacatttgtttaaattgggcagagtctaagggagacgccagtgcctcatgcatctccccacctgaaggaccccacctttcgacaatggtgtcatcatgaggacacaggtgtgtgtaaaactggcagcaaacccatcagacagcacccacctggccagctccatcctgtcccaggaaccactactattctcattatgtgtatgttacagactttgaagtggtcccacaactccaaaatataaaatatgctattgtcaatacaaaatattggaaagaaagctggataagttgttccacttttttcgcattctttttaaactttgctgtttccgttttagaagtttctgttgacacaccctcaagctagatatttgttcctcagttgtgcccaggctaccaggcttcttcatttatagacttttttttatagcattgtttaaagttctttcttagaatatccatctctctgcctacatcacccatcttttcctgcatggtgtctactttttccttcataactggtaaccagagttgctttaaattttcagtctgataatttcaacatctctgccatatctgtgtctggttctgatccttgctctttcaaaccacattttttttttttttgccatagcctgtcttgtacttttttctgttttttttttttttttgaaagccagacatgatgtactgggtaaaaggaacttgggtgagccggccttcaatgatatagtggtgaatgtggggagggaggagttctgtggtcctgaatgaggtctgttccctgggttgtgaatgtcacaactgcctctcagtattttctcctccttaggtgggatatgatggctagagggggctggagttggacattttcccttcaccaggccagttaagcttccatcaaaccccagctgattcggctatggtaaaacaatctttatgaatacaggtcttgccaggaagaattgaattcactgccatctaagtggttcctccccatcccccacaagaaagatgaggggaattttattgaatattcactgtgaaaacctggtatagttccaggaagtgagagccataaaattgtcctcctaatcccatacctgatccatctgctggagtgtttaactctgtgccttgtccacattgagccttcagcaattcatcagttacagttcagggtttttgactgtgtctggataaggtcagccggtggctaggatgcaaaagacaccccactgagtttctgggcctgggtttctgctcaggtaagacgtgctgctctgtatttacctgtgggtctctccaatttatgggggagttggctctgagaccttgcttctctgagcggtcgaaaagagtttttgatttttaagtttattcatctttctacttgttacaactgagtgacaaccacagcaggatgaggttggagtgaaatgggtaaaataagcctgtgggcattggggactgtagacatgtccttcctctgatcccctggtgagtcagtggagagagtgaaaccacctttgcaaagattacagcagcgagatggagctagtatggcagacttcatcttacctctagctggaggctggctgtccttgctcattcatgggcataggccaggttaaccatgggaggaatttagtttacagtgtaattttgaagcaagaatgataatatccccttactaaaataaactccctcctactcaaggatggtctttgtcaaagtaatacaagaccataacattaggattataggagggaccaaaatcctgctaaaatgtagtcatagtttctataatccattattgctcaggagtcatgtggccagcagtcacaagacttgtgatttctttaattgctcctatagataacatcactattatagattatgagattggtcttttgagatatttctcagacttgcattctggcaaccagctggcctcatccagacccgtgagcaatgcctccagtcatgtggcccccagtcagaggcagatcaaacacacagagacgatttcccccacctgcatgatttcattcccatccaatcaccaggacccattccttagacctcaaactttttgaaaaactccaaccctagccattggggaggttgatttgagtaataataaaataagctcctgtttggcagccttgggctaattaaaatctttctttactacaaatcaccctcttcataaattagttttgcctgcgcagggagcaggatggacctgtcggtcttcctgtcaggtaattataagagtggatggagaaaccactcatttctatctggtggcctgttccatgagtcagcctctcagaaggaaagagccctggaacaggatacagtgaaagctcattctcctggtgacctgaagacaatggctcataatggagcctggcggaagtggcaactctggctaatttcagtgttttttttgggggtggggagggggtgcagtcaggccacagtgtgagcagaaaaggagcagaatagtcagcttttgtctgaggaagtccaaagcatggagaaagatgtgctggacagggcatgccagctagaatgaaggtggagccgggggcagaagatgagggacacagaggagcagagggagccagagacacccatggcagggagcagtgaccccagtgaccaggggcccccagggtctcagttcagtaccagggatccctgaaagccctcccatggcctaggaaccctggagtcacatgagacgaggtagctttagggacagggagtaagagggaaggaacatgggtctcagcacccaagtgatagggaacaggtgtggccagaaacctctaggattctgcatccaggatccggtccctaaagaggttatgaatcattcattccttcattcaatggctccttccctcatgtgagaactacagagtgtgtatctcacactgagcctgtgttagtgtgaatggggagagaaagccaagtcctctcctttattctttcatgggaatgatactgactctttggaaaacacaggatttcaggttccatgaggaggattaggatctgagggaaaggtctggacattcctcctactggctctgacagttgaggcaggtgatttagttctggagtacaaacgaatcagtagtccatttgctctcactcctctgaggtttggatgcctaagaagaaaggatttgagccgacagatgaccatgggctccttagaacttaataagacctcacttctcatggaggagaggatggaggtgtggttacagaaagacctcgtgtgactctgatctgcccctcatgtttgtgtgaccctggttcagtgactgtgtctccctgtggctcagtttcctctcaatcatataagctaaatggtaaatggtctgtgacttgtcgtgttgactctgaatgaactttaaattattcacagtcacctgacctaacgcttggcatagaggaggtgttcacacaaacagtgtttattatttgccttcatgagtgagcaccctcagacctgatccctgtggacaagttgctgccgggaacatcttgtctcttctatttctgtcccaggggacactgaactttctatggggtctcctaagcctcccagggcagttggctgatagcctaagaagcttgtccatctgttcactctgagtctcaggtgaaagagaaggctctgtctttgaccagatgaggctcttggggctgaaccctgcctgggagcagctccagagccacatccatcatacagctggtcaatacttgctcccagtcagtcctgctcaggaggccacaacccagccctggcacaggttttccagggtcacttggattcaggatctgaggactgggttctggggccagggcttctaggcttctaggactgagcttctctataaggatcccaggggacccctcaaaccgggccctgatgtagttctccagggtctttttccgaatcatgttcatgggaagtgcacagggtgatgggctgagactgatctcctcctgctgagtttcccccatcagattgtcctttctctgcagcacgtgtcttcagagtatggatgcaggaaatgaattctgatccattgaaatttgtctaccctgtgtgtgtcctgcactgaatgcccaaacactaaaatgggacataatgcagagggggacacaggcacagcccaggcctaacaatcctgtgggtgcgtgaagtagaactgacccccaacacccagaggtcatgaattcctcacggtgtacacggaaatatccagttgcttcttcaatggtaaaatctgtctttatgatttgtagggtatagaatcctgtgtcatcctgggtgactttccgggtcagcagggatgcattggcaaatattacctcctgactactgtatgcaggtcctgagctagatctttgaatgcctgttgcatatcctaaaattcaatagtagagatccacacttcttcctttgtgccaattgtagcccatcactttcaggggcagattgtgggcaagtagaaaaaactcctcctcctcctcctctgtggcattgaatggcatggcttcagtagtgactctggcagtggtgggtgggttccagaaggttaaaagtgaggctaggatggggagggagcatcagtcaatatcaaaacctatgtattgggatggaaagttggggccctttgtccttagaggttctcttcacccatgagccttggagagagagagaatgtgtgtgtgtgtgtgtgtgtgtgtgtgtgtgtgtgtgtgtgtgtgtgtgtgtgtgtcctgctgggtcaaggtcagcagcatgacccccattccttcaacacctctgaacttggcatttccctgtgtggaatcctcttccccaggggtctgcatggttccctttccactgacctcatatcctgctcacatcagggcatccttgaaagagccctttcttgacacctccactagagattctgggtcttccctttctcacttttccctgctcagttttctccagggctcttgtcaacacctgacctcacattctagatatccttgcgtgtctcgctcccctccccataacagcatcaggttcatgagggcagggacttgtatgatcttggttgtaccgcagtgcctgggacatgctgtggactcttgtgaatgagtttgtgagcattcccagagccctccaaggcctgtgatttatttcccaatttctgaagttggtggctgatgacaatgccttataccctcactatgtttttatatgaagtgttatctgatatagttattatgatcatttttcaaaatgtagtggccagtgatgattaaccgggaatagagaacacttgagatttgtttgcttcttaccataaatttcagttcaatgtgattttcctgttttaatcctgtcccttctggtgtcctcttttctgttaaggcagcagtagaagctctaagtcctctttccccaggagccccattttccccaggagacccaagccagtccctgtgccttctcatttcctcttcaaggaagttctctcctcacctgtgaacatgagcttctgccagaggatgtgccatctggagaaagggactgataggggggcaccatggtctgtgctgcctgcttgtcctcctctgtggagatgagcctgggatccggaaagtttctgagcagggctgtcagctgggctgtccttccaccttctatgctgagcctcttcctggggcaggagcacttctcaggctcatgggtggggtctgtacccaggacacctctctgtgccctcccctctcagtcctgcttccttgtccctcctttctgtttctcttctgtctgtgtttcaggcccctgggaattgctgagtcctctgcctccttcagcagtgattctctcacccaacctctacacacactatgtgcagacacacacacacacacacacacacacacacacacacacagacatcctttaggtttggtaagcacagccctgggccctcagtgtcctcccatttccattgctccaggtcagggtgcacagtcgctccccctgccctctcccattcccatctggcttttctcttcaaagcaggaggctgggctgcaccatgaccctgtcacagtgatgcaccctcaccttgctttgggtgggctgagtgctggctggtgagaaggaccctccctctctttcattatgttgaactttgctacagcttccatggttagacattcgatgacccggttgtccaagagggtattttccttcgtggaggtgtgcaggatcaatctcttatgcctcctggtaggaaaggcctgtgctgattggtcagtggggcctatgggcccagtgttcaccagggacaggtctcagccactctcttggtccctgggttctggtggctgagctggggtgaggcccatccattttcttcctgaccatctttggtgtcctctgtccttggcccagctgactgtcctgtggtcaccccaccttccccacggctggtgcaaaagggagtggggtgatgcccagggtccccacagaacacagctcttcaagacccagagagagagactgggaaagaacaggggctcagagctggagagatttctgcagacttactctgcagccaggatgggcttagcccttcttgctatacatcccttggggttcctcttgagggattgaggcagatcaagctcctctgtgtagaagaagaacaggcagtggctggagagcctgcgtgaagggactttgctcacacctgagagggtgtgtgggggtgggccatgttctgagaacaaaaggagctcataccccccacttcaccttccccatgcacaaaggacagccctgtcttccctcccagcttcacgagagacagcagggggcagattgtgggtgagtagaaaaacctccagcaggtggccacatcatggatggtgcctgtgcgtgaccttcaaacaccctctgcacctcctagcgtgcaatgggcaggtcatagggtgcctggctgattcctaggaatactgtgggcactcaggcagctgctgttctgtgtcagcactgggatcagcctgggataacctagagaaccgtacagagggagtggggtgggaatgtagggagcagtcacagaaaaagttgataaggatggaaagaggtcacaagggtaaagtgcctaatatggcatcatgtggaccatcgctgcccttgcagatgcccttttggctgggtcagcagcccctggggagtcttgtggctgggattctgccatcctctggtgaacatgggggaaatttggatgacagcagccccaggcaaggctgcatgttttattccatgtgaatctgcacatttcacagcagattattcacctatgtcacagatccatcacattccagccccatgagtctcagtctctgtgactgtaagttcactatcctccctctatcacaatcagatgtcccaaacacagatttctgtcacctgtgagtttgtgtttgtgtgcagtgggctgcactgtgtatgccctggggacagtgatgtctgggtggggctgagcactgggcagaggtttggaagcagaagagggaggtgcagggcaggaagatcaatgacagaggagcagagagggagcagggacaagtcatctttgtttctcactcccaggggaccaagaatgcaggaccctgaccttagggctcaacaccacacactgttggtgtccgtggatgtcaccagtgctcgtaatttcatgttgccttggcattcatttattaaggtgtaagtttacctgctttatatcagaggcagggcttggtcaccgtgacagttcccaatactgtacctggccaaatggctgcagttggtggccagagataaaatcttagaggcatctctcctgcttagtgtgctgggctccccctctacccagctgcttcctttaaactgacggttgtgaaatttgccctgaaatttaaagtgaccacctctcagtcacagcgtggtcacctggccccagtgtttgcttgctttaaactcacccattaaagctttctgctggaaacctcagctaacgccttggacccactaaagccattggcctacaggtccctactttcctctctgcctggactccttgacctctgtgtctattatctctaggtgtgccatgtgctcctcagagtctgtaaatagcaaaaaaaaaatttgtactttcacattgtggttgtatcactatagcctcacctgccatctggtgcctgacattgaggctgccccatgggacccatgctggttgagcccctgctggagctcttttcttggggtctctggtgctgctggggacaggcactgtcaggtgatttgatggagaaatggaagagttttattcaaaacagtgtgtcagatgatgttttcatgggcttcagctgctgtaacaaacaccttagtctgggtgacttaaaatttagaaatctatttctcatagttctggagcctgggaagtccaagttcaaggttccagctgattcagtcctggtgagggcttccttgcagattcctgctctcttgctgtatctgcacatggtgcaggcttgaaggtgggtggagagacagaaagaggtagagacccttctcccatgttttcttctatttataaggtcattaactctatcatgaagcctccacttttatgacttagtcttactgtaattatctcccaaaaatgccacctccaaatttcatcacattaaggatgagggctttaacaattttgagggggcacattctgtctggagcaggaaaggtgggagctccttcccctcctgttcatgaggcctgaccttccctggtgagataacttcacattcagtctcattctaggttgcagctccacagagcctgggttctcctctgctcttctgcccattcctgggttttccttcttgcaccaccttctccctgtggccccacctgctcctgttccaggcagctgtccttgcgttgctgctctctcaccatctctggcctcactggcctctgcctttttttttctcagccctgaggccagctccatgggagggaggaagggtgaagctgggatgggttctgaccaggttgctgcccgctatggaagcttgacaatgagggacgctgttgtgtcaccatggaggagtccttaggaaaaggctatttctcaggggtgcctggatcaaaaggggggtggcacttttaatttagctggatctgtgaactacagggactctgctccatgtcagcaaccagcacctccaacttttggtttctctctgtagctgattgtcttgcctgtgataagatcctcctcacaatgactgatggtcacagccgtgtgtggaaacttaatggagggtcttgaatgctcacacagagtgtccagggaacatgcttcctgatgttgagaacgggtgctcagtgtcataaagataaacactgagacaaaggatctctcagaaaggctagtttactttctgcagaaagggtgtcactcgctagcagtcttgccatgacagcacacacaaacaaaggagacagggtcatttataacctgacccgtccaccctactgctatgtccagcttctattggctggaacggacctcccaatttgtacttgacttgattggctagcaacttagaactttcccaaagaggcaaaggcagagaataaaggaagagaggaattaacttgtggaatgctgagagaggcaaaaacattttcaagtagggaaaggaataagcctgacctaatgcttgcttggactggttcaggcatatcagggcaaatatctaagctaaaatgtggggtctaagaacacagagtatattgatttctttattatggctggcagaatttaagaatattagcacaggtctttgagaaaattgtgcttttaagagaggttactatttattttcaattagactgggaggaaaatccctttgaagaggacctctatttatttcattctctacaattctcccctcttttattttataattactcttcaaacttgtttaatatgttttgacttaattgctctgtttgtccttttaagagaagtaatctttttgaatatggtggagagttaggaaacaattttgtgagagtagcagggacaagtttttgtataaagctttgaaaacatttttatttatagttacccaccagaacaacaaagatttaaatctcacagctatttgatttcgtgctttaaatttatctggcacttcttgcgggaccccaatagtgtttatgtaaacctgaggattaaaggatttataaagagtttctttgggcctgcagtgttttgtttttactttttttttttttaaggctgataaaatgccagggtgaaagggatagccaattggattagagcataaatactcctccaattatctggcagagtgtccagtaaaggtccttcacagtactagcatacatttgctcaggggtggctaagcacagactgatgggcaagctcctggaaaggcttgagcttcttgcatccttttatgcttccaaggaacaccaaattctccacttgccatgggaggcacgaactaaacttggcatttagaggtggaagctggattgcccttgggggctgacccacagggtgtcaagctttaggaaacagcagagagagagctcagcatgatggattatcccaagcagtgggattttggtaggatttagcctgtggtagaatcctcctcacaatgactgatggtcacagctgtgtgtgaccatatggtccatacctggttgatgaggagaccatccgagtggaaaggggacaatctgggcgtctgtgcacaagcataacaatcactgttatttaaagtgcagatggaatatttaatccattccagccgggcatttgcattttgatacattgtcttaatggctaaggtttgttttagatctttcacctttgcaatagacaccgtagttttattataggtgtaggagtaagtgggatgggatctaaaactgaggctactgaagaaggggaagatggggaataatgcatatctaaaaaatgcatagggggtgtttcccatttaggtcgatccccataccatagaagcaactaagagtaggtttagagtcagttaaggtggaggtggtgatagagagaaggacagtgttacactgataaggctggcaattagaaggcgtagtccctttagtgaggggttttagatctgcacaaacctcttccgtggaagtccaaccttgcacctgagtagtccataggatgtagtcccagctactacaaggttgccaggctataggagcagaaaattggtgtctcggctgcaggtattcacaaccatgagtgctaggaggaactatgtcaactagagggccggagcataaatatttgtgtgaaaaagctagctgtcattgatccttcacatctttacaaggtatgacagagcatgcattaaaggcaatggtctgagatgagtcagacttagttatgttaataacaaaaggagctagtaacagaataaggaaaggaaaggaagcaatatagaagggatatggaaattaagcttttggttttttttaactttaacttgttaaggcttgatcccggtacactaacctatgattctgatgaggaagatgatttcttgacttaagtatggtgggtccatcttctcttggctgtgcggatggcagtcttggtggtcaactgtacaggataagggccttcccaggcgggcacaagtttcccttctttttaccctctgatgagaacatggtccctgggttagtgctggtgagctagaaattctagcggtggtgtctgtgctaagagatcttttatcttaagagaagaaaaggtagcggagagaccaagtatataatttctgaggaactgatccttagtttcaaacataggaacattagctgaggaatgtaaataaggcaatccatataacattttatatggagacaggcctgtatccttttggggagctgtcctgatccttaataaggcaatgggaagacatttggtccatggtaaatgagtttctagaattaatttagtcagatgattcttaagggtttgatttattctttctacttgtccggaggataagggatgccagggaatatgatattcccattttatgtctagcacttgggccagctttttaataatatgtgcagcaaaatgggtttcattgtttgagtcaatattttctattattccaaacttgggtataatatgctcaattaatggttttaccacattattggcagttgcctcgaaaaggggatggcttctacccagtggttaaggtaattaattattactagcaggtgttttagccgactaatgggtggcattttagtataatcgacttggacgttttggaatggtcttaactccggagttcttcctccgaaaggcaatttcctttcagcttgtttgtcagctttcttacagatgagacagccatttgtgatctgcctgtctagaatataaatgccaatacacctaaagactctgagaatcatgtcacatagggcctggggaccccagtgagtcccttgatgtaaatgggataatacttccctcataaagggtttagatagcatctctctttgatctggaagtatgcagctttcttatgaatttttttttttttttgctttgggatttcaactaatttttctttcccagccagggagaagataggcacaacagtaggagaaggaaggtggggagttaaatgaaaaatgggcatatctaagactgcagcctttttggccatctgatctgcaaggttattccttcggctcttaagggaaaaatcatgttgatgtccaggaatgtgcatgatggctatctactttagtagctggagattatctaagacatgactaatgacttatgagcaagttcttggcccctactatttataagaccttgttcagcctaaatcttcccaaatgtgtgtgctaccctaaaggcatacttagaatctgtgtagatagtttctatctgatcctttaaatattttaaggcctgactgaaggcaaataatttacaagcttgagcagaatagctattgggtaaccatcctgatttaatttcttcgagtgtctctctatctactactgcatatccactgtgttattccccattaaacacccagggggacttgtctatgaataggtgttgccccgatctatagaggcctcagctaaatctggctggacttttgtatggtagtcaattaagttgaggcacaagtgttctgtctgtagcaacggatttcccgtcaagaaccctgcagggttgagtgagttatctgttgttatggttaagtcatttaaatcatccttttttttttaacagaatagccttatattttaaaattctggaatcagtgggccagcttcctgctttttggctcaaaatggtcttgacttgatgagatgtgctcacggtcaaataccccccaaaggttatttttctacttttttctactaatatggctgtggttgcaatagattgaatatactggggccacccactggcaacaggatttaaaatcttagacagaaaagctactggttgtcaccggcctccgtgttcttgagtgagcacccctaaggctactccattgcttacattaacaaaaaggtggaagggcttcttaagagaaggcagagctaaaactggagcagacattagtctatgcttcagtttattaatttgatctacttctttagaggaccacataagggggtcaggccccttattagctaacttttcatataataatttacttcttaatgcataggagtcgatccataatcggcagtatctaattaatcctacaaactttttaagttcttgtttgatccagggcagtggcagggacagaattccttctactcgctcaggaccaattcttcttttgctggtgctaaatggcccatgtatttgacttctggttctacatattggagcttctcttttgagactcgtagcccttcagtgtataaatgatttagaaaatagatggtgtacttatttactttctctatatcctctccaggtataagaatatcatccatgtgttaagtaaacatagctgttttgggatagcagccctctctatgactttctctaaggcatgactaaaagggtttggtgaatctgcaaacccttgatacagaactgtccatctgtattgttgcttctgcccactgtgggggtcctcccactcaaaggcaaacaggtcaggctgttttccactaaaagacatgcccagaagtcatcctctaaatttaagacagtgaactactgattactatatggaattttacttagaatagtgtagggatgggccaggcgcaatggctcatgcctgtaatcccagcactttgggaggccgaggcgggcagatcatgaggtcaagagattgagaacatcctggccacttggtgaaaccccgtctctactaaaaatacaaaaattagctgggcatggtggtgggtgcctgtaatcccagctattcaggaggctgaggcaggagaatcactggaacctgggaggcggaggttgcagtgagccaagattgcaccactacactccagcctggtgacacagtgagactctgtctcaaaataagaaaagaatagtgtagggatttggcatgattgggtgaggagtctgcactatttcattaacagctttaagatcttgcactaatcagtatgacctgttaggtttcttgacaggtaaaatgggagtattatagggagacatgcaaggcttgaggagcccatcttttgtaagtctattacgggcttcaaccctatctgcccttccaaggagataggatactatttattccttacaatctcccctggagtcttcaattttatttggattgggggaatctgtaacctccttcagtttctttcttttggccagacaccaggggaaattttgccatagttagcaaatttagtgaggttaagaaccctcttgggctaacctgttaagggaagagaccacccctcatattgtcttatgcccaatttctacttccaaaagaaagaagaagtaaaaactaaaaggcagaaatgaaatccacaggcagacagcccggcaccgcgccctgggcctggtagttaaagatcgacccctgacctaacaggttatgttatctatagattccagacattgtatggaaaagcattataaaaatccctgtcctgttctgttctgttctgattaccgctgcatgcagcccccagtcacataccccctgcttgctcaatcaatcatgagcctctcacacggacccccttggagttgtgagcccttaaaagggacagaaattgctcactcagggagctcggctcttgagaaaggagtcttgccgatgctcccggccgaataaaccccttccttctttaactaggtgtctgagaagttttgtctgctgctcatcctgctacgctgtagaccaatacctaattttaacattaaatctctccgaagtagattagtttctgctttaggaattaataggaattgaatgttacttgatcaggctttatattttaccttggcactttctaaaatctttgctttaaatccttccccttttactccagagactaacaactcctctggagaatatgttagcccagttggggtaacacatagggaggagcaagtagagcctcagtcgactaagaaagtaattgactcatggttaggtcctacctttaaatttatcaagggctcctggtgggactcgaggtagaaaagaaagagcccctgacaccccccattcctcctctttaaaggcaggaatgagcggaggagctccccctgtaatctgtcacttagggcattatctcttaaagtggcctgagtttccacatttgtaacatctatcttgccctccttttctccctattccggaacttccctgcctctgtcctttttcttctctcttatgtttacaccctttacaacacttgctgtgactgttttcccttcaaccttgattctgtcttctgttttgcatccccaggtcccagggtgtcggccgaaattttgcttctggcattgattgccctggtgaattttgccaaaagatttttgccttttgcttttctttttttcatttcatctctcctgacatatactttctgtgcttcctctaaaagctctttgatggagcgattttttcatctttttattttttgtaacttctttgctatattatgctatttgtgacaaaatgcaattttagcatcccttgtcctggggggctatctagatctaaattagcatactttctcatttgctctcttaatctgtttagaaattgcacaggcccttcatgtttttcttgttgtacatcaaaggccttagtaagattttgaggtcagggtgctgattctttaatccctctaaccgttaattctcgtaaatttttatatggtcttggtgggttgcattattattatcccactgtgggtcttgagtgggaaatttagtatttgccaccggattatcctggcgagcagggtgatcaccttcccaggctgccatagcggctgcgtggattatgtttcgcttctcttttgagaagaggatacctaggatcgacattaactccgtccaggtatactactggggacctaaaaactggtcgatctgttctgccactccttttggatcatctagcaggggcttgagctccctctttaggcctcagacctcagaggcagttaagggagcatttataaagccaatcgtgccctctccttgtggaactttttttagagggaagagctgggaagtcgattctttaggagtgcaaggaaaaggaagattctgaatgtcccttttacattgttctatctctttttggagccctctttttgaggaaggacatttagatgggcagcagagatgatcaagccactgaggcggtaattcctcgggaacagacgcctccaagtccagagtgatccctggagcgggtgggggggacgagacttccgcctgaggaggaggggaggcgggacttctgccggaggaggagtgggaggcgggagttccatctgaggaggagaaggcggcagccatacggcaggcagcagcagcgccgtgggattcagaaacgggaagataatttaaaggatcccactaactgctctgggcctttgtttctgtctgttaccgtctttaagtcatttaaggggtaaagaagggcaggcccttgctgctagcataaggcataatccattttttctggggacatggggctttggttgttaacatacattattaaaagttgacagacccaatcctcatctgaaccaaattttggccagaaaatggcaggttttaaggttggctcttgggtccagaggaaacagcaatatttaatcatctgttgttttctcttatatttagtccgctcatcctctttccaatattatagcatgaatcctaagggactatcaaaggaaatttgatcactgtcccctcccttgttgcctggtctatttcctgtcccaatcctactagaagcatttcccatgttgaatcccagataggcccaatcccttgtgctagggatgttttgcctcttcctttcccaggaaggctgaatcccccagataccggggatgtctcgtctgtcctgtcctcaaggcttaatctctcacaccagaggtgtttcaccgattctctttccctgcgaggttaaccttcctccgtttcccttttggaggttccttacactcttcccgtttatgtccacgcactctgtccagcaacaagttggtaatcgtgcacacacactcagcctcccaaaagctgaccaccaaggaagtactttgctgccctcttgcggcttttcctaccttggcccatgcacggcgttgcctggttactgtggggagtcccgcaagcctgtctctttccccgcgttgctgagaattcaagtatattcctctcaccgggtaggtcccggctctcctcctggggctgccgcaacgggcggcagggcgcctccccacaagacagggccaaagactgtcccagaggggaatgttaatctcgctggggccttcaaattgttggtaacgggtgctcggtgtcataaagatcagcactgaggcacagcatctctcagcaaggctagtttactttctgcagaaaaagtgccgctcgccagcagtcttgccatgaatgcacacacgaacaaaggagacaaggtcatttataacctgatgcatccaccctactgctgtgtgcggcttccaatggctggaacaggacctcacaatttgtacttgactcaaactactacaagtcaaatacagcaaaaatccaaaaacccgaatttaaaagtgaacaaaagactaaaatacttcccaaaggaagacacacacattgccagtgaggacatgcgaggattctcaacatcactaatacttacggatatgcaaatcaaaaccacagtaatacaccacctcacacacattaaaatggctttaataaaaacaacaacaacatgaaaccacaagtgttttcaagtaggtggaaaaattagggctctagtgcattgctgctggtgatgggaaatgttatagatgctgtggaaagtggtatggcagtttctcaataaattaaagaattactacttgatccagcaattctacttctggattctaggttgtgaatgcgttgattatctttagtgaactatagaaagttttctttatctggtgaaaatacactgtaacataataacttagtagataacatgagccctcttgcatgggagagcttttatacaaccagaaccagaaaatatgcattgaaaataacaattgaatgaaatctcattataaaatgtttaaatggaccagcaggtgaccaagtgtacctgaagctttgattgttttcccaggaatatggggccaaacattggttataaattcttttaacaatttataagtcaccacaccaatatattccatttgaatatttttatcttttccatgatgagtcatggaatgcagaacttttaataataaaagctttaaggacttaggaaggacaaggtggccatcctggttctccatgagtccatgcttaattaatattagactcatatcctcttgaatcatagtttttcttcaaattatgtgcatagcactgataactgatgggttatcataggtaatttgacttagaccatgacgttcattcaaattgtatatctaagtaattttaatgtcagctgatgtagcatgagtgctgattggttaggtaggagatgaaatcatgggaagttgaagctgtccttttttgctgagtcagttcctgagtagaggtcacaagatcaaatgacccattttatcgatctgggtggggccagctcatccatccatcaagtgcagggtctgccaaatagctcagacagatctcaggagcagtttagagagggtcagaatcttgtagcctccagctgcatgactcttaaaccgtaatttctaatcttgtggctaatttgttagtcccacaaaggcagtcttgtccccaggcaagaaggaggttcgttttgggaaagggctgttatcgtctttgttttaaactgtaaactaaattcctattaaagttagttcagcctatgcccaggaccgaacaaggacagcttggaggttagaagcaagacggtgttcattaggttaggttagatctctttcactgtctcagtcataattttgccaagatagtttgaggagaatcaaattttaaagaaagacacataatagtgtcacggctagccttaaatattctcttgactaacttacagagcaaaaatctagccttaaacaaagttaagttttttgtaatctcaaatgacttgctttagatctcctgaggcaataaggattaaagccacttcaccatgtcatccagtagttaaaattccacactttcactgttgcagcctggattcaattacaagtcagagaatgaaccgcttttgttacaggaaaaaggtcccaatccatgcccaaagagaggattcttggatcttgcacgagaaagaattcagggcaagtctgcagcgcaaagtaaaagcaagtttattaagaaagtaaagtagtgaaagtacagctactccatagtcacagtaggatgttcttgaaagtaagaggaggcacacacccaccctaggtacagtgctcatatatatggggagatgtaccctgctacaaaggtttgtgataaggattaattttcttaattgtgatattttgcaagaatctaagttattatctttaaagcaaaattaggaatcactttgttttccagatattgggatatctggacactcccaagtctgggtctgtttagtaaatattattgatttgttcccttaaccataaacatctagaggctaggaatgcctcactttctggaaatgcagcccaacaagtcccagcctcattttcccagccctcactcaagatggagtcactctacttcaaatgcctctgccacttttgttttgatatttgtgtgatttttgagtttttgtggtactcatttacatctttggagatgtctcatgcatccttggctaagtcacaattatggttagtgcttatcagtttcagctgggaggatacttttggttaaaaaaaaattcaaaagccagaaatatcagctgtttgtcctagctaaaatctgataataaaaaatctgaaagtattacagtgggtagctagtcagacatcagcaggacaggagggagcctccttcccccacacaccaggaatgtcatgaccatcaggtgattgtcaggtggtcgttaactgtctctctaaaataataatgggttgtagctagcaccagggaaaggcagtctcccaatagacaggaaacacctgaaacagttgatcagctccttcctgataagttctcagaagttgggtgagtgggctaaaacatgtgcattaagaggcaaaatggtggagtttaactggtttgtgacctcccagggacatttgactggaaagagaagaacacctcaagtgagcatgcatacaactccagtaaatacactgcgcatgttcaccccaccccaagtgctagcaggccactgcacatgcagacagcccactccaaagggaaaataaggggagaggagatgcagaccccagaattatgccaacatacaaaagcctaagtcagaggtcaagcaatgcacttgatctcttgttgcctgcttggcttttttatttttttatttttatttatttatttttttgcaacagagtcttgctctgtcacccaggctagagtgcagtggcatgatctcagatcactgcaaccttcgcctcccaggttcaaatgatcctcccgcctcagcctccctagtagctgggactacaggcacatgctaccacacccagctaatttttgtatttttggtagagacgaaatttcaccatgttggccaggttggtctcaaactcctgacctcaggtgatctacccatctcggcctcccaaagtgctaggattacaagtgtgagtcactgtatccagcctgcttgactctcttttaattgtactttacttcctttaattcctgccttaaagcttttaaataaacttttactcctgctctaacacttacctcagtcccttcttctgccttatgcctcttagtcaaattacttcttctaaagaggcaagaattgaggttgctgaagacgtctacagattcactgctgctaacatgctttggtgtcatttctcagctatgtttggcagctaagagaaggatttcccaaaacagctctgtgattaagagtcagcttaattaaaaactggtatttaagccatatatttattaatggtatttaagccatataattattaatatttataatattaagccatgtatatattaaaataatatatatataaaatattatatatatatagaatatgtatatacacagaatatataaattcatattggatatatattgagaaaggacttgaatgtatattgaaggcttttctgcttttctcttttgtatctttttttttttttgagacaggctgtcactctgtcacccaggcttaagtgcagtggcacaatctcagctcgctgcaacctccacctcctgggttcaagggattcttgggcctcagcctcttgagcagctgagattacaggcacgtgccaccacacctgactgatttttgtatttttactagagactgggtttcgccatgttgctggtcttgaactcctggccttgagtaatctgcccgcctcagtctcccaaagtgctgccattacagatgtgagccactgcctctggccatctcttttgtatctttgaaagattttttttcagttgactgaaatctttttaaatcatgtgcttagtctgtctggtttttttcttaaaaattctttttctgcttatttctctttccatccttcctcttgctattcttgatgccacatgagggaacctaaagaatttctgacagcctggaaccccttaaggaaaacagaaaagatgccacagacttccctatttaggagaaaccactgtttttcctcatggaaccccaagagttgtaagtaaatggattcctctcaggtctaaaactctgctctcttttccattttccctgacctctttggcttttgggggcatcagagattactttgcactgtaaaaatgcttgaccttatatgtgtgatggctgctgggtcactggtaagagctttggttttggaggtgactaacagcgctcgcaataaatgattattacttcagaatgctactcatttctttgcaagtttagataagaaatacacagtttaaataattagaaaaatgcccttatagcaaagtacactgtggaagtgttgcatagtatggttccattggcattttcctcttctcagggacctgggattcagtgaaatccttgatttataaaggtctggatgctgtcccttgcaactgggtcttctttttatgtatttaaattattaggatctaaaagttgcaagacttcgttggtcctcttccttaatgggctctgtcctgagctcagtggtccagttggaaaacagagaccaaattaaaagctgcctatctaaataaaattggtctccttataaaatcctatggtaaatttctgtcatttttgtgttaccttggcatctatttttaatcttccttgaacacacacaaattccttcttgtaaaagctttagttctctttctctctgtgctttgagatgtaaatttgctaccaattttctctaaaactcaataaagtctggcttaattaaatgttaacctcttccatttacaaaggcacaaatttaatccaactgtcttttttaaatactgaatttgatcggtcctatgctgaaatcaaaactctaaactctttctgcctccctctatctttatgtgcacatgtgtatgttatatgctgtatcacatatatgtctatgtccatacatatgattatatgttgtttacatacatggtatcaaattaatgtaaaaataagtactcataaattaagtaaataatcccaaatgcttttcaatacatgtgattttagtaatctttggtaaataaagatagtttaaaaattattggtaaaatgaagtagaaatgtcttcagatttaatttagacatttgtgcctgggtctgttggcagacatttttatattgtatttactagatgttttagggtcatcatatggttgcttctgtatatatacattttcttaatttttctgtgaccttatatctttagatttgagcctttagattctgagttctagatgagcgaccatagcaagaactggggacaaaactcatcccatcccacagctgtgccttttggccatgctggaagagattagattctccaggtataatcttcatagctttgctgtttatcttgggctttacacctggtaactagttagaattgcttacttcctgttttttctctcctgaaaataatgctgtatttgtttgttctcacattgctactgagaaatacctgagactgggtaatttataaagaaaagaggttgaattggctcatggtttggcatgactctcacatttgctcagcttttgaggaggcctcgggaaacttacaatcattgtggaaggccaaggcagaacaaggcatctcacaggtgagagcaggaggaagacagcaagggttacacactcttaaccagatcacctgagaactcactgtcactaggaaagcaccaagaggaatggtgttaaaccatgagaaaccatccccataatccaatcaccttcaaccaggctccacctacaactttggagattacaacttgacatgagatttgagtgggaatataaatccaaaacatatcattctttccctggtttctctcaaatctcatgtctttcttttcatacgtgtccgtgtgaagagaccaccaaacaggctttgtgtgagcaacatggttgtttatttcacctgggtgcaggtgggctgagtccgaaaagagagtcagcaaagggagatagggatggggccattttataggatttgggaaggtaatggaaaattacagtcaaagggggttgttctctggtgggcaggggcgggggtcacaaggtgctcagtgggggagcttctgagccaggagaaggaaattcacagggttaatcactcagttaaggtggggcaggaacaaatcacaatggtggaatgtcatcagttaaggcggggcagggccttttcacttcttttgtgattcttcagtaacttcaggccatctgggcgtatacgtgcaagtcacaggggatgcgatggcttggcttgggctcagaggactgacattcctgccttcttatattaataagaaaaataaaacaaaatagtgttgaagtgttggggtggcgaaaatttttggggggtggtatggagagagaatgggcgatgtttctcagggctgcttcaagcgggattaggggcgggtgggaacctagagtgggagagattaagctgaaaggagatcttgtggtaaggggtgatattgtggggttgttagaagaaacatttgtcatatagtatgattggtgatggcctggatacagttttgtgtgaattgaaaaactaaatggaataagaaggagaaaaacaggtataaaaggtctaagaattgggaggacctaggacatctgattagagagtgcctaaggagattcagcatagtcctgccagcaaagattatttatttacttcaagagttaagagtggcagtttggggatagcacgaggagatatcagctgtgatggcttggagaaacagtgtaaactggcagtgtgaacaagagcagggcatgtgtgagtagttgagaatggagaataggaatatgactagacagaaaatagtagggatgacaagttttcttgggggcacagtctaagttggtccagtgtctggaatgagactggggcctaataaaaaggagcatctatacaggagcttaaatgggctgtaccttgtagcattctgaggacaggcctgaattctgagaagtgaaagtggtaaaagtattgtccagtcctttttaagttggtggctgagcttggtgaggtgtgtttttaaaagacctttagtccgttctacttttcttgaagacggaggaccgtaagggatataaaggtttcactgaatactaagagcctgaaaaactaattggctgatttgactaataaaggctggtctgctatcagactgtatagaggtgggaaggctaaactgaggaattatgtctgacagaagggaagaaatgactgtggtggccttctcagaccctgtaggaaaggcctttacttattcagtgaaagtgtctatttagactaagaggtattttagtttcctgactcgggcatgttgagtaaagctaatttgccagtcctgggtgggggcaaattctcgagcttgatgtgtagggaagggagggggcctgaataatccctgaggagtagtagaatagcagatggaacactgagaagttattttcttgaggatagatttccacgatggaaaggaaatgagaggttctgagaggcaggctagtggcttgtactatagcatagcctgcatttgctggtatgtggcgattaggcctggtggaactgccatcaataaatcaagcgtgatcagggtgaggaataggaaagaaggaaatacagggaaatggggtgaatagcaggtggatcagagagatacagtcatgggggtcaggtgtggtatcaggaataatgtgggaggccagattgaagtccgggccaggaacagtggtaattgtgggacttaacaaagagtgagtacagctgaaggagccggggagcagaaagtgtatgcgtcaggtatgaggaagaaaatagattttggaagttgagaaatgtagagagtgagttgagcatagtttgtgattttcagggcctctaaaagtattaaagcagcggcagccgctgcacacagacatgagggctaggctaaaacagtaaggtcaagttgtttggacagaaaggctacagggtgcggtcctggctcttgtgtaagaattctgaccacactaaccatgcctaggaaggaaaggagttgttgttttgtaagggattgaggtttgggagattaatcagacatgatcagcagggaaagcacgtgtgtttttgtgagaattataccgagataggtaacagatgaggatgaaatttgggcttgactgaggtaatgggggctgtctgtgaagccttgcggcaggacagcccaggtaatttgctgagcctgatgggtgtcagggtcagtctaagtgaaagcaaagagaggcggggacgaggggtgcaggggaacagtgaaaaaagcatctttacgatcaagcacggaatagtgagttgtggaggaaggtattgaggacaaaagagtgttcgggttgggcaccacaagggggataggcaaaacaatttggttgataaggcacagatcctgaactaacttgtaagtcttgtctggttttaggacaggtaaaatgggggaattgtaaggagagtttataggctttaaaaggccatgctgtagcaggcgagtgataacaggctttaatccttttaaagcgtgctgtgggatgggatattggcgttgagtggggtaagggtgattaggttttaatgagatggtaaggggtgcatgatcagtcgccaaggagggagtagaggtgtcttatacttgtgggttaaggtggggggatacaagaggaggacgcaaaggaggctttggattgggaagaagggcggcaatgagatatagctgtagtccaggaatagtcagggaagcagataatttacttaaagtgcctcagcctaataagggaactgggcaggtggggataactaaaaaggagtgcttaaaagagtagtgtctaagttggcgccagagttggggagttttaagaggtttagaagcctggctgtcaatacccacaacagttatggaggcaagggaaacaggcccttgaaaagaaggtaatgtggagtgggtagcctccgtattgattaagaaggggatggacttaccctccaccgtgagagttacctaaagctcggcgtccgtgatggtctacggggcttctgaggtgatcaggcagcgtcagtcttcagccggtaagccaagaaggagtcagtcagagagccttgggcccagagttccttgggctctgggagtggctgccaggtgagttgaacagtccgattttcagtggggtcccacacagatgggacgcggcttaggaggaatcccaggctgcgggcattccttggcccagtggccagatttccggcacgtgtagcaagcgcctgggggaggaggttctggaggaacgcctggttgctatggttcaggcgtttggaagttcttgtgtgctggagatgtggctggggtttgtctcacagtggaggcaaggaattgcaacttttttctgttattgcacaccttgaaggtgaggttaattaagtcctgttgtggggtttgagggccagattccaatttctggagttttatttaatgtcgggagcagattgggtaataaaatgtatattgagaataagatggccttttgaccttttagggtctagggctataaagcgtctcagggttgctgtcaaacgagccatgaactgggctggatttttatacttgatgaaaaagagcctaaacgctatctgatttgggataaagaaaaaggagcattaaccttgactatgcctttagctccagccacctttttaagagtaaattgctaggcaggtggggaagggctagtcacggaacgaaactgtaagccggaccaggtgtgaggaggggaggcaataaaaagattacagggtggaggagcggaggctgaggaagaattgggacctagcttggcctggcaaggaggggagaggtcagatgggtctgtagaaaaggaagattagaaagactcagcgacgcttggggttgggactgaggggacaggcgggagatttgggacgagttgcactgggcacagagactaggaagggactgatgtgtaaaagaatgcctggacgtcaggcacctcagaccatttgcccattttacgacaagaattatttagatcttataggatggaaaaattgaaagtgccgttttctggctatttggaactactgtccagtttgtattggggtcaagcggcattgcagaagaaaatgagatgcttagattttaggtcaggtgagaattgaagaggttttaagttcttaagaatacaggctaaggaagaagaaggaggaatggaaggtggaagcttgcccatagtgaaggaggcaagcccagagaaaagagtagagacatggagaaggggtgggggtttcttgcccaccagaaaagcagagaaagggtcggagcatggaaataagggattggggtgcagacataagaggttggggcatggaagtaagggattggggcacagagataacaggttggggcgcggaaataagcaattggggcacagagataagaggttggggcatggaaataagcgattggggcgcagagataagaggttggggcatggaaataagcgattggggggttcttgccccctaggaaagcgggacttaccgctaagggtgaaggagaaggggttgagtggtacttgcccctgccccaggaaagcagagaaggggtggagagaaggagagaaggggttggggtacttgccccacccccggaaaagcagagaaggggtagagacaaggagagaagggttggggtacttgccccttccccagaaaagcagagaaggggtagagacaaggagagaaggggttggggtacttgccccttccccagaaaagcgggacttgccgctaagggtgaaggaccaagacaggcgtccctgcgtggtctgacacctttgaaacgtgggtgaataatcagagaggcgtccctgcaatgattaaacaccaagggaaagctgccttcccagtctgtgaccggcgccggagttttgggtccacggataaaacatgtctcctttgtctctcccagaaaatgaaaggaattgaaattaagagaagggagagattgaagagtggaaaggagaaagtggttgagggacagtgagagaggttggagaagagagtaagaagagaccgcttacctgatttaaaattggtgagatgttccttgggctggtcggtctgaggacctgaggttgtaggtggatctttctcacggagcaaagaacaggaggacaggggattgatctcccaagggaggtcccccgatccgagtcatggcaccaaatttcatgcgcgtccatgtgaagagaccaccaaacaggctttgtgtgagcaacatggttgtttatttcacctgggtgcaggtgggctgagtccgaaaagagagtcagcaaagggagataggggtggggccgttttgtaggatttgggaaggtaatggaaaattacagtcaaagggggttgttctctggtgggcaggggcgggggtcacaaggtgctcagtgggggagcttctgagccaggaaaaggaaattcacagggttaatcactcagttaaggtggggcaagaacaaatcacaatggtggaatgtcatcagataaggcggggcagggccttttcacttcttttgtgattcttcagttacttcaggccatctgggcatatacatgcaagtcacaggggatgcgatggcttggcttgggctcagaggcctgacatttctcacatttcaaaatgtaacaatggttttccaacagtccattacctctttccagcattaccagtaaagtccaaagtcccaagtctcttctgagacaaggcaagtcccttttgcccatgagcctgtgaaatcagaaacaagttatttacttccaagatacaatggggatttaggcattgggtaaatactccaattccaaaaggtagaaataagccaaaagaaataagatacaggccccatgcaagtctgacacccagcagcacagtctttaaaactaaagctccaaaataatctcctttgaccccatatctcacatttagggcacactgatgcaagggttagactcccaaggccctgagaagctctactcctgtggctttgcagggctcaaccctcatggctactctcatgggccggcattgcgtgcctatggcttttccaggtgcagtgtgcaagctgccagtggctcttccattccagggtcttgaggatggtgggtatcttctcccagctcctggcccagtgaaaactgtgtggagacacttaccccacattttgcttctatactgccctagtagaggttcttcatgagggcactgcccttgtagcaggcttctgcctggacattcaggcttttctatatatcctctgaaatgtaggctcccaagcctaaactgttgcactttgtgcacctgcagggttaccaccacatggaagctgccaagctttatgacatgtaccttctgaagcaacaggccgagctgtaccttgacccttttgagccatgactagagcagctgggatgcagtgagcagtgtcctgaggctgcacagggcagcagagccctgggcctggcccaaaatttattctgtcctcctaggcctctggtcctgtgatgggaagggctgctgcaaaggtctctgaaatgcctttaaggccttctccttattgttttggctattagcacttcgctccctttacttatgcaaatttctgcagcctgcttgaattcctcccctgaacatgggcttttcttttctaccacatgctttcctacacactttcagaaaactggatctcatgagaactcactatcataatgacagcaccaaggaagatggtgttaaaccatgagaaacattagtttatttgccaatgtctgaggtaggcaggtgaggacagcgtttgtgctgttgtggaaatgtgttctgaacagggaccttgaagtgaggtggaggaggtggccaagggagagaacactcaggaccccagatggctgctgctgcccaggacatccccgcctcttatggatgttacccagattgtagcagggagaggcttcctttaagtagagagtaaacggactaagaaagcgatagatggctccacatgccaagaatgttcttttccttttctctcccttttctccctctccttttcttttcatgatatcaaatgccagagaggcgtgcagagcacgtagggggccttccttgcgttgctgctacccaagcctgcctgggctgtaagttcccccggagcacccctttgcccccacctgtggcatggtcggcctctcttgggcccaagcctaccctctgcttcctcagagcgggtctcagaccaggcagggggtttcccaggagtccctgggaaggtttgttttctgcagtgccatggtgacataaatggttgctttccttatcatttttcaatatttagtggccactgattactgccttagaaacacggagcaattgaggttttcctgcccctttccaattccagttcaatgtaattttcctgctgtgactcctgtccctctctgatgtcctctcccctattcaggcttcaacagaagccttctatcccctctcaaagctccgtcctccccaggagacaccagccagtctctgtgcttcctcctcccaccctctcccagggagtcctccctcacctgtgagcaggagcccctgccaggggatgcatcctctgcggggaggggctgaggggggcctcatggtctctgctgcctgcttctcttctgtggagaggagcttagctccaggatgatcagagctactgtgactgccagttctgctgtctttcctccctctgtgctgagccttctctcagggcaggagcacttcctagggccaggggcaggggcgggactctgcccaggatgcttctctgtcccctcccctctcagtcctgccttctggttcctgcttccccttcccttctgtgtgtgtttggtccttaggacctgctgaggccatttgccttcttcagatatggctctccttccacacttgtccacacacacacacatatacacacacagagacacacacagagacacacacagagatgcacacacacatacacacagacatgacacaaacacagacacacatatatacagacatacaggcaaacacatatacacatatatacagacatagaggcaaacactcacatatacagacacacacacatatatactcagattcattgaaactgagacacatgtacacatacagatacacagagctgtcacaggacaaactagcacagataaagacttcaagtggctttatttgccgtcctaaaatcgggcgagacttcatcccatgagacaatacgtgggtcaaggagctgagcagaagcgcgggtttaatagagaggggagggctgcggaaagcaaacacaaaaaacagggccactcgggaaaggctcatggaacaagggagaaatctctgatgggggagaatcaggttcctgttttagaaacggtgagagcagaggggaggtcattgtcatgcgattgaaactggcctgtttgggaaatcggctattatctttcgaaggtcaggtagcagctcagttttcctttggtgacctgtgacattggggaaggactgcattgtgctgttggtctggtctgttggggcctggagcaggagctcagccactgccatggcctcctctgactgctgtttagcaaagctctcaggtggggctgatggcgctgtcctggggaggccctttcagtagcaaggctggtgcaaccctgtcccctgggaggatgacccgccctccccagggctgacctctgctatctcctggcctcaggtctgtcagctccacacacagaaccctggggatccaaacctggggaattctttctttgtgatgcagaaacccagctggccaggtctccccatgctctttagtgcttgggaaggtgggatgatgcccagcaggaaggtgacagaggtggctctgggggatagaaaggagctcactgggggatgactggggagggaccagccctctgtctccagtgtcaccagcctggcctctgacccaaagagacccaggctggactcaggtggagctccagctccagggtgtggaggaagttgtcctgtgtgtcctgggtagagaggactgtggtggagggaggtgggtggctctgagccctgctgtccttggggaaggcttcatggagaccctccctttctgtgtctgttggctgagctgtggctcagggcctgtccatgttctccctatgttcaccccttaaccttgcaggtggttgggggggcgagagagatagaaagactgtgtctgtctgtgtgtgtgtgtgtgtgtgtgtgtgtgtgtgtgtgtgtcctgtggctaccacaccttccccatgggtgatgccaggaggaagtggggagctgcacaaaaacccttggcagagcaggcaccatgaaggagcaggcacatggcagggaccagaagggtcatttggggcaagggctggaaaccaggctccacctctacctccttagcaaagccaggttcctgtccaggggaatccatttcctgagtgttatctgtgtgtgatgtcgccccctggagggcaagaggagacttgtggccttgtcaggggctgccccagggacactgaccagggtctgcatggtatgagctggccctgacccctgggcagaagtgggatctgacctccagactgcagggtcaggtcaccccaggtcctgttcactgcaggtccccaggctgcccaactccatgcagtgcaagatgagcccagggagaggacaggagttatccagagaacagcaggtcgagattcaagagaactgtccaccaggaggatgggctgccttagaaggagccacctgtccccaaggtttcaaaggaagggctcagggaggtatctctgggggctttagagagaggatgccagcctgggaggtaggtggtccccagaatgccctgtgttcctccatcacagcactgggggtgctgcctccaggtcaactgtgtccctgtctgatgcccactgtcactgctgttactcaatattgtactggaggcattggccaatgaaattggggtacagatacgaatagagatataagacttagaaagagggagaataagctataccaattcacaaccaatatgtgattatatatctaggaaattccagacatagtgaaaaactaatcaatgcaagaatttaatagaaagatgtaaagttaacataaggaggttaataacttttatacacagaaacaatactcagatagaaggtgtaatataagacctcttttattatgacaatataaagataaaacacctgggcatacccttaacaagaaatttgtaaaacctatacgagaaaactcttaaaacactcctaaaggacacaaaattcatcttcaaaagatgaagagacacatttagtttcttttcgatcactttattatgaaaatgttcaagcacacaaacaaattgaaaaagttgtacagccaacacttacatactcatcatgtagattctgtaattgttaatattttgtagtatttgcttgattaaatattcttacatccatgaaaataaatccatcctattttttcatgtatgtcagagtgagttgcggatctcagtacccttaggccctaaataccccagcactaacgtcattaactagagtttaatatttgtttctatcttaggtgaaatttacataaagtaaaatgcacaaagttgtagtgtaccttttgatgagttttgacaaataagtgcatacacccatgcaaccccttccaagacacacacagttcctgttgccccagtgagttccttcccagccaatcctcatgcccagtcccacctccagaggcaaccatcgtgctgagttttcatcataaattaatgttgtctgtagaagaattccatataaatagaatcatacaatgtgtacgttttcctgtgggttaaattttcttttgctcagcaaaatgtttttgagaatgaagtattttgttgcctctatcagtagtttattactttttttttttttgagacagagtctcgctctgtcgcctaggctggagtgcagtggcatgatctctgctcactgcaagctccgcctcccgggttcatgccattctcctgcctcagcctcccaagtagctgggaccacaagcgcccgccaccacacctggataaatttttttttttaaatatttttagtagagatgggatttcaccttgttagccaggatggtctcaatctcctgacctcgtgatccacccgcctcggcctgccaaagtgctgggattacaggcatgagccaccgggcccggccttgtttattactttttatagcaacataatattcagcagtgtgaatataccacatctggcttattcatcctcctattgatgggtattttgttttaatatttcctcagttttggaccattattattatgaataaatctgcttttaaaaataactttgtgtatgttttggatgggcacagtagctcatgcctgtaatcccagcactttgggaggccaaggaggcactgatcccttaaggccaagagttcaagaccagcctgggagacatgatgaaatctcatctctacaaaataataataataaaacaaaataacatctttgtatgtgtcttgttatgatcacatgtttcattcattttgggtaaaatacctaggaatgaaattgctgggttatggagtaggtatatgtttacttgtataagaaagggacagacttttcccaaagtggttgcatcattttacattctcaacaacagtatatgagagttctggttgctccatatatcctcatcaacatttggggtcttgtctttctactttcaggaatttggttggtgggttgcaacatttgattgtgattttaatttgcatttccctgatgactgatgatgttgagtagtttttttctgtgcatattagctattcgtatatcttattttgtgaagtttctgtgaaaatcttttagtcattattgcattcagaacaaaggattaaaaaaatgcatcgcttgaacccccgaggcagagtttgcagtgagccaagatcgtgccactgcactccagcctgggcgacagagtgagactccatctcaaaaaacaaaaacaaacaaacaaacaaaaaaaagcatgtggaactttagcatgagttgacttcactttgggcatgctgtctttagcagtcacaaaaaaatgaataggcgggtgaactattgtagaatgtaagagatataataaccaaatataaggcataagtcttgattggattccagttttaaaaatacacatggatagccaggcgtggtggcacacacctatagtcccagctactctaaagactgaggcaggaagatcagttgagcctgggaggtggaggttgcagtaagctgagatcctgtcactgcactccagcctggatgacagaacaagattctgtctcaaaataaattaaataaataaatacagatggaaaaatcattttggagaccaaaggggaagactgaaaaaggactatatattagatagggttagggagttattgtttattttctcaggtgtgatcatgggattgtgggccagtcactctggggagaggcacgctaaagcactcaaggacatagtgtcactcaaggacacagtgccttgatgcctgcaatttactctgacacagttcagaaaaaaacgaggaaatatggcaaaatgttaaacttgaatataaggagaggatgcgggtattcttggtattattttttccgcttttctggatgtttgaaattttcataataaaaagttgaaaacaaaggatgatgtgtaagaaagtaacttggtggcatcagaggtcatggatggtggcattggtgcaaagacatcaaggatgggaagggtctagttatacaaagagtagatgaaagacaccccaggcacaggaacagcaagtgcaaaggccctgaggtaggaactagccagcatcacattgtcagccctgcgagtgaccttcctagaaagcagacccttcaggcccagtaaagctgcagatgactgcaccctgactggcttctttactccaacctcatgagactcaccaagtcacaatcacccagcttcataataaaaagctgaaaacaaacactcttcaattcctgccccacagaatttgagaggtaacaaatatctgttgctgttttaagccctgaagccctggggtaatttgctaggcaacaatggataactaatgcagcttctgtcacatcttctaggaaacttcttaacctgctctctcagtacaaaatcccctttctccatttggttccatgtaaacctctgttcatccttcaaaattcacctaaaggagtgtttcccaaaatagggttcaggtgtcagtggctgagggcatgtgagatgattctaaggggttacacacgacagttgttaaaaagcgttacaggctatgcttgtgattaagcgcctattagagaaaaataattgaaaatagcatattaatcacatgattggataaacattattgttttaagatgaggccaaagaaaaacagtgagttgctttaaggaaaatttttgagtaaatagcagtgcaagtgctattcagatcgtaaaagtggaacacgactaaaatttggaagcgcagtgaggaatagcaggaattcctctaggaaaccttccctgccgctccaggtgggccagtttgcccctcattcagacccctaaatacctaaatatctctccacttggcgctggtggaatgtgtcaggatcccatctctggctgatggaagtctgtgaggaggctgtgggctctgcatctgacctgagctccaagtctgcagggcaggccctggggaaggggagatggatggaaagtggggagtaaggacaagccaggagcccacacaaggtggaaggtttcgggacccacagaacctgcctctattcttgctgcctcatcttggtggtgcaggggacctgcaggagtgacctttgtcacagaggtcaacgcacacctggctcaggaggtggagaaactgaaggaggattggggtaaaggtggagcagtttcaggtcctgctgctgctccaggctgaccagccgagctagcagatgagcaacacctggacctgagccacggaagctcctgcctggatttccccagcatgaaatgcacaacggcggctgctttgggcaggtgtgtcccgctcccaccctaacaggaacctacagggaagagagttctgagaggtgtcgttcagcctagccacagtcattgtcaccacaccctcttatgggcctgagcacccttttctgtctgcccttcctgggaatgagaagtccctgagagcggggatgggtctcattcattttggggtcttagtatcattcagcatagggcttggcacagagcaggagctcagggagtgcacagtgaattaatgaatgattcttaaagagcccctacatttaagtaagaaatccatccattgaataagaaatccatccatcacaggttcttcctgtgtccacctgggtggggaaagatggactcatcagtggcctgaaagggatcaagttaagtcaccccaaaatgtaccacgttggtataaggattgttttgagctgaaggccattgagaatcaacagatgctggaagagcactgccctctccttatctacctagaagcagggcatatatttccttttgggaaggtgtttcctccccagaccattaagaaaagcaactcatcctggagatggcgagtccacactgagatgagtatgcatagaccgacctcactaacagaacctgcatctccatcagtgccccaggtatttccgggtcactgtcccatgatgtatcaccctttgaagaacaagcccctttcctttgttaaaatggtatataagccccacaagtctagccgtttcattttttcttttctgtgaactcccatgcatgtaataaaaattctctgccctttctgttgttaattggtcttttgttagtttaattcacaggcctccagatactgaacctaagtggatagaggaaaagcattccctccctgaaaggcagttttccagactaacaaacaaatgtcataagtatgtacatcttccagaaaacggagttgtctagttacatagtatgccctgggcaatggattaatacatgtaacttaggcaattcatctgaatttcagatttttgaaggctaagagctaccttcacaggaccaagtgatggtctctggagtctgggtgttttacagagctccattgatagaaataatctttgcaagaacattgtaggatgatgaataggatctgcttatatctcaagttgtctgggaagcggggacatttgctccttcttatcttgctgggatttctgtcaccagcagttggaagggactccagttttaagacaaaggtttacagtttctttggcaccaagagcaaaagaagcataaaactaggcagaaaggggtataatattatcatgttgagaaaaggaatatggaaaatgtaaccttttgcatctcctgagttaatgaatctatactctgagaagggcagaaatgagaaccacctccccatctctgcaataaattccctagaaggtttggattttagccaagaagtttctgctttcctggagaatgtctctcaattcaaactctaaaccccaaagccagaaaaggcaaacgttaccttgtctgggctttaatccaagttttcagtggctggaaacacggttacactcctggagacaaggtggccttggacacccaggaagagccctgctcccgggcacacctggccctggagccagaccacctgggtttgaaccccagctctgcaccttaccagcagagcttcctgtctggaaagtggagatgatcgtgatatcactgacctcagactgtggttgtctcaattaaattaacaatccatgttatgagtgtacaagtatcgggcacagagcattgactcaattaatactgatctgtaatgaatggggattcatgccaagtgctgatgatgtgcatgacattagtgctgactgctgtaagtactggaagccgtcatgataatgaacagtgactttcatcacagttcatggggtcctttgtgaaacatgagggggcattaagcagaaacagccagcccagccctctccaccaccctttgaggaggtgtatctatgcctggtttacagtgtggaaactgaggctcagagacggggactggattgtgcacggtcacccagtcatgaaggccaagaaatgatggatgggatgcaggctgtgtgctcagccccctccctgtggagcagctcaggggcgtggggcatccagtcgccctgaagatgctgctcttgtctgtctgcctctctctctttccaccacactaggtctctgtttctggctctgtctcctcttcactgtgtgtctgtggttcactttgtgtcttttcatctctgtgtctccctgtctgtctctgtctttgtctctctaccaatgggtaccttctgtctttccttccttcttttcttttcttttctcttctcttcctttcttccttccttcctttcttccttcctttcttccttccttccttcctttcttttctttccagagtctcactctatcacccaggctggagtgcagtgtcatgatcttggctcactgcaacctctgcctcctgggttcaagtgactctcctgcctcagcctcctgagtagctgggattacaggtgtgtgccaccacatccggctaatttttgtatttttagtagagacagggtttcaccatgttggccaggctagtgtcaaactcctaatctcaaatgatccgcccgtctcagcctcccaaagtgctgggattacaggtgtgagccaccactccagcctcttctttctgtttctgtgtatttatgagtgtccttcctcctgcacactgtctgtctctcactctgtatctctccagctctgtccgtctctttttctgggtctctttccctctgtgtctctctgtgcctccctctttgtctctgttctgattttgtgtggccccatcagcttgactatggtggtgtctccatgtccctcctcctcctctcagatgctcttttggttctgtgttttccttctgtctctgtgtccctgtgggggtctcaggaccaggacgagggtgaagtaagtgaggtgtctctgctgcaaaatctaaggagacacccaaatccagggttgcacaagtgaccccttaatttttagtcctaggccctttctctctcccctcactctctctcttttctggattacaacaccattgatttttaatcaagaatccacaagcctgggtcctctcttgtctcaccctagtcctgccctgcatctctctatggctcaccttctacttctccggctctggctcttgagttctccctctctccgtgcctctcctctccctccatctctctatgttagtgtctctgtccccttcactctctgtctctctctgtatctcccctctccacccccgtatttctctgactctgtctctctctgggtctttatcattttctctttctctctccatccctgccccaactctctctgtgtgtttcccagtctctctgttttcccctaagccaggggcttcatgttgtccatctgtattgaggtcttgggtggccagcagggttctctgcttagtgggggcttcccctcagtgctttccatatgctgtccagactgggggtgctgcagctagaaagggaagaaggtttccatatttcctgagactggagtcacatcctgtcaccaatgcactcacctgctgactaaccagtgtacttctgggaattgcaaatgcatgaaatggcacccattctagactagtcacggcagtgttggtgatggtcacagaccgggaacgaccctgacgtttatccatagagaactgggtcatgagccatgatccacatcatggatactggtcagctgtggcaaagaatgaggtatccttctgtctgtgcactggggaaggtttccaagatacaccgcacagtgagaaaaacaagaagcagaacagtgcacggtgtgctacctcttacattacaaaggaggaaatgtaaaattaatttacaaatggccaataagcacatgaaaacatgctcaacatcactaatcattaggaaaataaaaatcacaactacagtgagataccaccttacatccattacgatggttgttctcaaaaaaaaagaaaaacagaaaagaacaagtgttggcgaggagaaattggaacgcttgtgtagtgtttgtgggtatgtgatatggcgcaaccactgtggtcatttctcaaaaaattaatcatagacttaccacaagatgcagcaattcggcttctggtgtattccaaaaagaacggaaagcaggggccccagcagatatttgcacgtctttgttcatagcagcattattcacaatagctaaaagttggaaacaagcccagtgtccatccgtccgtgaatgaataaacaaaacgtggtctatatgtacaaatgaatggaattcagccataacaagaagggtggttctgatggtgcttcaacatgaatgagccttgagttctttctgctaagtgaaataatcagactcaaaaagacaaatttgcatgattccacttaacagaggtgcctaacgtcatgaaatgcatagacagaaaatgaaaaggtggttgtcagtggctggagggagggggaaagaggagttggtgtttaatgggcacagaattccagttggggaatatgaaaaagttctgggtggggatggacagtggtggtggttgaacaacaacctaaatgtacttcctgcccctggatatacacttaaaagtggttaaaatgggctgggcaaggtggctcacgtctagtcccagtactttgggaggttgtggcgggcggatcacgaggtcaggagatcgagaccatcctggctaacatgacaaaataccctctctatctctactaaaaatacaaaaaattagccgggcgtggtggcatgcacctgtagtcccagctactcaggaggttgaagcacaagaatcggttgaacctgggaggtgaaggttgcagtgagccaagatcgtgccattgcattccagcctgggtgacagaacaagaccccttctcaaaaaaaaaaaaaaagaaagaaagaaagaaaagaaaagaaaagaaaagaaaagaaaagaaaaaaagtggttaaaatggtgaattctatgttatatatattttaccataatttacaataattcctattgttttgcataaaacagctgtagaaagctttgcaggtcatgaacagcacagctggccactggggctggtgtggggctaggacctgggtgcacagggaacaggtatgagacacaggctcttcatgcctgcacacacatatggatacacaaggatgcaaatttctgagccatctaaatacaacacctattcaaaaaatcaaacagaaaaaggaaatgaatggagctgaaggatgagggcaggtggggcggctgctcgggaggactctggagaccacttcacccaacattcgaggcctctcttagcagctggagctcatccgggggacttaggagctctggaaagaggaacaggagagggccatggccggaggaggcctgaaaaagatcatctctgccacagagaagatgctggctcggatactggtgtcccccgtggaggcagggagacccagggagacaactgtattcattcaaggaggaatgggtggtggtgcaaacttgggtggaggccacagggtgcagaagacaggacacagcagagatagatgtaggacatggaagggacagaaaggagtgatcactggacgtaaaggggcaaggaaagtggaagcatgagaacatctgctgggcatccggctgagaggttgggtgtccagggtgcccttccctgagggagaacccaggacaggagcagattcagagaaaaccacccagctcactccagcaagaagcagaaaagggactggttaaaggacagggtaggaaggtcaccaagctccaagggccctcatgaagccagcttggaggccacagggcccagggcaaggaccaaaccacaggcacaggacagctccggtcaagatcttctggccactgcaggaggcagaaaccacaccctgcaccctgcactgctgaggctggccctggagtccagaagcttctacaccagaagcttctgtcccccatccccactcaaaaaattaaaaacaaaaagcaaatcggtgccatgcaccctctgcttcctggtgctgttcgggatcctgagtctttcacgggggcacctgatggggaaagcctggacccgtgtctgtgtccctcctgcaaggagtgctgggaaaatgaactttccagcttcctccttgggaagacagaacattccccatgtgtactggtggcatttaaaaactgcacggcagccagagaacatggaccgtgttccaccaggagagttcctggagggatgtcccggtgcagacgcccgtcccaaggtgggtatttgagctgaggaactgagaagccggtttctgcctagagttagagatccgacaggcatcagcacatggaagggagggaagctacgatgcatcgagggtgggagatcagatgaaccaggagaggcagggcccgggaggaaccccggggagcagccgcctttaaagcctgggggaagtagcttcagagaaggtgaggtaggttgggtgggggttgctggaaaaagataattaagaaacaaatttctgctcagcccagaaacccccgtcatatccgtagaagcaaaagaaacctgtcttatgactgagtaagcattaagccaaaatgtgatgcaatctgctaagagatgacaaagacagaaagaaatcccacctttgtatccagccaagcaggtgcaacccgttacacacgtggtctccagatagacggtgactagttcccagttgagaggactcaacggcaccatttgtcacacatagttcatcctaaattcacccagtaactgtgttgattctctgtgtggttaattggctttatccacaggaaaaacaaacctctcttatctatgacaggaggtagttttgcaactgggagtgagatgcccccagaactgaggttccttccttctcacagaaactgggagacaggggcgctttctgcccggatgcctgcctttcaaagagagggctcctatggccttgaggaggacagttctgggttgtgaggcaggcaagatgcttatgtatgctttagaaagctttacatacatcttcaagggacagagaaagaattttcaattacacctcttctaaaaaataaatgctctcaaagtccagcctgggcaacatagcaagatccaatctccacacacacaataataataatcaatttgctgggcacagtgggatgtgcgtgtagtcccagctactcaggaggctaaggaggaaggatcacctgagcccaggaggttaaggctgcagtaagcttggatggcaccactgcactccagcctgggtgacagagggagactctatcaatgaatgaatgaatgaatgaatgaatgaatgaagagaaaatgatctgagtgaaaagaggagagtctctttatctttttgcaacaggctaaacaaaatttttaaaaatgtatatttgcctcacagagattattccaggaaaagaagtggccctcagtgtcaaaggatgcaaaactaacctgtgagttcctggcaggtttagcaataaagcaggatgttgctgatctcagtacaagcaatgttagagaaaggggaagatggaagtggacatggacgagtgagtggcaggtgacaaatggaagcaaagaaacgtatccagaccactgaagatgcttgaccgagaaaaaagaggcggtggagggaatggaagcccaaggaagtcatttgttgcaataagaggcctcagagcacgtgtagggtgcggggcagagcccatgcagaggggctgtggaaggctggtagggtgcaggtggccccactctccatcaccctgaggagtatgtggtcagagttaaagctcagtctgtttctgggatcaggtaagaggtcagcgtccggagaagagaggtggatcttcagatcctgcagacctccaccgcgccctctgtccctcttgactgctttttctccatctccattgtctggctcacattcctgtcacgtcttcctttctccctgcccctcttttctcttttctcctctctttttcttaacccttgtacctttggaagtcccactaatagaatttaaacagcttttcaagttggttttttgttcccagaaattgactttagactctccatgaataatgtggaaatcaaacgagtataagctggttcatgtctctgcaattaaacaaataaaatcaacattccaatgctttcttcttccagagtagcccacatttgattttttttttcttaattactgtcacttgcgatagatttttaaatcttgtaacctggttacacaaataccatggggcaaaagccttacttcctgtgagaggaaaccaggcttgactagcctcatgctggctttgaagaagtaaaatcaggggttgatgaatttgcatagggtaaatatcaaaggtcaaaagtcaacaataggtggtagagggaataccccaaattataaaagaacaaactgtttaagccacaatagaattatcgtagaaataaaccacggtccttcccactaaaatattccacttagaattgtaaaatattttcctcaataactcctggaagagcctattaagaaattaacgaggctgggcgtggtggctcacacctctaattccagcacttttgaaggccgagatgggcagatcacttgaagttaggagtttgagaccagtctggccaatatggtgaaaccccatctctgctaaaaatacaaaaattacccaggcgtggtggcaggcgcctgtaatcccagctactcaggaggctgaggcaggagaatcacttgaacctgggaggcagaagttacagtgagccaagattgtgccattgcactccagcctgggggacaagagcgagacttcatctcaaaaaaaaaaagagtcaaacttgagccaggcatggtggctcacacctttaatctcagcactttgggaagctgatgaagtcaggagttcgagaccagcctgggcaacatgctaataccctgtctctaccaaaaatttaaaaattagatgggtatagtggctcatgcctgtaatcccagctatttgggaggctgaggcacaaggatggcttgaacccgggaggtggagcttgcatttagccaagactgtgccattccactccagtctggagtgaaaaaaaaatccatctcaaaaaaaatcacaaaaagaataaatatggggccttatgactgtatattactgggcttctgacctagactgaaagatcagggaagactttcctgaaaagaaagtgagctatgatgggcccactgtactccagcctgggcaacgtaatgaggctctgtctcaataaaaacatgcagaataaaaccacaataagaaaataagacaataaaaccactacagaactattagaatggctaagattaaaaagagtgaccacgccaagtgttggcaaggatgtggaggcactggaacgctcacgctgctggtgggaatgtaagatggtacaaccactatggaaagcaatctggcagcttctaaaaatttcagcatacaccatgccactcgtcaattccattccattcccacatgatttttatttaaaggaaagtcaagtggaatgatctttaaagcatttttgcctgacaaatagatgaaatgtgggtagcagcccaacactccctggtcagtcttcacagggcatatgtggccttatggcccccaggaaatatggctctttccacaagtgctatgtccactctcttcaccaatcctaagatgttagttccacagcactgctagcattgggctttgtctatttctttctttctttgtcttttttgacagggggtcttgctctatcatccaggctgaagtgcaatgatgcaattttggctcactgcaacctccacttcccaggctcaagagatcattccacctcagcctcccaagtacctgggactacaggtgcacaccaccatgcctggctacttttttatatttttggtagggacggggtttctctatgttgcccaggctggcctggaactcctgagctcatgcgatccgcccgcctcagcctcccagagtgttgggacagcaggcgtgagccactgctcctggagtgggctttatttatttctatttctatttccttttcctgtatggtgaagagattgaaaagcatgccttattttgcaggaagagatggaaggctagaaagaggaagtaaattgttcaggtaatagtgaaatgatagcaggtctagaatatcagcctctttactcaaagcccacaatttccaaatatcacaacttcctttctctttatacactttagggattttatttatttatttatttattattttttgccaaagtgaaactccaggtcaaaggactttgttggtctagtgtcaaattagcttccaaggtgttgatctaatccatggggccaccagcactcaaggatataggcgcacagcaatgtcagcctcatgttgtaatccttttattcatttttgctcctctggtcagtacacgaaggcctgtaaagatcctttcttttatttttgagatggagtctcactctgtcgcccaggctggagtgcaatggcacaatctcagctcactgcaacctccgccccctgggttcaagccattctcctgccccagccaagtagctgggattacaggcacatgccatcatgcccagctaatttttgtatttttagtagagacagggtttcaccatgttggccaggctggtctcgaactcctgacctcaggtgatccacccacctctgcctcccaaagtgctgggattacaggcatgagacaccacacccagccaggcctatgaaaatctttaagtgtaacttttcattaagtgccatagatccctcctctttataacataaagtcctgtaaactgcatgcaggtcagtttgccataggaataatttgtctttgctggaacatgctgggtgcttggcagatgaagagattggaagtgaaccactgagatgactgatgagcgtcctcagcaggctgtgttgcagggggaagagtgcaggttgtttataaggcctgggtcgtgcccctggccaccatttcctggctttgtgactccagctttacttctccttcccagggctcagttttcctctccttgaaggggatgagtggaaccagctctggacgctgagctgcctgggtgtaaaggcttcctgtaatgggcagaagagtggataggagggcagcaggggagctggaccaaaagcatcatgtgatttgccgtgatcacagaggattttctggaagtagcttgggcacaatgtgtgcaaggagacagaagggtctcgtggtggggaataggacattcacacagcctcctccatggcttacctcacacagcagttgttaattagccaagaatttgacaaacaggcattaaaggccttctgaatgtgacacacgacacccagctagaagaatattgccaaaaatcattaaaactactctaatcatagtctgagtcagacacatccaggtggtggaagactttacaaaaaaaaaagaagtgaaccattgctttcaatgacattaaagaaaatgaaaggcaggtggggagcactcctagattaaaggggagtccagagatgagatgtaaaccaaaaggtatctgagacaggtctccatcaacttagaagcttattttgccaaggttaaggacatagaaaaaaccatgcaatcatagaaacagtctgtggtctgtgcctttttccaaagataattttgaggacttcaatatttagggtggaaaagctggctggcggtgaaagaaggagggtgtggtcgcattactgaatccacatggtgtaagagaaagcaggaggtaggggaataatcaatcacgtattcatctcacgctcagtaaattggcaccttgagaaagataaggtgaatatggccgggcgtggtggctcacacctgtaatcccagcactttgaaaggctgaggtgggaggatctcatgagcccaggaacttgagaccagcatggacaacatggcaaaacccatctctacaaaaaaaaccacaaaaattagctgggcgcggtggtgggtgcctgtagtcccagctacacgggaggctgaggtgacagaatgacttgagcccgggagacagaggtcgcagtgagccaagatcgtgccactgcgccccagcttgggagacaaagtatgatactctctcaaaaaaaaataaataagtaaaaatttttttaaagaaagataagatgaacatagagtagctacctacggagatacttaaccttttctctgtagctgtctgcttaggaacaaaaggaaaggcagtttcttgcatgactcagcttccagttttttttttttccttctgtcacagtgaattggggtcctgagtttttgtttctctttcataaagacaacgcagtgcagttcatgcttgaccccggatgttctcctgatcagaaagcaaaaacgcaatgagagatgtcattgggacaacagaggaaaactggaaatgggcttcctattagacaacagtgcatctgtgtaaactacacgggtctgatcctggtctgtggttacgcaggacaaagtccttaagaataatctatataggctgggcgtggtggctcacacctgtaatcctagcactttgggaggccgaggcaggtggatcacctgaggtcaagagctcaggaccagcctggtcaacatggtgaaaccctgtctctactataaatacaaaaattagccggacgtggtggcaggcgcctgtaatcccagctactcgggaggctgggacaggagaattgcttgaacctggagggcggaggttgcagtgagcagagatcacgacacttcactccagcttgggtgagagagcaaaactgcatctaaaaaaaaagagagagagaggaaaaaaaagaatgatatatgctttttaaaaatttttttatttatttattttttgtgatggagcctggctctgtcacccaggctggagtgcagtggtgtgatctcggctcactgctgcaacctccaccaccagcttcaagtgattctcctgcctcagcctcccaagtagctgggattacagttgtgtgtcaccatgtccagctaatttttatatttttagtagagatggggtttcaccatgttggccaggctggtcttgaactcctgacttaaagtgatccttccaaagtgctgggattacaggtgtgagtcactgtgcccagcccccttaagaataatcttaagaaggttcttgctgaagcacttagtggtgagagttacaatgtctactccttgtttttaaaatttaagaatattttaaaagcatatgttgtgtgtgtataaacagatacaataaaatgtgaagagtgggtgaatccagtgaaggggatacttgtgttcactgtactatccttgcaacttttctgccggtttgaaatttttccgtctttttttttgagatggagtcttactctgttgcccaggctggagtgcagtggtgcgatctcggctcactgcaacctctgcctcttgggttcaagcgattctcctgtctcagtctccggagtagctgggactacaggtggctgccactacaccgggctaatttttgtattttttttttaagtagagatggggtttcaccgtgttgtccaggttggtttcaatctcctgacttcaatagatccacccgccttggcttcccaaagtgctaggatgactggtatgagtcaccgctcccagcctgaaatttttcaaaatgaaaacaccgcaggtcaggagtttgagaccagcctgaacaacatagtgaaaccctgtctctattgaaaatacaaaaattaaccagacatggtggtgtgcacctgtagtcccagttactcgggaggctgaggtgggagagttgcttgagtccaggagatggaggctgtagtgacctgcagtgagctacaactgcaccactgtactccagcataggtgagagcaagactctgtttctaaaaaaaaaaaaaaattactgggcatgtactgtatgccatgtaggtggtggagacatagcaggagatcagacaaacacttccctgtctgtgtggcaaatattaaacttgcaataaacttgcaaagacaaataaagataaaatttatagagatgtcaaaaataaacatataattgcaagtcacattcatttctctttctctgctattcctgctctcgccttccctcttctgcttctcctctctccgtcacagacacccacaacgtccctctgcagtcactgacagataccccaggttccttcctgtcttcctccccgccaccccagtgtgttacagctgatttgtacagccctggacaagcccatggttaaatagctagggatttcatcagcctggttggcaaactgtaggtagcttaaaatcagacatgctatgagtatttacaccagagaaataggccaacactacgaggcaggatttgtgggtattgtttttcagaaaacttggtttttcagcacaacactgctctcccatcggcttccagcaaataaatgttgcatttttcagatatatcctaattctttcatagatattcagtctctactccacctctggccaagcctttcctggtggtaggaaactggggacttgagtcctatgttgtactgtgagggtagagaatagaagagaaagcatgagagaaaagcatgaaaagaagaatcaaaagaaagcaatataagaaggaaagagaaagaacagagaagtgggaagacagtggagggtagaaactaggaccggaagacatggggacaagctgatgcccactgcacaacgtcctcacaggtagttgggccatttccccatctggggtacagaggtggccagggagcccatgagaaatgaggaaactgccttcccaaactactggagaaagagggtgggggtggtgatccacatagctgggctcaggaggaaagagggctgggagtctggaccgggggaacctcgggtcaagatgccacagtttctaactatggagggcctgggggcctggactcctgggtctgagggaggagggcctgggggtctggactcctgggtcggagggaggagggcctcggggcctggactcctgggtctgagagagggaggcctggggcctggactcctgggtctgagggaggaggggctggggggctggactcctgggtctgagggaggaggcactgggggcctggactcctgggtctgagggaggagggactgggggcctggactcctgggtctgagggcggaggggctgggggtctggactcctgggtctgaaggaggaggggctgaggggctgggggtcctggaccctccatctgagggaggaggggctggatgcctggacccgaaggtctgaggaagaaagggggtccctgataggccactgcggccattgagacttggggtggggcccaagcctccattttgcaaggccctcccctccccacccttttctgggctggctgcttaagggctggtataaaggacttgtttcctgctgaaaaagcagaaagagattaccagccacagacgggtcatgagcgcggtattactgctggccctcctggggttcatcctcccactgccaggtgagtgatgagcccagcctggaggagattccctggaggccgggcaagggaaccctgctgagatggatttgctcttgccactccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggtgagaaggccctggcgtgcagagaccccgccctgtcccctcagtcccttgatccctgtgcagggacccgggagccacccctccgggggatcgactcctagggtcccggtgatcccctttccagcctctcagcctacgccgtgtagcagcgtctccctccaggaccctggaggcctgacctccatcctcgcttgcctccctctttcggtccaggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcaggtgcctgcgggagggtcgggaggagagggaggggctgctagaaggggatccgctgagcacagaggggctgttacggagtccctcccaccctcgctcgctatcccgaccctcgctggctccatccctcccctgactgctccctgaccatcgccccgccccgctccctttccatccctccccactcactcccgatccctcccaccgacctgccacccgggaatccccgcacccctcctcttctaagagcaaacaggacggatttctgatatgaaatcaccattaactgggttatcctgcattctttttttattctgttgcgtttggttcaagaagttctcctgcagggtttttgctatttcctcttcctaagggagactgaactgtaactttccactttccttgtctggtgttataaagagtctagggagatattttgcgcttcttttattggaacagcttgtgaacacagaagtctcctgttcttggaggtttagtagcgcttgcaggtgaaggcactggctcgttccagggcaccccctcattcccttgaccaatgagtctgcttctgtgtctcccctcggaaggccagactttgttgaaaggttcagacttgaccatgtctgagtctacatttggcctcagcaggcccctcctccaccctgcccaccccccacccccacttgccacccaagacacccccccttttcttttctttttttttttttttttttttttttctgagaaagcgtctcgctgtgtcgaccaggctggagtgcagtggcgcaatctcggctcactgcaacctccgactcccgggttcaagcgattctcctgcgtcagcctcccacgtagcagggactagaggagcctgccaccacgcccggctaatttttgtatttttagtagagacagggtttcactatgttgcccaggctggtcttgaactcctgacctcgtgatccacctgcctcagcctcccaaagtgctgggattacaggtgtgagtcaccacacccagccaagaccactttctgtacccagccctgggtgcctctacccagacctcctgttcattctcccttcctcttttatggattacacttctttattttcccacatccagatcccatgatgggagctgcagaaggcccctttgggaaggctgagcaggttgactcttgaggccagcaaaagtggggtgcagagaaggtatctgatcaaatccagtgccctctcagtgccccctcactctgtctgtcactttcctagacccaggatccttgaggtgcccagtctgcttgtctatggaaggctgtctggaggggacaacagaagagatctgccccaaggggaccacacactgttatgatggcctcctcaggctcaggggaggtaagcctgggacatcggggtccctgtggggactgaactggaaggtctggggactgagatcttaggctttggggagtgaggtgagctgaggcacggcatgagacccagaggagggtgggcctggcttcctggagctatgcctgcctctgagggttgggtggtcctggaggcagcatcactgactctccctcgctccccctttctgcaggaggcatcttctccaatctgagagtccagggatgcatgccccagccagtttgcaacctgctcaatgggacacaggaaattgggcccgtgggtatgactgagaactgcgatatgaaaggtgagtcctgcccctaggctgtgccctggactgcagcctcggggcacgatgacacatggggcatccagagccatcacaccaaagccagcaggaggaaggtcaagggtgcagggtgggttgcttggcatgtggctttaggcaacagtgagtgctggggcccctgctggctctcaagctgctgagagtgactggttgcttcaatttctgtgtctccacacccctggccttgggtaaccctaggtctcccacttccctaggccaccgtagcctctctcccacccgtatcagcccccgccccgctcatggtgctggagtgccccagcagccttgcctgcacaggagagaacatcagagagaaaatcaaggggactttgggtgtgacagagaaagcaagagttaaaggaggacactgagagggtccccacttacccatttaggtgctgccatggaagagagtgccagggaatgtctccataagaagggctccaaagcaacaggaagccatggtggggaggtgggggtcttataggaatcccagcttccctcctagaagcaaagtcttccctgcccctgcctcagtttccttgtctgcccacatcacgctaacccttagagcttagaagagagagttgtgtgagctctgcacacattcctctgtgtatttggctgtttctccctagctaggctgggagcctgaggctaggggcttggtaccactggcaccagggtttccagccttgggtagctcaggagacggctcaggaagggtaccaggaggtgtttgctcaagtgaggacatgcagggctcacttgagcaaagctccctcatgagtcagaccctgtttctacctgaagggcctccaggactaggagggggaggtgctacagacacagatggtcacagcttgaggtgatcagggctgtggcaaacggggatgtggggcctggggcagctcagaggaggaaaatactgatgttgttggggtagagagtcaaggagggctttacagaggaggtggcctgtgaaccgtgtgttaaagatgacctacagcttattggtagaagaggaagaggacattggtggcagagggaacagtgtgtagcagctgcataggcctggaggtgggagtgagcctgctgttttcaagaagagtccctcactccacctgagaaggactcatcaagatgagggggtacagctgggattgggggtgattcgaagttttccaggtggacaaggtgggtgtggggtcgaagagggagctgctccaagccaaaggcacagcaggtgtgaggctgaggaggaaatgaactggcatgccttcagaatggatactggtgggggaggaagagttaagtggggaacctggtggtcgctcaagtacctgaaaacccaggctgaggggtggaccctctcctgaaggcaggggagccatggaagattgtggagcagggagggcagggtctgagccatttatctttccttttgactgatgctgctgttaaggatctggccctggtctctgggaccagatgacactgataacccagaaggtatttcagaaacaaatcagacgcaacacatgccacacacacagcccacaataagcacagcagacacgaatgcgtcacaccatgacacatacacaccacacatcacataccacacacacactcccccatacccctgacataccacctatggaacacaaatcacacacagagcacacaatatgcacaacacacacaaatgcatcacacgagtgcacaattactacgtgtacatgtagtgtgtatgccacatactacacgtcaggtaccacacacactctccctctcaacatatcagacatgcaatacataccacacacaacacacaatacacacaacacatctggcatgccacacacaccacatgcaagcaaaacacagatacacagaacacacaccacaccaaacacacaaaacaaacacataccacatatatcacacacagtatgtctacacatgcacgcaccacacaaacataccatgaacacaccacacaccccatacaaccacaccccccacatgtatactacgcactcacacacagcacacatacctgcacacatcacgcatgtgcacacactacacaaacgcaccacataaaacacagcgactatgcaccaatcagtgctgttcatagagattcatctgctttcaacactggagccagatcttgcaggctgttttgcctccctggtgaagtgcagttcagcagtttagcagacagtgagcatcacaagaccaggcatcagaaactgggggaacaacaagacgttggggaccaagtgcaggagagaagaggcttcagggtgatggaaccgcttataagaagccgcagcagtgggagggctgggtgcaaggatgcaggttactaaaaggggccatggcagcagccccttgtgaagaaccaaggggcccgggcagataaggccctggctgcccctagaggagctgggcagcggtcccagtgagagagcagggaagagcccacgtctgaatcagggacacgtgggtcccaggcccagctctgccgccgaaacagctttccagcctcagcttcacacgaggatcaaaagtctccatatctcatggagcctctttccctggatttggggaagaggaggggatggttgcagacatgggacggaagcagatgcaaagaccatgatgtgggtgagtgcctgccagaaacacctgtgcggagcagagtgatggagggagcagggaggcggccgcgtcttatcaggcctcccgggccattggaagggcttagaattttattctccagaatggggacctcctggagtcttcggagcagaggagtgacatgaactgacttaggtttacctagcctccctctgcctgctgggtggagaatggagcgagaggaacagtgacaggcgggtgcagggattgccccaggagtcaggtgggagtgaagcggggggcttggaggcagcagaggtggtgacgtggggttgggttttgaagattttctgcagctcaagccagtaggattacttgaggaacacaatgtgggagagaaagagcgtggtcaaggacaacaccaatgtgttcagctagactggcagaaacgagccgccacgggtgtaagtaggggagatgggagtggggagagaagggtgggagaagggagcaggagccatgattttgattttgtcatctgtgaagtatgcaaatgagcagccctccagggtggcatcggttctgcaggtcgcatgtgttggtggaagctgggggctcagtctaagagtccctgcatcatgggaccgatcccccctgctctgtgatggccgtgaggggaggccaggggctgtggtttcacactagagccttgagggcctcggggccaaggtagccgaggatggtcttcagtacctgtctccctcctgctcccaaccccgaccctgagggtccagagtccctgggttcccagcctacctctgccactcacaagctgtgtggcatgggcagctactgagcaatcctgcctctgtttcccttgttgcaaatgagggtgttgattgtgatcacaccacctactgctggggtgctgtggggaaatgaggcatcccagataagctgtgttccctggaaccttagatgggtggatctgtgggaagcaatgaggtcagccaggtgcagaggcagtgctcagcggcagtgctcagcccaccctggcccttcgcatcttgtttggaacatagggctttgcaactgaaaggtatgagaaaggtctcaggctgccttccttattattgaaatgaggaccttaaagctcagatggggaagcagagatgggatgaggataaggaagagcttccattgctctcacagctaaagcaaggaacggccgttcccccagggctgtgagaggacgtccctgcgggtgttcaagcagaaacagggaacaatgggggtgggatttcgactcccaagtcccttctgaatccttggttaagggaatctgtggccaggtcacctggagtgtgactcaagagtgtgatcaccttccctagcccaggacgtggagggacagacatggtgggttcctggcttacacacaccctgggattcctctccccagattttctgacctgtcatcgggggaccaccattatgacacacggaaacttggctcaagaacccactgattggaccacatcgaataccgagatgtgcgaggtggggcaggtgtgtcaggagacgctgctgctcctagatgtaggtacgtggactgaggtagaagacgaacacctgtcccaagtccctggcagctccctccaccccactggattctttcccctgaatttcctgctcagctcccttcacatctgcaattttcaatccgactcttcttctctctgcatcttgggttccccttatgaaaactgggggtgaagcagtgggaatgacagtgtctgcctttctggggaggggtgaccacgtatgcggtaatccctgcccagggtggagaaccgtgccaacaccgaggactctcagtggcttcatacattctggaaatgtttatccagcatttgttttaggtgccgcagatccaatcccatctgtattcctgcagctttatatgccttgagaaacaggaaacaaacaaacaaaaagcagcaaagtatggggaatggagatcccagctctgcagagaaatctggcaaggaaaaggagataggaaaagtgaggggaaggctgcaattttaagctcagtgctcaggggagactcatggagaaggtgacctttgagcgagaactgggaggaggcagagcttcgggcaggacccaggccccagcctccgtctttgccccacactaaacatgacccagcagttgtgatcagggcattcaccctctgcctggggggtattgtgaagggcagggagtccagctctggagcccctgctgccctgggagctgcccagtccccagcccagctttccctctcaccctcaggactcacatcaaccctggtggcgacctaaagctgcagcgctgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaaggtatgggatccagggccgtggagaaatgaggcccagacacacagagactctggcccaaggtggccagctgctctgagcacaaagtcatgtacccccaccttccctctgctccccagctgcccctgtcccaggagaccggcagtgtcctacctgtgtgcagccccttggaacctgttcaagtggctccccccgaatgacctgccccaggggcgccactcattgttatgatgggtacattcatctctcaggaggtgagtgctgcaagcagggccccaaggatgaaggcactggtggcctggactcctgggtctgagggaggaggggctgggggcctggactcctggtccgagggaggaggcgctgggggcctggactcctggtccgagggaggaggggctgggggcctggactcctggtctgagggaggaggcgctgggggcctgggctcctggtcccagggaggaggggctgggtgcctggactcctggtctgagggaggaggggctgggggccggggctcctgggtctgaggagctgaggctctggactcctgggtctgaggtaggagggactgggggcctggactcctgggtctgagggaggaggggctgggggcctggacccctgggtctgaggagctggagctgggggtctgggctcctcggtctgagggaggagggtctggggcctggactcctgggtttacaacttggctgggctgtactctgtgtcctttctgacttggtcttctccctctaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatctaaagcctgcccttcattggtctggttcacgtctccaaaccagcttggatggtagcagagacttcagggtgctccagccaaacgtatttgggcatcaccatgacctgggaggggaagatgcactgagacgtatgaggcttccagcctagcagccagggccctagcacaaacaggaggctcgccccatctgagcaactgcaggagaggttagtacagtcatgcattgcttaacgacagggacgtgtcgttagaaatgtgtcgttaggtgattttatgaccataggaacattgtagcgtgcacttacaccaacccagatggtacagcccaatacacacccaggatggacgctagagtcgactgctcctaggctacaagcctgcagtgcatgttatggtgtgaatactgcaggcaatcttaacaccacggcaagtatttgtgcatctacacacatctaaacatagaaaaggtacagcataaatacactattgtcatctcagcagaccaccgttctatacgcaattcgtcgctgacccaaacgttgctatgtagcatctgcgtatcgtgggataattgacatgagggcttgagagaactccagaaaaaaatgggttagcattttcccagagctgttatcattgggtctctcttaccaccatagcccaaaaagggtgaggagaagagccactgctggaatctgcagacagagagagagagagagagagagacatagacagaaagagacagagagagctggagagagagccggagacagaaagagagagatattcagagagggttgcctaacaagagctcccatctcaggctgaaaaacgcgtccagcccacaatgatactggggagggaagtggggaactaaaattccaaactgatgtcctcactctggtctccagttgaggttccccattgactgaaccccctagaggccacagaagcaggagactccactggtccagcccccatagatctgccattcacactacagaacagaggagaggagagggaagaggagaagagagcgaatctggagaaggaaacagaacacgtctagtaccgttcactcccttgcccctcggcatccaccctttccctttgtccaaatgaaaatcaaagtccaggacgggctcggtggctcacgcctataatgccagcactttgggaagccgaggtgggaggatcacttgagcccaggagtttgagaccagcctgggcaacatagtgaaaccgcttctctacaaaaaaatacaaaaaataagccgggtgtggtggtgtgcgccccctccctctactggtcccagctactcagaaggctgagtccaggaggtcaaggctgcagtgagccaagactgcaccactgcactccagcctgggcgacagagcaagaccctgtctcaagggggaaaaataaatcagagtcctccgtacagatgacacacaattccagtccttccctctgtcacagtaacagtgtgtgatggtgacagtgatgtcctcctcccattgtgctgggcaccagttcttcacccacaatgagagaaagatggggaggagatggcttccaatacagctgctgaggtcctgggggcggggctgctggtgcttagagctgctttcttccagtacattccacattgtcttcccacttccaaaacctcctttggatgttatttgttacctgcagtgtaacccaaatcttgattcttatggagagtgagtcttggatggccttgtctttagtgggtttctgtagttttccatggaacagggccctggccaaggaaatgttaccgccatgagttgcctgccttcgaaaatagcctccttgtcccagccacccgacctccctctgtaatcagatgccattcccccgactgcagagtgacgtctcctttgcctgctgttttggcagcacaaggggcacaggatggctggagggctgtcatggcttcctgcagatcagaactaggaagagattcctcatccacagcagcccagggccacggggacaaagagcaagcattctctcagtgggctggcaggtgcagtcacgggagggagccgcgcttattcttcctgtctttcctggatctttgcatctggccctggggcgcgtgacccgatagcctggttgctggtttataagatgtgtggcccctcctgtgggtggtggggtacggtctccctcccggtgccctgataagccacacatgagccattgcgccaatctgagaagcagctgtgtctgtatagaggggcacctgagacggtcagtgggttccatgggtgtgagttaattaccccccattctttgcgttaacacgtgtccccagtggaagcaaccctgcatgggttccagagccacaggaaaggcgctgttcacagaagcactgagcagggtccagggaaggccaactggaacccccagtgtgtgcgtatccgtgtgaggacaaagcccagtcccctccaggatgggacgtgtcctgtgtggccagcctatctgcagtggccgggtagtcctcctgtaaaatgacgccttccaggggcttagccccgggctctgcctacactgggcagggctggatacagtgtgcagccaggccagtgctgggagactcagtccacttgtggtaaggtatgtcgccgtcctccctatccatgtggccatctgcacctggaccccctgaacaagctctgagggacagagtctgcctgacaccatccaccaaacaccaagaacctcatccccacagcacaggttctgggcttaagggtggggacggcatagctcacactttgtgcccatccccagaggaacatccatgtgtcctccctgtcttaagtttactcttttattctcttcaagtccttgaccatgtggcccgctctgggttcatgcaatggacccaagtccatccctccttgcagaacccctgaggttctgcccatctgaaggatttcccttcatcactcctcaggaccacctgaagtgggcactaaggcagccgccgtccacttctgctgggcgccagctcaccgtgaggacccatccataagcctggtctgcactttcctcctctgtatgaggtcacagggcttcccaggagctcacagatgtggtagagggaggggcagaaggacaggtgccatgggagcctgagtcacttgctggcctcagacctgcttgagcctgaccccatgctcagctgtcccgtggatgctggaggctgctgtgcatgccccaggttatggtttggtagctcagagagcacccggccctgaacttgattgcacttggcccagggatgagccaagagctgctttccgaatggtcagagttacctgcaggaggaggcgcggaatttctctagaacctccagctctgcactgttaatcttttggagcttgtgaaaatctccataaaataatgcactagatttgaaacatagactctcttacattttttcgtttctaaatatactctaaatatactcatccaggagttatcgagaataatattttgcaattccaactggagtaatgtactgggaagtgctgtggttcatttctttctttctatttttttttttttttttgagatggagtctcgctctgttacccaggctggagtgcagtggcgtgatctttgctcactgcaacctccgcctcctagcttcaagcgattctcctgcgtcagcctcccgagtagctgggattacaggcacccgccaccacgaccggcaatttttttgtatttttagtagagatggggttttgtcatgttggccaggctggtctcaaactcctgacctcaggtgatctgcctgccttggcctcccaaagtgctgggattactggcgtgagcctgtgcttcatttcttttataattctattgtggtttaaatggcccgttgctttcctaatttgtgggtattccctgtatcacctattgtttactttctacctctctgatatttaccgtatatgaatttatcaatcctgattttacttcttcaaagccagtatgagtttagtcaagtctgatttccccgtacaggatgaaaggtttttgtgggcgtcaagcaagaacattgtaggatgctgaataggatctgtatacatctcaagttgtctaggaagcagggacatttgctccttcttatcttgctgggatttctgtcactagcagttggaagggactccagttttaagacaaaggtttacaatttctttagcaccaagaaaaaaagaagcataaaactggagagaaaagggtataatattatgttcagcaaggaatatggaaaatataatcttttgaatcttctgagttaattaatctgtactctgagatgggcagaaatgagaaccacgtccccatctctgcaataaattccctaggtttggattttagccaagaagtttctgctttcctggagaatgtctctgaatttaaacaccacacctcaaagccagaaaagggaaagtttactttgggctttgatccaagttttcagtggctggaaacacggttacactcctggagacaaggtggccttggacacccaggaagagccctgctcctgggcacacctggccctggagccagaccacctgggtttgaaccccagctccgcaccttaccagcagagcttcctctctggaaagtggagatgatcgtgatatcactgacctcagactgtggttgtctcaattaaattaacaatccatgttatgagtgtacaagtatcgggcacagagcatcgactcaattaatactgatctgtaatgaatggggattcatgccaagtgctgatgatgtgcatgacattagtgctgactgctgtaagtactggaagccgtcatgataatgaacagtgactctcatcacagttcatggggtcctttgtgaaacatgagggggcattaagcagaaacagccagcccagccctctccaccacccttgaggtggtgtatctatgcctggtttacagtgtggaaactgaggctcagagacggggactggattgtgcacggtcacccagtcacgaaggccaggaaatgatggatgggatgcaggctgtgcgctcagccacctccccgtggagcagttcaggggcactgggcatcgggtcgccctgaagatgctgctcttgtctgtctgcctctctctttccaccgcactgggtctctgtttctggctctgtctcctcctcactgtgtgtctttggctcactttgtgtcttttcatctctgtgtctccctgtctctctctgtctttgtctccctctcacttggtcccttccttcctttcttccttccttccttccttccttctttctttctttctttctttcctttttctttcttattataacaccattgatttttaatcaaggatccacaagcttgggtcctctcttgtctcaccctagtcctgccctgtgtctctctacggcacaccttttacttctctggctctgactctctgagttctccctctgtccatgcctctcccctccctccatctctctgtgttagtgtctctgtaccctttcctctctgcctctctctgtatctcccctctccacccccatatatctctgactctgtctctctctgggtctttatcattttctctttctctctccatccctgcccccattctctctctgcctttctcgatctctctgtttctcaccctccttctgccttcccctaagccagggacttcatggctctgatggctgtccagcggtgttgcccatttttattgaagtatccttctgtcgacccacttggaaagacttccaagatacactgcacagtgagaaaaacaagaagcagaacagtgcacagtgtgccacctctggcattacaaaggaggaaatgtaaaatgaatttataaatggccaataagcaaataaaatttggtcaacatcacttatcattaggaaaatggaaatcaaaaccacagtgagataccaccttacatctgttctgatggcagttctgaaaaaaaaaaaaaaaaaaaaaacaaagtgttggcgaggagaaattggaatgcttgtgcagtgtttgtgggtatataatatggcacaaccactgtggtcatttctcaaaaaattaatcatagacttaccacacgatgcagcaattctacttctggtgtattctgaaaagaactgagagcaggggccccagcaggtatctgcatgtctttgttcatagcagcattattcacactagccaaaggtgtaaacaagccaaatgatatggctttcctctgtccgaacacaaatctcacgttcagctgtaattcccaaaggtcgaaaatagcctccttgtcccagccacctgacctccctctgtaatgagatgccgttcccccgactgcaagtgactcaggctcccatggcacctgtcctcctgcccctccctctaccacatctgtgagctcctgggaagccctgtgacctcatacagaggaggaaagtgcagaccaggcttatggatgggtcctcacggtgagctggcgcccagcagaagtggacggcggctgccttagtgcccacttcaggtggtcctgaggagtgatgaagggaaatccttcagatgggcagaacctcaggggttctgcaaggagggatggacttgggtccattgcatgaacccagagcgggccacatggtcaaggacttgaagagaataaaagagtaaacttaagacagggaggacacatggatgttcctctggggatgggcacaaagtgtgagctatgccgtccccacccttaagcccagaacctgtgctgtggggatgaggttcttggtgtttggtggatggtgtcaggcagactctgtccctcagagcttgttcagggggtccaggtgcagatggccacatggatagggaggacggcgacgtaccttaccacaagtggactgagtctcccagcactggcctggctgcacactgtacccagccctgcccagtgtaggcagagcccggggctaagcccctggaaggcgtcattttacaggaggactacccggccactgcagataggctggccacacaggacacgtcccatcctggaggggactgggctttgtcctcacacggatacgcacacactgggggttccagttggccttccctggaccctgctcagtgcttctgtgaacagcgcctttcctgtggctctggaacccatgcagggttgcttccactggggacacgtgttaacgcaaagaatggggggtaattaactcacacccatggaacccactgaccgtctcaggtgcccctctatacagacacagctgcttctcagattggcgcaatggctcatgtgtggcttatcagggcaccgggagggagaccgtaccccaccacccacaggaggggccacacatcttataaaccagcaaccaggctatcgggtcacgcgccccagggccagatgcaaagatccaggaaagacaggaagaataagcgcggctccctcccgtgactgcacctgccagcccactgagagaatgcttgctctttgtccccgtggccctgggctgctgtggatgaggaatctcttcctagttctgatctgcaggaagccatgacagccctccagccatcctgtgccccttgtgctgccaaaacagcaggcaaaggagacgtcactctgcagtcgggggaatggcatctgattacagagggaggtcgggtggctgggacaaggaggctattttcgaaggcaggcaactcatggcggtaacatttccttggccagggccctgttccatggaaaactatagaaacccactaaagacaaggccatccaagactcactctccataagaatcaagatttgggttacactgcaggtaacaaataacatccaaaggaggttttggaggtgggaggacaatgtggaatgtactggaagaaagcagctctgagcaccagcagccccgcccccaggacctcagcagctgtattggaagccatctcttccccatcttcctctcattgtgggcgaagaactggtgcacagcacaatgggaggaggacatcactgtcaccatcacacactgttactgtgacagagggaaggactggaattgtgtgtcgtctgtacggaggactctgattattttttcccccttgagacagggtctcgctctgtcccccaggctggagtgcagtggtgcagtcttggctcactgcagccttgaccttctggactcagccttctcagtagctgggaccacaggcgtgcaccaccacacccggctaattttttgttgtcttagtggagactggatttcacggtattagccaggatggtctcaatctcctgacctcatgatctgcccgcctcggcctcccaaagtactgggactacagacaggcacgcaccaccacacccggctaattttttgtattttttgtagagaagcagtttcactatgttgcccaggctggtctcaaactcctgggctcgagtgatcctcccacctcagcttcccaaagtgctggcattacaggcgtgagccaccgagcctgtcctggactctgattttcatctggacaaagggaaagggtggatgccgaggggcaagggagtgaacggtgctagacgtgttctgtttccttctccagattcactctcttctcctcttccctttcctctcctctgttctctactgtgaatggcagatctatgggggctggaccagtggagtctcctgcttctgtggcctctagggggttcagtcaatggggaacctcaactggagaccagagtgaggacatcagtttggaattttagttccccacttccctccccagtatcattgcgggctggacgcgtttttcagcctgagatgggagctcttgttaggcaaccctctctgaatatctctctctttctgtctccggctctctctccagctctctctgtctctttctgtctatgtctctctctctctctctctctctgtctgcagattccagcagtggctcttctcctcaccctttttgggctatggtggtaagagatacccaatggtaacagctctgggaaaatgctaacccatttttttctggagttctctttagcccttatgtcaattatcccacaataggcagatgctacatagcaacgtttgggtcagtgacgaattgcgtatagaacggtggtctcctgagatgacaatagtgtatttatgctgtaccttttctatgtttagatgtgtatagatgcacaaatacttgccgtggtgttacgatgcctgcagtattcacaccataacatgcactgcaggcttgtagcctaggagcagtcaactctaccatccatcctgggtgtgtattgggctgtaccatctgggttggtgtaagtgcactctacaatgttcctttcgtgataaaatcacctaacgacacatttctaacgacacgtccctgtcgtaaagcaatgcatgactatactaacctctcctgcagtcgctcagatggggccagccccctgtttgtgctagggccctggctgctaggctggaagcctcatacatctcagtgcatcttcccctcccaggtcatggtgatgcccaaatacgtttggctggagcaccctgaagtctctgctaccatccaagctggtttggagacatgaaccagaccaatgaagggcaggctttggatggccattttctcattaggttcctctcctccaccatgctagatccctgggcgtcctgctgtccccttacatggagaaatcccagcactgggagaaagcacagggtctttattatcagacacatgcagccactcctccagtgtcccctctcccacagggcaagtccggctgctccaggctctccccagtgttgctattaggtgagtagatatgaatgattatgtgtggggaagatgattcatggacaggatggggaaataatctggtgtccaaggccattaggttacaagcacaagggacggttgagtgtggtggtgagcagcggtgaagaatcgtgggggaaatggagttagcaggaagggcaaaccgctccccaccacagcgctggggccagtgccagccccaccccccaagtgagacactccaggcccccagccccacctccctcatgctgagaggcaggaggcggctcatcacccttctcacacacagagaagatcccaatttgtctggtgtggttcaacaaggagctggaaggttgggccacacagccctgaatgctcattctggtggtcagcccacctagagggagaagaccaagtcagaaaggacacagagtacagcccagccaaattcataaacccaggagtccaggccccagaccctcctccctcaaacgcaggagctcagacccccagcccctcctacctcagacccaggagtccaggcccccagccccttctccctcagtcccaggagcccaggacaccagcgccttcatccttggggccctgcttgcagcactcacctcctgagagatgaatgtacccatcataacaatgagtggcgcccctggggcaggtcattcggggggagccacttgaacaggttccaaggggctgcacacaggtaggacactgccggtctcctgggacaggggcagctggggagcagagggaaggtgggggtacatgactttgtgctcagagcagctgcccaccttgggccagagtctctgtgtgtctgggcctcatttctccacggccctggatcccataccttgaggagggagggagttcagcagaacgctgctgctgctggcactattgcacaggtccgaggagcagaagtgggtataggaggccacaagcaccccaggaggggctgagtggatggtggtcttctgggaattttgagccccaacagcgctgcagctttaggtcgccaccagggttgatgtgagtcctgagggtgagagggaaagctgggctggggactgggcagctcccagggcagcaggggctccagagctggactccctgcccttcacaataccccccaggcagagggtgaatgccctgatcacaactgctgggtcatgtttagtgtggggcaaagacggaggctggggcctgggtcctgcccgaagctctgcctcctcccagttctcgctcaaacgtcaccttctccatgagtctcccctgagcactgagcttaaaattgcagccttcccctcacttttcctatctccttttccttgccagatttctctccagagctgggatctccattccccatactttgctgctttttgtttgtttgtttcctgtttctcaaggcatataaagctgcaggaatacagatgggattggatctgcggcacctaaaacaaatgctggataaacatttccagaatgtatgaagccactgagagtcctcggtgttggcacggttctccaccctgggcagggattaccgcatacgtggtcacccctccccagaaaggcagacactgtcattcccactgcttcacccccagttttcataaggggaacccaagatgcagagagaagaagagtcggattgaaaattgcagatgtgaagggagctgagcaggaaattcaggggaaagaatccagtggggtggagggagctgccagggacttgggacaggtgttcgtcttctacctcagtccacgtacctacatctatgagcagcagcatctcctgacacacctgccccacctcgcacgtctcggtattagatgtggcccaatcagtgggttctttactcaagttttcctgcttcttcaaggtggtcccccgatgacaggtcagaacatctggggagaggaaacccagggtctgtgtaagccaggaacccaccatgtctgtccctccacgtcctgggctagggaaggtgatcatgctcttgagtcacactccaggtgacctggccacggagtccctcaaccacggattcagaagggacttgggagtccaaaccccacccccattgttccctgtttctgcttgaacacccgcagggacgtcctctcacagccctgtgagaacagccattccttgcttcagctgtgagagcaatggaagctcttcctgagcctctgcccatctctgcttccccatctgagctttaaggtcctcatttcaataataaggaaggcagcctgagacctttctcatacctttcagttgcaaagccctatgttccaaacaagatgcgaagggccagggtgggctgagcactgccgctgagcactgcctctgcacctggctgacctcattgcttcccacagatccacccatctaaggttccagggaacacagcttatctgggatgcctcatttccccacagcaccccagcagtaggtggtgtgatcacaatcaacaccctcatttgcaacaagggaaacagaggcaggattgctcagtagctgcccatgccacacagcttgtgagtggcagaggtaggctgggaacccagggactctggaccctcagggtcggggttgggagcaggagggagacaggtactgaagaccatcctcggctaccttggccccgaggccctcaaggctctagtgtgaaaccacagcccctggcctcccctcacggccatcacagagcaggggggatcggtcccatgatgcagggactcttagactgagcccccagcttccaccaacacatgcgacctgcagaaccgatgccaccctggagggctgctcatttgcatacttcacagatgacaaaatcaaaatcatggctcctgctcccttctcccacccttctctccccactcccatctcccctacttacacccgtggcggctcgtttctgccagtctagctgaacacattggtgttgtccttgaccacgctctttctctcccacattgtgttcctcaagtaatcctactggcttgagctgcagaaaatcttcaaaacccaaccccacgtcaccacctctgctgcctccaagccccccgcttcactcccacctgactcctggggcaatccctgcacccgcctgtcactgttcctctcgctccattctccacccagcaggcagagggaggctaggtaaacctaagtcagttcatgtcactcctctgctccgaagactccaggaggtccccattctggagaataaaattctaagcccttccaatggcccgggaggcctgataagacgcggccgcctccctgctccctccatcactctgctccgcacaggtgtttctggcaggcactcacccacatcatggtctttgcatctgcttccgtcccatgtctgcaaccatcccctcctcttccccaaatccagggaaagaggctccatgagatatggagacttttgatcctcgtgtgaagctgaggctggaaagctgtttcggcggcagagctgggcctgggacccacgtgtccctgattcagacgtgggctcttccctgctctctcactgggaccgctgcccagctcctctaggggcagccagggccttatctgcccgggccccttggttcttcacaaggggctgctgccatggccccttttagtaacctgcatccttgcacccagccctcccactgctgcggcttcttataagcggttccatcaccctgaagcctcttctctcctgcacttggtccccaacgtcttgttgttcccccagtttctgatgcctggtcttgtgatgctcactgtctgctaaactgctgaactgcacttcaccagggaggcaaaacagcctgcaagatctggctccagtgttgaaagcagaagatgaatctctatgaacagcactgattggtgcatagtcgctgtgttttatgtggtgcgtttgtgtagtgtgtgcacatgcgtgatgtgtgcaggtatgtgtgctgtgtgtgagtgcgtagtatacatgtggggggtgtggttgtatggggtgtgtggtgtgttcatggtatgtttgtgtggtgcgtgcatgtgtagacatactgtgtgtgatatatgtggtatgtgtttgttttgtgtgtttggtgtggtgtgtgttctgtgtatctgtgttttgcttgcatgtggtgtgtgtggcatgccagatgtgttgtgtgtattgtgtgttgtgtgtggtatgtattgcatgtctgatatgttgagagggagagtgtgtgtggtacctgacgtgtagtatgtggcatacacactacatgtacacgtagtaattgtgcactcgtgtgatgcatttgtgtgtgttgtgcatattgtgtgctctgtgtgtgatttgtgttccataggtggtatgtcaggggtatgggggagtgtgtgtgtggtatgtgatgtgtggtgtgtatgtgtcatggtgtgacgcattcgtgtctgctgtgcttattgtgggctgtgtgtgtggcatgtgttgcgtctgatttgtttctgaaataccttctgggttatcagtgtcatctggtcccagagaccagggccagatccttaacagcagcatcagtcaaaaggaaagataaatggctcagaccctgccctccctgctccacaatcttccatggctcccctgccttcaggagagggtccacccctcagcctgggttttcaggtacttgagcgaccaccaggttccccacttaactcttcctcccccaccagtatccattctgaaggcatgccagttcatttcctcctcagcctcacacctgctgtgcctttggcttggagcagctccctcttcgaccccacacccaccttgtccacctggaaaacttcgaatcacccccaatcccagctgtaccccctcatcttgatgagtccttctcaggtggagtgagggactcttcttgaaaacagcaggctcactcccacctccaggcctatgcagctgctacacactgttccctctgccaccaatgtcctcttcctcttctaccaataagctgtaggtcatctttaacacacggttcacaggccacctcctctgtaaagccctccttgactctctaccccaacaacatcagtattttcctcctctgagctgccccaggccccacatccccgtttgccacagccctgatcacctcaagctgtgaccatctgtgtctgtagcacctccccctcctagtcctggaggcccttcaggtagaaacagggtctgactcatgagggagctttgctcaagtgagccctgcatgtcctcacttgagcaaacacctcctggtacccttcctgagccgtctcctgagctacccaaggctggaaaccctggtgccagtggtaccaagcccctagcctcaggctcccagcctagctagggagaaacagccaaatacacagaggaatgtgtgcagagctcacacaactctctcttctaagctctaagggttagcgtgatgtgggcagacaaggaaactgaggcaggggcagggaagactttgcttctaggagggaagctgggattcctataagacccccacctccccaccatggcttcctgttgctttggagcccttcttatggagacattccctggcactctcttccatggcagcacctaaatgggtaagtggggaccctctcagtgtcctcctttaactcttgctttctctgtcacacccaaagtccccttgattttctctctgatgttctctcctgtgcaggcaaggctgctggggcactccagcaccatgagcggggcgggggctgatacgggtgggagagaggctacggtggcctagggaagtgggagacctagggttacccaaggccaggggtgtggagacacagaaattgaagcaaccagtcactctcagcagcttgagagccagcaggggccccagcactcactgttgcctaaagccacatgccaagcaacccaccctgcacccttgaccttcctcctgctggctttggtgtgatggctctggatgccccatgtgtcatcgtgccccgaggctgcagtccagggcacagcctaggggcaggactcacctttcatatcgcagttctcagtcatacccacgggcccaatttcctgtgtcccattgagcaggttgcaaactggctggggcatgcatccctggactctcagattggagaagatgcctcctgcagaaagggggagcgagggagagtcagtgatgctgcctccaggaccacccaaccctcagaggcaggcatagctccaggaagccaggcccaccatcctctgggtctcatgccgtgcctcagctcaccctcactccccaaagactaagatctcagtccccagaccttccagttcagtccccgcagggaccccgatgtcccaggcttacctcccctgagcctgaggaggccatcataacagtgtgtggtccccttggggcagatctcttctgttgtcccctccagacagccttccatagacaagcagactgggcacctcaaggatcctgggtctagggaagtgacagacagagtgagggggcactgagacggcactggatttgatcagataccttctctgcaccccacttttgctggcctcaggagtcaacctgctcagccttcccaaaggggccttctgcagctcccatcatggga

SEQ ID NO: 812 - DNA, 56955 bp, Homo sapiens
cggcccaaagatctaagatcgattgctggaagtagtattcatcttgataacataaaaaggtttaggtctgctctgaattccagttggatcacattatgctcaaagaaaggtgctgaagatggtttggaattagcaactccctgggtagtgggaggcatgtgcattctgttgggaggacaggattgatcagagagaaagtcttaggtgtgtcaattacataaagtgaggaatgacgccaaattaagagaagtgatgtgtgttatgttagtgaatttagaaagagctccctgcttctaatttctgtgcagttaggcaaaaaggggaggagcccaaaagaggcatgtgaaatgctttcatcattttctcttgatctcaagaaacactagagtttgattacatttgtttaaattgggcagagtctaagggagacgccagtgcctcatgcatctccccacctgaaggaccccacctttcgacaatggtgtcatcatgaggacacaggtgtgtgtaaaactggcagcaaacccatcagacagcacccacctggccagctccatcctgtcccaggaaccactactattctcattatgtgtatgttacagactttgaagtggtcccacaactccaaaatataaaatatgctattgtcaatacaaaatattggaaagaaagctggataagttgttccacttttttcgcattctttttaaactttgctgtttccgttttagaagtttctgttgacacaccctcaagctagatatttgttcctcagttgtgcccaggctaccaggcttcttcatttatagacttttttttatagcattgtttaaagttctttcttagaatatccatctctctgcctacatcacccatcttttcctgcatggtgtctactttttccttcataactggtaaccagagttgctttaaattttcagtctgataatttcaacatctctgccatatctgtgtctggttctgatccttgctctttcaaaccacattttttttttttttgccatagcctgtcttgtacttttttctgttttttttttttttttgaaagccagacatgatgtactgggtaaaaggaacttgggtgagccggccttcaatgatatagtggtgaatgtggggagggaggagttctgtggtcctgaatgaggtctgttccctgggttgtgaatgtcacaactgcctctcagtattttctcctccttaggtgggatatgatggctagagggggctggagttggacattttcccttcaccaggccagttaagcttccatcaaaccccagctgattcggctatggtaaaacaatctttatgaatacaggtcttgccaggaagaattgaattcactgccatctaagtggttcctccccatcccccacaagaaagatgaggggaattttattgaatattcactgtgaaaacctggtatagttccaggaagtgagagccataaaattgtcctcctaatcccatacctgatccatctgctggagtgtttaactctgtgccttgtccacattgagccttcagcaattcatcagttacagttcagggtttttgactgtgtctggataaggtcagccggtggctaggatgcaaaagacaccccactgagtttctgggcctgggtttctgctcaggtaagacgtgctgctctgtatttacctgtgggtctctccaatttatgggggagttggctctgagaccttgcttctctgagcggtcgaaaagagtttttgatttttaagtttattcatctttctacttgttacaactgagtgacaaccacagcaggatgaggttggagtgaaatgggtaaaataagcctgtgggcattggggactgtagacatgtccttcctctgatcccctggtgagtcagtggagagagtgaaaccacctttgcaaagattacagcagcgagatggagctagtatggcagacttcatcttacctctagctggaggctggctgtccttgctcattcatgggcataggccaggttaaccatgggaggaatttagtttacagtgtaattttgaagcaagaatgataatatccccttactaaaataaactccctcctactcaaggatggtctttgtcaaagtaatacaagaccataacattaggattataggagggaccaaaatcctgctaaaatgtagtcatagtttctataatccattattgctcaggagtcatgtggccagcagtcacaagacttgtgatttctttaattgctcctatagataacatcactattatagattatgagattggtcttttgagatatttctcagacttgcattctggcaaccagctggcctcatccagacccgtgagcaatgcctccagtcatgtggcccccagtcagaggcagatcaaacacacagagacgatttcccccacctgcatgatttcattcccatccaatcaccaggacccattccttagacctcaaactttttgaaaaactccaaccctagccattggggaggttgatttgagtaataataaaataagctcctgtttggcagccttgggctaattaaaatctttctttactacaaatcaccctcttcataaattagttttgcctgcgcagggagcaggatggacctgtcggtcttcctgtcaggtaattataagagtggatggagaaaccactcatttctatctggtggcctgttccatgagtcagcctctcagaaggaaagagccctggaacaggatacagtgaaagctcattctcctggtgacctgaagacaatggctcataatggagcctggcggaagtggcaactctggctaatttcagtgttttttttgggggtggggagggggtgcagtcaggccacagtgtgagcagaaaaggagcagaatagtcagcttttgtctgaggaagtccaaagcatggagaaagatgtgctggacagggcatgccagctagaatgaaggtggagccgggggcagaagatgagggacacagaggagcagagggagccagagacacccatggcagggagcagtgaccccagtgaccaggggcccccagggtctcagttcagtaccagggatccctgaaagccctcccatggcctaggaaccctggagtcacatgagacgaggtagctttagggacagggagtaagagggaaggaacatgggtctcagcacccaagtgatagggaacaggtgtggccagaaacctctaggattctgcatccaggatccggtccctaaagaggttatgaatcattcattccttcattcaatggctccttccctcatgtgagaactacagagtgtgtatctcacactgagcctgtgttagtgtgaatggggagagaaagccaagtcctctcctttattctttcatgggaatgatactgactctttggaaaacacaggatttcaggttccatgaggaggattaggatctgagggaaaggtctggacattcctcctactggctctgacagttgaggcaggtgatttagttctggagtacaaacgaatcagtagtccatttgctctcactcctctgaggtttggatgcctaagaagaaaggatttgagccgacagatgaccatgggctccttagaacttaataagacctcacttctcatggaggagaggatggaggtgtggttacagaaagacctcgtgtgactctgatctgcccctcatgtttgtgtgaccctggttcagtgactgtgtctccctgtggctcagtttcctctcaatcatataagctaaatggtaaatggtctgtgacttgtcgtgttgactctgaatgaactttaaattattcacagtcacctgacctaacgcttggcatagaggaggtgttcacacaaacagtgtttattatttgccttcatgagtgagcaccctcagacctgatccctgtggacaagttgctgccgggaacatcttgtctcttctatttctgtcccaggggacactgaactttctatggggtctcctaagcctcccagggcagttggctgatagcctaagaagcttgtccatctgttcactctgagtctcaggtgaaagagaaggctctgtctttgaccagatgaggctcttggggctgaaccctgcctgggagcagctccagagccacatccatcatacagctggtcaatacttgctcccagtcagtcctgctcaggaggccacaacccagccctggcacaggttttccagggtcacttggattcaggatctgaggactgggttctggggccagggcttctaggcttctaggactgagcttctctataaggatcccaggggacccctcaaaccgggccctgatgtagttctccagggtctttttccgaatcatgttcatgggaagtgcacagggtgatgggctgagactgatctcctcctgctgagtttcccccatcagattgtcctttctctgcagcacgtgtcttcagagtatggatgcaggaaatgaattctgatccattgaaatttgtctaccctgtgtgtgtcctgcactgaatgcccaaacactaaaatgggacataatgcagagggggacacaggcacagcccaggcctaacaatcctgtgggtgcgtgaagtagaactgacccccaacacccagaggtcatgaattcctcacggtgtacacggaaatatccagttgcttcttcaatggtaaaatctgtctttatgatttgtagggtatagaatcctgtgtcatcctgggtgactttccgggtcagcagggatgcattggcaaatattacctcctgactactgtatgcaggtcctgagctagatctttgaatgcctgttgcatatcctaaaattcaatagtagagatccacacttcttcctttgtgccaattgtagcccatcactttcaggggcagattgtgggcaagtagaaaaaactcctcctcctcctcctctgtggcattgaatggcatggcttcagtagtgactctggcagtggtgggtgggttccagaaggttaaaagtgaggctaggatggggagggagcatcagtcaatatcaaaacctatgtattgggatggaaagttggggccctttgtccttagaggttctcttcacccatgagccttggagagagagagaatgtgtgtgtgtgtgtgtgtgtgtgtgtgtgtgtgtgtgtgtgtgtgtgtgtgtgtgtcctgctgggtcaaggtcagcagcatgacccccattccttcaacacctctgaacttggcatttccctgtgtggaatcctcttccccaggggtctgcatggttccctttccactgacctcatatcctgctcacatcagggcatccttgaaagagccctttcttgacacctccactagagattctgggtcttccctttctcacttttccctgctcagttttctccagggctcttgtcaacacctgacctcacattctagatatccttgcgtgtctcgctcccctccccataacagcatcaggttcatgagggcagggacttgtatgatcttggttgtaccgcagtgcctgggacatgctgtggactcttgtgaatgagtttgtgagcattcccagagccctccaaggcctgtgatttatttcccaatttctgaagttggtggctgatgacaatgccttataccctcactatgtttttatatgaagtgttatctgatatagttattatgatcatttttcaaaatgtagtggccagtgatgattaaccgggaatagagaacacttgagatttgtttgcttcttaccataaatttcagttcaatgtgattttcctgttttaatcctgtcccttctggtgtcctcttttctgttaaggcagcagtagaagctctaagtcctctttccccaggagccccattttccccaggagacccaagccagtccctgtgccttctcatttcctcttcaaggaagttctctcctcacctgtgaacatgagcttctgccagaggatgtgccatctggagaaagggactgataggggggcaccatggtctgtgctgcctgcttgtcctcctctgtggagatgagcctgggatccggaaagtttctgagcagggctgtcagctgggctgtccttccaccttctatgctgagcctcttcctggggcaggagcacttctcaggctcatgggtggggtctgtacccaggacacctctctgtgccctcccctctcagtcctgcttccttgtccctcctttctgtttctcttctgtctgtgtttcaggcccctgggaattgctgagtcctctgcctccttcagcagtgattctctcacccaacctctacacacactatgtgcagacacacacacacacacacacacacacacacacacacacagacatcctttaggtttggtaagcacagccctgggccctcagtgtcctcccatttccattgctccaggtcagggtgcacagtcgctccccctgccctctcccattcccatctggcttttctcttcaaagcaggaggctgggctgcaccatgaccctgtcacagtgatgcaccctcaccttgctttgggtgggctgagtgctggctggtgagaaggaccctccctctctttcattatgttgaactttgctacagcttccatggttagacattcgatgacccggttgtccaagagggtattttccttcgtggaggtgtgcaggatcaatctcttatgcctcctggtaggaaaggcctgtgctgattggtcagtggggcctatgggcccagtgttcaccagggacaggtctcagccactctcttggtccctgggttctggtggctgagctggggtgaggcccatccattttcttcctgaccatctttggtgtcctctgtccttggcccagctgactgtcctgtggtcaccccaccttccccacggctggtgcaaaagggagtggggtgatgcccagggtccccacagaacacagctcttcaagacccagagagagagactgggaaagaacaggggctcagagctggagagatttctgcagacttactctgcagccaggatgggcttagcccttcttgctatacatcccttggggttcctcttgagggattgaggcagatcaagctcctctgtgtagaagaagaacaggcagtggctggagagcctgcgtgaagggactttgctcacacctgagagggtgtgtgggggtgggccatgttctgagaacaaaaggagctcataccccccacttcaccttccccatgcacaaaggacagccctgtcttccctcccagcttcacgagagacagcagggggcagattgtgggtgagtagaaaaacctccagcaggtggccacatcatggatggtgcctgtgcgtgaccttcaaacaccctctgcacctcctagcgtgcaatgggcaggtcatagggtgcctggctgattcctaggaatactgtgggcactcaggcagctgctgttctgtgtcagcactgggatcagcctgggataacctagagaaccgtacagagggagtggggtgggaatgtagggagcagtcacagaaaaagttgataaggatggaaagaggtcacaagggtaaagtgcctaatatggcatcatgtggaccatcgctgcccttgcagatgcccttttggctgggtcagcagcccctggggagtcttgtggctgggattctgccatcctctggtgaacatgggggaaatttggatgacagcagccccaggcaaggctgcatgttttattccatgtgaatctgcacatttcacagcagattattcacctatgtcacagatccatcacattccagccccatgagtctcagtctctgtgactgtaagttcactatcctccctctatcacaatcagatgtcccaaacacagatttctgtcacctgtgagtttgtgtttgtgtgcagtgggctgcactgtgtatgccctggggacagtgatgtctgggtggggctgagcactgggcagaggtttggaagcagaagagggaggtgcagggcaggaagatcaatgacagaggagcagagagggagcagggacaagtcatctttgtttctcactcccaggggaccaagaatgcaggaccctgaccttagggctcaacaccacacactgttggtgtccgtggatgtcaccagtgctcgtaatttcatgttgccttggcattcatttattaaggtgtaagtttacctgctttatatcagaggcagggcttggtcaccgtgacagttcccaatactgtacctggccaaatggctgcagttggtggccagagataaaatcttagaggcatctctcctgcttagtgtgctgggctccccctctacccagctgcttcctttaaactgacggttgtgaaatttgccctgaaatttaaagtgaccacctctcagtcacagcgtggtcacctggccccagtgtttgcttgctttaaactcacccattaaagctttctgctggaaacctcagctaacgccttggacccactaaagccattggcctacaggtccctactttcctctctgcctggactccttgacctctgtgtctattatctctaggtgtgccatgtgctcctcagagtctgtaaatagcaaaaaaaaaatttgtactttcacattgtggttgtatcactatagcctcacctgccatctggtgcctgacattgaggctgccccatgggacccatgctggttgagcccctgctggagctcttttcttggggtctctggtgctgctggggacaggcactgtcaggtgatttgatggagaaatggaagagttttattcaaaacagtgtgtcagatgatgttttcatgggcttcagctgctgtaacaaacaccttagtctgggtgacttaaaatttagaaatctatttctcatagttctggagcctgggaagtccaagttcaaggttccagctgattcagtcctggtgagggcttccttgcagattcctgctctcttgctgtatctgcacatggtgcaggcttgaaggtgggtggagagacagaaagaggtagagacccttctcccatgttttcttctatttataaggtcattaactctatcatgaagcctccacttttatgacttagtcttactgtaattatctcccaaaaatgccacctccaaatttcatcacattaaggatgagggctttaacaattttgagggggcacattctgtctggagcaggaaaggtgggagctccttcccctcctgttcatgaggcctgaccttccctggtgagataacttcacattcagtctcattctaggttgcagctccacagagcctgggttctcctctgctcttctgcccattcctgggttttccttcttgcaccaccttctccctgtggccccacctgctcctgttccaggcagctgtccttgcgttgctgctctctcaccatctctggcctcactggcctctgcctttttttttctcagccctgaggccagctccatgggagggaggaagggtgaagctgggatgggttctgaccaggttgctgcccgctatggaagcttgacaatgagggacgctgttgtgtcaccatggaggagtccttaggaaaaggctatttctcaggggtgcctggatcaaaaggggggtggcacttttaatttagctggatctgtgaactacagggactctgctccatgtcagcaaccagcacctccaacttttggtttctctctgtagctgattgtcttgcctgtgataagatcctcctcacaatgactgatggtcacagccgtgtgtggaaacttaatggagggtcttgaatgctcacacagagtgtccagggaacatgcttcctgatgttgagaacgggtgctcagtgtcataaagataaacactgagacaaaggatctctcagaaaggctagtttactttctgcagaaagggtgtcactcgctagcagtcttgccatgacagcacacacaaacaaaggagacagggtcatttataacctgacccgtccaccctactgctatgtccagcttctattggctggaacggacctcccaatttgtacttgacttgattggctagcaacttagaactttcccaaagaggcaaaggcagagaataaaggaagagaggaattaacttgtggaatgctgagagaggcaaaaacattttcaagtagggaaaggaataagcctgacctaatgcttgcttggactggttcaggcatatcagggcaaatatctaagctaaaatgtggggtctaagaacacagagtatattgatttctttattatggctggcagaatttaagaatattagcacaggtctttgagaaaattgtgcttttaagagaggttactatttattttcaattagactgggaggaaaatccctttgaagaggacctctatttatttcattctctacaattctcccctcttttattttataattactcttcaaacttgtttaatatgttttgacttaattgctctgtttgtccttttaagagaagtaatctttttgaatatggtggagagttaggaaacaattttgtgagagtagcagggacaagtttttgtataaagctttgaaaacatttttatttatagttacccaccagaacaacaaagatttaaatctcacagctatttgatttcgtgctttaaatttatctggcacttcttgcgggaccccaatagtgtttatgtaaacctgaggattaaaggatttataaagagtttctttgggcctgcagtgttttgtttttactttttttttttttaaggctgataaaatgccagggtgaaagggatagccaattggattagagcataaatactcctccaattatctggcagagtgtccagtaaaggtccttcacagtactagcatacatttgctcaggggtggctaagcacagactgatgggcaagctcctggaaaggcttgagcttcttgcatccttttatgcttccaaggaacaccaaattctccacttgccatgggaggcacgaactaaacttggcatttagaggtggaagctggattgcccttgggggctgacccacagggtgtcaagctttaggaaacagcagagagagagctcagcatgatggattatcccaagcagtgggattttggtaggatttagcctgtggtagaatcctcctcacaatgactgatggtcacagctgtgtgtgaccatatggtccatacctggttgatgaggagaccatccgagtggaaaggggacaatctgggcgtctgtgcacaagcataacaatcactgttatttaaagtgcagatggaatatttaatccattccagccgggcatttgcattttgatacattgtcttaatggctaaggtttgttttagatctttcacctttgcaatagacaccgtagttttattataggtgtaggagtaagtgggatgggatctaaaactgaggctactgaagaaggggaagatggggaataatgcatatctaaaaaatgcatagggggtgtttcccatttaggtcgatccccataccatagaagcaactaagagtaggtttagagtcagttaaggtggaggtggtgatagagagaaggacagtgttacactgataaggctggcaattagaaggcgtagtccctttagtgaggggttttagatctgcacaaacctcttccgtggaagtccaaccttgcacctgagtagtccataggatgtagtcccagctactacaaggttgccaggctataggagcagaaaattggtgtctcggctgcaggtattcacaaccatgagtgctaggaggaactatgtcaactagagggccggagcataaatatttgtgtgaaaaagctagctgtcattgatccttcacatctttacaaggtatgacagagcatgcattaaaggcaatggtctgagatgagtcagacttagttatgttaataacaaaaggagctagtaacagaataaggaaaggaaaggaagcaatatagaagggatatggaaattaagcttttggttttttttaactttaacttgttaaggcttgatcccggtacactaacctatgattctgatgaggaagatgatttcttgacttaagtatggtgggtccatcttctcttggctgtgcggatggcagtcttggtggtcaactgtacaggataagggccttcccaggcgggcacaagtttcccttctttttaccctctgatgagaacatggtccctgggttagtgctggtgagctagaaattctagcggtggtgtctgtgctaagagatcttttatcttaagagaagaaaaggtagcggagagaccaagtatataatttctgaggaactgatccttagtttcaaacataggaacattagctgaggaatgtaaataaggcaatccatataacattttatatggagacaggcctgtatccttttggggagctgtcctgatccttaataaggcaatgggaagacatttggtccatggtaaatgagtttctagaattaatttagtcagatgattcttaagggtttgatttattctttctacttgtccggaggataagggatgccagggaatatgatattcccattttatgtctagcacttgggccagctttttaataatatgtgcagcaaaatgggtttcattgtttgagtcaatattttctattattccaaacttgggtataatatgctcaattaatggttttaccacattattggcagttgcctcgaaaaggggatggcttctacccagtggttaaggtaattaattattactagcaggtgttttagccgactaatgggtggcattttagtataatcgacttggacgttttggaatggtcttaactccggagttcttcctccgaaaggcaatttcctttcagcttgtttgtcagctttcttacagatgagacagccatttgtgatctgcctgtctagaatataaatgccaatacacctaaagactctgagaatcatgtcacatagggcctggggaccccagtgagtcccttgatgtaaatgggataatacttccctcataaagggtttagatagcatctctctttgatctggaagtatgcagctttcttatgaatttttttttttttttgctttgggatttcaactaatttttctttcccagccagggagaagataggcacaacagtaggagaaggaaggtggggagttaaatgaaaaatgggcatatctaagactgcagcctttttggccatctgatctgcaaggttattccttcggctcttaagggaaaaatcatgttgatgtccaggaatgtgcatgatggctatctactttagtagctggagattatctaagacatgactaatgacttatgagcaagttcttggcccctactatttataagaccttgttcagcctaaatcttcccaaatgtgtgtgctaccctaaaggcatacttagaatctgtgtagatagtttctatctgatcctttaaatattttaaggcctgactgaaggcaaataatttacaagcttgagcagaatagctattgggtaaccatcctgatttaatttcttcgagtgtctctctatctactactgcatatccactgtgttattccccattaaacacccagggggacttgtctatgaataggtgttgccccgatctatagaggcctcagctaaatctggctggacttttgtatggtagtcaattaagttgaggcacaagtgttctgtctgtagcaacggatttcccgtcaagaaccctgcagggttgagtgagttatctgttgttatggttaagtcatttaaatcatccttttttttttaacagaatagccttatattttaaaattctggaatcagtgggccagcttcctgctttttggctcaaaatggtcttgacttgatgagatgtgctcacggtcaaataccccccaaaggttatttttctacttttttctactaatatggctgtggttgcaatagattgaatatactggggccacccactggcaacaggatttaaaatcttagacagaaaagctactggttgtcaccggcctccgtgttcttgagtgagcacccctaaggctactccattgcttacattaacaaaaaggtggaagggcttcttaagagaaggcagagctaaaactggagcagacattagtctatgcttcagtttattaatttgatctacttctttagaggaccacataagggggtcaggccccttattagctaacttttcatataataatttacttcttaatgcataggagtcgatccataatcggcagtatctaattaatcctacaaactttttaagttcttgtttgatccagggcagtggcagggacagaattccttctactcgctcaggaccaattcttcttttgctggtgctaaatggcccatgtatttgacttctggttctacatattggagcttctcttttgagactcgtagcccttcagtgtataaatgatttagaaaatagatggtgtacttatttactttctctatatcctctccaggtataagaatatcatccatgtgttaagtaaacatagctgttttgggatagcagccctctctatgactttctctaaggcatgactaaaagggtttggtgaatctgcaaacccttgatacagaactgtccatctgtattgttgcttctgcccactgtgggggtcctcccactcaaaggcaaacaggtcaggctgttttccactaaaagacatgcccagaagtcatcctctaaatttaagacagtgaactactgattactatatggaattttacttagaatagtgtagggatgggccaggcgcaatggctcatgcctgtaatcccagcactttgggaggccgaggcgggcagatcatgaggtcaagagattgagaacatcctggccacttggtgaaaccccgtctctactaaaaatacaaaaattagctgggcatggtggtgggtgcctgtaatcccagctattcaggaggctgaggcaggagaatcactggaacctgggaggcggaggttgcagtgagccaagattgcaccactacactccagcctggtgacacagtgagactctgtctcaaaataagaaaagaatagtgtagggatttggcatgattgggtgaggagtctgcactatttcattaacagctttaagatcttgcactaatcagtatgacctgttaggtttcttgacaggtaaaatgggagtattatagggagacatgcaaggcttgaggagcccatcttttgtaagtctattacgggcttcaaccctatctgcccttccaaggagataggatactatttattccttacaatctcccctggagtcttcaattttatttggattgggggaatctgtaacctccttcagtttctttcttttggccagacaccaggggaaattttgccatagttagcaaatttagtgaggttaagaaccctcttgggctaacctgttaagggaagagaccacccctcatattgtcttatgcccaatttctacttccaaaagaaagaagaagtaaaaactaaaaggcagaaatgaaatccacaggcagacagcccggcaccgcgccctgggcctggtagttaaagatcgacccctgacctaacaggttatgttatctatagattccagacattgtatggaaaagcattataaaaatccctgtcctgttctgttctgttctgattaccgctgcatgcagcccccagtcacataccccctgcttgctcaatcaatcatgagcctctcacacggacccccttggagttgtgagcccttaaaagggacagaaattgctcactcagggagctcggctcttgagaaaggagtcttgccgatgctcccggccgaataaaccccttccttctttaactaggtgtctgagaagttttgtctgctgctcatcctgctacgctgtagaccaatacctaattttaacattaaatctctccgaagtagattagtttctgctttaggaattaataggaattgaatgttacttgatcaggctttatattttaccttggcactttctaaaatctttgctttaaatccttccccttttactccagagactaacaactcctctggagaatatgttagcccagttggggtaacacatagggaggagcaagtagagcctcagtcgactaagaaagtaattgactcatggttaggtcctacctttaaatttatcaagggctcctggtgggactcgaggtagaaaagaaagagcccctgacaccccccattcctcctctttaaaggcaggaatgagcggaggagctccccctgtaatctgtcacttagggcattatctcttaaagtggcctgagtttccacatttgtaacatctatcttgccctccttttctccctattccggaacttccctgcctctgtcctttttcttctctcttatgtttacaccctttacaacacttgctgtgactgttttcccttcaaccttgattctgtcttctgttttgcatccccaggtcccagggtgtcggccgaaattttgcttctggcattgattgccctggtgaattttgccaaaagatttttgccttttgcttttctttttttcatttcatctctcctgacatatactttctgtgcttcctctaaaagctctttgatggagcgattttttcatctttttattttttgtaacttctttgctatattatgctatttgtgacaaaatgcaattttagcatcccttgtcctggggggctatctagatctaaattagcatactttctcatttgctctcttaatctgtttagaaattgcacaggcccttcatgtttttcttgttgtacatcaaaggccttagtaagattttgaggtcagggtgctgattctttaatccctctaaccgttaattctcgtaaatttttatatggtcttggtgggttgcattattattatcccactgtgggtcttgagtgggaaatttagtatttgccaccggattatcctggcgagcagggtgatcaccttcccaggctgccatagcggctgcgtggattatgtttcgcttctcttttgagaagaggatacctaggatcgacattaactccgtccaggtatactactggggacctaaaaactggtcgatctgttctgccactccttttggatcatctagcaggggcttgagctccctctttaggcctcagacctcagaggcagttaagggagcatttataaagccaatcgtgccctctccttgtggaactttttttagagggaagagctgggaagtcgattctttaggagtgcaaggaaaaggaagattctgaatgtcccttttacattgttctatctctttttggagccctctttttgaggaaggacatttagatgggcagcagagatgatcaagccactgaggcggtaattcctcgggaacagacgcctccaagtccagagtgatccctggagcgggtgggggggacgagacttccgcctgaggaggaggggaggcgggacttctgccggaggaggagtgggaggcgggagttccatctgaggaggagaaggcggcagccatacggcaggcagcagcagcgccgtgggattcagaaacgggaagataatttaaaggatcccactaactgctctgggcctttgtttctgtctgttaccgtctttaagtcatttaaggggtaaagaagggcaggcccttgctgctagcataaggcataatccattttttctggggacatggggctttggttgttaacatacattattaaaagttgacagacccaatcctcatctgaaccaaattttggccagaaaatggcaggttttaaggttggctcttgggtccagaggaaacagcaatatttaatcatctgttgttttctcttatatttagtccgctcatcctctttccaatattatagcatgaatcctaagggactatcaaaggaaatttgatcactgtcccctcccttgttgcctggtctatttcctgtcccaatcctactagaagcatttcccatgttgaatcccagataggcccaatcccttgtgctagggatgttttgcctcttcctttcccaggaaggctgaatcccccagataccggggatgtctcgtctgtcctgtcctcaaggcttaatctctcacaccagaggtgtttcaccgattctctttccctgcgaggttaaccttcctccgtttcccttttggaggttccttacactcttcccgtttatgtccacgcactctgtccagcaacaagttggtaatcgtgcacacacactcagcctcccaaaagctgaccaccaaggaagtactttgctgccctcttgcggcttttcctaccttggcccatgcacggcgttgcctggttactgtggggagtcccgcaagcctgtctctttccccgcgttgctgagaattcaagtatattcctctcaccgggtaggtcccggctctcctcctggggctgccgcaacgggcggcagggcgcctccccacaagacagggccaaagactgtcccagaggggaatgttaatctcgctggggccttcaaattgttggtaacgggtgctcggtgtcataaagatcagcactgaggcacagcatctctcagcaaggctagtttactttctgcagaaaaagtgccgctcgccagcagtcttgccatgaatgcacacacgaacaaaggagacaaggtcatttataacctgatgcatccaccctactgctgtgtgcggcttccaatggctggaacaggacctcacaatttgtacttgactcaaactactacaagtcaaatacagcaaaaatccaaaaacccgaatttaaaagtgaacaaaagactaaaatacttcccaaaggaagacacacacattgccagtgaggacatgcgaggattctcaacatcactaatacttacggatatgcaaatcaaaaccacagtaatacaccacctcacacacattaaaatggctttaataaaaacaacaacaacatgaaaccacaagtgttttcaagtaggtggaaaaattagggctctagtgcattgctgctggtgatgggaaatgttatagatgctgtggaaagtggtatggcagtttctcaataaattaaagaattactacttgatccagcaattctacttctggattctaggttgtgaatgcgttgattatctttagtgaactatagaaagttttctttatctggtgaaaatacactgtaacataataacttagtagataacatgagccctcttgcatgggagagcttttatacaaccagaaccagaaaatatgcattgaaaataacaattgaatgaaatctcattataaaatgtttaaatggaccagcaggtgaccaagtgtacctgaagctttgattgttttcccaggaatatggggccaaacattggttataaattcttttaacaatttataagtcaccacaccaatatattccatttgaatatttttatcttttccatgatgagtcatggaatgcagaacttttaataataaaagctttaaggacttaggaaggacaaggtggccatcctggttctccatgagtccatgcttaattaatattagactcatatcctcttgaatcatagtttttcttcaaattatgtgcatagcactgataactgatgggttatcataggtaatttgacttagaccatgacgttcattcaaattgtatatctaagtaattttaatgtcagctgatgtagcatgagtgctgattggttaggtaggagatgaaatcatgggaagttgaagctgtccttttttgctgagtcagttcctgagtagaggtcacaagatcaaatgacccattttatcgatctgggtggggccagctcatccatccatcaagtgcagggtctgccaaatagctcagacagatctcaggagcagtttagagagggtcagaatcttgtagcctccagctgcatgactcttaaaccgtaatttctaatcttgtggctaatttgttagtcccacaaaggcagtcttgtccccaggcaagaaggaggttcgttttgggaaagggctgttatcgtctttgttttaaactgtaaactaaattcctattaaagttagttcagcctatgcccaggaccgaacaaggacagcttggaggttagaagcaagacggtgttcattaggttaggttagatctctttcactgtctcagtcataattttgccaagatagtttgaggagaatcaaattttaaagaaagacacataatagtgtcacggctagccttaaatattctcttgactaacttacagagcaaaaatctagccttaaacaaagttaagttttttgtaatctcaaatgacttgctttagatctcctgaggcaataaggattaaagccacttcaccatgtcatccagtagttaaaattccacactttcactgttgcagcctggattcaattacaagtcagagaatgaaccgcttttgttacaggaaaaaggtcccaatccatgcccaaagagaggattcttggatcttgcacgagaaagaattcagggcaagtctgcagcgcaaagtaaaagcaagtttattaagaaagtaaagtagtgaaagtacagctactccatagtcacagtaggatgttcttgaaagtaagaggaggcacacacccaccctaggtacagtgctcatatatatggggagatgtaccctgctacaaaggtttgtgataaggattaattttcttaattgtgatattttgcaagaatctaagttattatctttaaagcaaaattaggaatcactttgttttccagatattgggatatctggacactcccaagtctgggtctgtttagtaaatattattgatttgttcccttaaccataaacatctagaggctaggaatgcctcactttctggaaatgcagcccaacaagtcccagcctcattttcccagccctcactcaagatggagtcactctacttcaaatgcctctgccacttttgttttgatatttgtgtgatttttgagtttttgtggtactcatttacatctttggagatgtctcatgcatccttggctaagtcacaattatggttagtgcttatcagtttcagctgggaggatacttttggttaaaaaaaaattcaaaagccagaaatatcagctgtttgtcctagctaaaatctgataataaaaaatctgaaagtattacagtgggtagctagtcagacatcagcaggacaggagggagcctccttcccccacacaccaggaatgtcatgaccatcaggtgattgtcaggtggtcgttaactgtctctctaaaataataatgggttgtagctagcaccagggaaaggcagtctcccaatagacaggaaacacctgaaacagttgatcagctccttcctgataagttctcagaagttgggtgagtgggctaaaacatgtgcattaagaggcaaaatggtggagtttaactggtttgtgacctcccagggacatttgactggaaagagaagaacacctcaagtgagcatgcatacaactccagtaaatacactgcgcatgttcaccccaccccaagtgctagcaggccactgcacatgcagacagcccactccaaagggaaaataaggggagaggagatgcagaccccagaattatgccaacatacaaaagcctaagtcagaggtcaagcaatgcacttgatctcttgttgcctgcttggcttttttatttttttatttttatttatttatttttttgcaacagagtcttgctctgtcacccaggctagagtgcagtggcatgatctcagatcactgcaaccttcgcctcccaggttcaaatgatcctcccgcctcagcctccctagtagctgggactacaggcacatgctaccacacccagctaatttttgtatttttggtagagacgaaatttcaccatgttggccaggttggtctcaaactcctgacctcaggtgatctacccatctcggcctcccaaagtgctaggattacaagtgtgagtcactgtatccagcctgcttgactctcttttaattgtactttacttcctttaattcctgccttaaagcttttaaataaacttttactcctgctctaacacttacctcagtcccttcttctgccttatgcctcttagtcaaattacttcttctaaagaggcaagaattgaggttgctgaagacgtctacagattcactgctgctaacatgctttggtgtcatttctcagctatgtttggcagctaagagaaggatttcccaaaacagctctgtgattaagagtcagcttaattaaaaactggtatttaagccatatatttattaatggtatttaagccatataattattaatatttataatattaagccatgtatatattaaaataatatatatataaaatattatatatatatagaatatgtatatacacagaatatataaattcatattggatatatattgagaaaggacttgaatgtatattgaaggcttttctgcttttctcttttgtatctttttttttttttgagacaggctgtcactctgtcacccaggcttaagtgcagtggcacaatctcagctcgctgcaacctccacctcctgggttcaagggattcttgggcctcagcctcttgagcagctgagattacaggcacgtgccaccacacctgactgatttttgtatttttactagagactgggtttcgccatgttgctggtcttgaactcctggccttgagtaatctgcccgcctcagtctcccaaagtgctgccattacagatgtgagccactgcctctggccatctcttttgtatctttgaaagattttttttcagttgactgaaatctttttaaatcatgtgcttagtctgtctggtttttttcttaaaaattctttttctgcttatttctctttccatccttcctcttgctattcttgatgccacatgagggaacctaaagaatttctgacagcctggaaccccttaaggaaaacagaaaagatgccacagacttccctatttaggagaaaccactgtttttcctcatggaaccccaagagttgtaagtaaatggattcctctcaggtctaaaactctgctctcttttccattttccctgacctctttggcttttgggggcatcagagattactttgcactgtaaaaatgcttgaccttatatgtgtgatggctgctgggtcactggtaagagctttggttttggaggtgactaacagcgctcgcaataaatgattattacttcagaatgctactcatttctttgcaagtttagataagaaatacacagtttaaataattagaaaaatgcccttatagcaaagtacactgtggaagtgttgcatagtatggttccattggcattttcctcttctcagggacctgggattcagtgaaatccttgatttataaaggtctggatgctgtcccttgcaactgggtcttctttttatgtatttaaattattaggatctaaaagttgcaagacttcgttggtcctcttccttaatgggctctgtcctgagctcagtggtccagttggaaaacagagaccaaattaaaagctgcctatctaaataaaattggtctccttataaaatcctatggtaaatttctgtcatttttgtgttaccttggcatctatttttaatcttccttgaacacacacaaattccttcttgtaaaagctttagttctctttctctctgtgctttgagatgtaaatttgctaccaattttctctaaaactcaataaagtctggcttaattaaatgttaacctcttccatttacaaaggcacaaatttaatccaactgtcttttttaaatactgaatttgatcggtcctatgctgaaatcaaaactctaaactctttctgcctccctctatctttatgtgcacatgtgtatgttatatgctgtatcacatatatgtctatgtccatacatatgattatatgttgtttacatacatggtatcaaattaatgtaaaaataagtactcataaattaagtaaataatcccaaatgcttttcaatacatgtgattttagtaatctttggtaaataaagatagtttaaaaattattggtaaaatgaagtagaaatgtcttcagatttaatttagacatttgtgcctgggtctgttggcagacatttttatattgtatttactagatgttttagggtcatcatatggttgcttctgtatatatacattttcttaatttttctgtgaccttatatctttagatttgagcctttagattctgagttctagatgagcgaccatagcaagaactggggacaaaactcatcccatcccacagctgtgccttttggccatgctggaagagattagattctccaggtataatcttcatagctttgctgtttatcttgggctttacacctggtaactagttagaattgcttacttcctgttttttctctcctgaaaataatgctgtatttgtttgttctcacattgctactgagaaatacctgagactgggtaatttataaagaaaagaggttgaattggctcatggtttggcatgactctcacatttgctcagcttttgaggaggcctcgggaaacttacaatcattgtggaaggccaaggcagaacaaggcatctcacaggtgagagcaggaggaagacagcaagggttacacactcttaaccagatcacctgagaactcactgtcactaggaaagcaccaagaggaatggtgttaaaccatgagaaaccatccccataatccaatcaccttcaaccaggctccacctacaactttggagattacaacttgacatgagatttgagtgggaatataaatccaaaacatatcattctttccctggtttctctcaaatctcatgtctttcttttcatacgtgtccgtgtgaagagaccaccaaacaggctttgtgtgagcaacatggttgtttatttcacctgggtgcaggtgggctgagtccgaaaagagagtcagcaaagggagatagggatggggccattttataggatttgggaaggtaatggaaaattacagtcaaagggggttgttctctggtgggcaggggcgggggtcacaaggtgctcagtgggggagcttctgagccaggagaaggaaattcacagggttaatcactcagttaaggtggggcaggaacaaatcacaatggtggaatgtcatcagttaaggcggggcagggccttttcacttcttttgtgattcttcagtaacttcaggccatctgggcgtatacgtgcaagtcacaggggatgcgatggcttggcttgggctcagaggactgacattcctgccttcttatattaataagaaaaataaaacaaaatagtgttgaagtgttggggtggcgaaaatttttggggggtggtatggagagagaatgggcgatgtttctcagggctgcttcaagcgggattaggggcgggtgggaacctagagtgggagagattaagctgaaaggagatcttgtggtaaggggtgatattgtggggttgttagaagaaacatttgtcatatagtatgattggtgatggcctggatacagttttgtgtgaattgaaaaactaaatggaataagaaggagaaaaacaggtataaaaggtctaagaattgggaggacctaggacatctgattagagagtgcctaaggagattcagcatagtcctgccagcaaagattatttatttacttcaagagttaagagtggcagtttggggatagcacgaggagatatcagctgtgatggcttggagaaacagtgtaaactggcagtgtgaacaagagcagggcatgtgtgagtagttgagaatggagaataggaatatgactagacagaaaatagtagggatgacaagttttcttgggggcacagtctaagttggtccagtgtctggaatgagactggggcctaataaaaaggagcatctatacaggagcttaaatgggctgtaccttgtagcattctgaggacaggcctgaattctgagaagtgaaagtggtaaaagtattgtccagtcctttttaagttggtggctgagcttggtgaggtgtgtttttaaaagacctttagtccgttctacttttcttgaagacggaggaccgtaagggatataaaggtttcactgaatactaagagcctgaaaaactaattggctgatttgactaataaaggctggtctgctatcagactgtatagaggtgggaaggctaaactgaggaattatgtctgacagaagggaagaaatgactgtggtggccttctcagaccctgtaggaaaggcctttacttattcagtgaaagtgtctatttagactaagaggtattttagtttcctgactcgggcatgttgagtaaagctaatttgccagtcctgggtgggggcaaattctcgagcttgatgtgtagggaagggagggggcctgaataatccctgaggagtagtagaatagcagatggaacactgagaagttattttcttgaggatagatttccacgatggaaaggaaatgagaggttctgagaggcaggctagtggcttgtactatagcatagcctgcatttgctggtatgtggcgattaggcctggtggaactgccatcaataaatcaagcgtgatcagggtgaggaataggaaagaaggaaatacagggaaatggggtgaatagcaggtggatcagagagatacagtcatgggggtcaggtgtggtatcaggaataatgtgggaggccagattgaagtccgggccaggaacagtggtaattgtgggacttaacaaagagtgagtacagctgaaggagccggggagcagaaagtgtatgcgtcaggtatgaggaagaaaatagattttggaagttgagaaatgtagagagtgagttgagcatagtttgtgattttcagggcctctaaaagtattaaagcagcggcagccgctgcacacagacatgagggctaggctaaaacagtaaggtcaagttgtttggacagaaaggctacagggtgcggtcctggctcttgtgtaagaattctgaccacactaaccatgcctaggaaggaaaggagttgttgttttgtaagggattgaggtttgggagattaatcagacatgatcagcagggaaagcacgtgtgtttttgtgagaattataccgagataggtaacagatgaggatgaaatttgggcttgactgaggtaatgggggctgtctgtgaagccttgcggcaggacagcccaggtaatttgctgagcctgatgggtgtcagggtcagtctaagtgaaagcaaagagaggcggggacgaggggtgcaggggaacagtgaaaaaagcatctttacgatcaagcacggaatagtgagttgtggaggaaggtattgaggacaaaagagtgttcgggttgggcaccacaagggggataggcaaaacaatttggttgataaggcacagatcctgaactaacttgtaagtcttgtctggttttaggacaggtaaaatgggggaattgtaaggagagtttataggctttaaaaggccatgctgtagcaggcgagtgataacaggctttaatccttttaaagcgtgctgtgggatgggatattggcgttgagtggggtaagggtgattaggttttaatgagatggtaaggggtgcatgatcagtcgccaaggagggagtagaggtgtcttatacttgtgggttaaggtggggggatacaagaggaggacgcaaaggaggctttggattgggaagaagggcggcaatgagatatagctgtagtccaggaatagtcagggaagcagataatttacttaaagtgcctcagcctaataagggaactgggcaggtggggataactaaaaaggagtgcttaaaagagtagtgtctaagttggcgccagagttggggagttttaagaggtttagaagcctggctgtcaatacccacaacagttatggaggcaagggaaacaggcccttgaaaagaaggtaatgtggagtgggtagcctccgtattgattaagaaggggatggacttaccctccaccgtgagagttacctaaagctcggcgtccgtgatggtctacggggcttctgaggtgatcaggcagcgtcagtcttcagccggtaagccaagaaggagtcagtcagagagccttgggcccagagttccttgggctctgggagtggctgccaggtgagttgaacagtccgattttcagtggggtcccacacagatgggacgcggcttaggaggaatcccaggctgcgggcattccttggcccagtggccagatttccggcacgtgtagcaagcgcctgggggaggaggttctggaggaacgcctggttgctatggttcaggcgtttggaagttcttgtgtgctggagatgtggctggggtttgtctcacagtggaggcaaggaattgcaacttttttctgttattgcacaccttgaaggtgaggttaattaagtcctgttgtggggtttgagggccagattccaatttctggagttttatttaatgtcgggagcagattgggtaataaaatgtatattgagaataagatggccttttgaccttttagggtctagggctataaagcgtctcagggttgctgtcaaacgagccatgaactgggctggatttttatacttgatgaaaaagagcctaaacgctatctgatttgggataaagaaaaaggagcattaaccttgactatgcctttagctccagccacctttttaagagtaaattgctaggcaggtggggaagggctagtcacggaacgaaactgtaagccggaccaggtgtgaggaggggaggcaataaaaagattacagggtggaggagcggaggctgaggaagaattgggacctagcttggcctggcaaggaggggagaggtcagatgggtctgtagaaaaggaagattagaaagactcagcgacgcttggggttgggactgaggggacaggcgggagatttgggacgagttgcactgggcacagagactaggaagggactgatgtgtaaaagaatgcctggacgtcaggcacctcagaccatttgcccattttacgacaagaattatttagatcttataggatggaaaaattgaaagtgccgttttctggctatttggaactactgtccagtttgtattggggtcaagcggcattgcagaagaaaatgagatgcttagattttaggtcaggtgagaattgaagaggttttaagttcttaagaatacaggctaaggaagaagaaggaggaatggaaggtggaagcttgcccatagtgaaggaggcaagcccagagaaaagagtagagacatggagaaggggtgggggtttcttgcccaccagaaaagcagagaaagggtcggagcatggaaataagggattggggtgcagacataagaggttggggcatggaagtaagggattggggcacagagataacaggttggggcgcggaaataagcaattggggcacagagataagaggttggggcatggaaataagcgattggggcgcagagataagaggttggggcatggaaataagcgattggggggttcttgccccctaggaaagcgggacttaccgctaagggtgaaggagaaggggttgagtggtacttgcccctgccccaggaaagcagagaaggggtggagagaaggagagaaggggttggggtacttgccccacccccggaaaagcagagaaggggtagagacaaggagagaagggttggggtacttgccccttccccagaaaagcagagaaggggtagagacaaggagagaaggggttggggtacttgccccttccccagaaaagcgggacttgccgctaagggtgaaggaccaagacaggcgtccctgcgtggtctgacacctttgaaacgtgggtgaataatcagagaggcgtccctgcaatgattaaacaccaagggaaagctgccttcccagtctgtgaccggcgccggagttttgggtccacggataaaacatgtctcctttgtctctcccagaaaatgaaaggaattgaaattaagagaagggagagattgaagagtggaaaggagaaagtggttgagggacagtgagagaggttggagaagagagtaagaagagaccgcttacctgatttaaaattggtgagatgttccttgggctggtcggtctgaggacctgaggttgtaggtggatctttctcacggagcaaagaacaggaggacaggggattgatctcccaagggaggtcccccgatccgagtcatggcaccaaatttcatgcgcgtccatgtgaagagaccaccaaacaggctttgtgtgagcaacatggttgtttatttcacctgggtgcaggtgggctgagtccgaaaagagagtcagcaaagggagataggggtggggccgttttgtaggatttgggaaggtaatggaaaattacagtcaaagggggttgttctctggtgggcaggggcgggggtcacaaggtgctcagtgggggagcttctgagccaggaaaaggaaattcacagggttaatcactcagttaaggtggggcaagaacaaatcacaatggtggaatgtcatcagataaggcggggcagggccttttcacttcttttgtgattcttcagttacttcaggccatctgggcatatacatgcaagtcacaggggatgcgatggcttggcttgggctcagaggcctgacatttctcacatttcaaaatgtaacaatggttttccaacagtccattacctctttccagcattaccagtaaagtccaaagtcccaagtctcttctgagacaaggcaagtcccttttgcccatgagcctgtgaaatcagaaacaagttatttacttccaagatacaatggggatttaggcattgggtaaatactccaattccaaaaggtagaaataagccaaaagaaataagatacaggccccatgcaagtctgacacccagcagcacagtctttaaaactaaagctccaaaataatctcctttgaccccatatctcacatttagggcacactgatgcaagggttagactcccaaggccctgagaagctctactcctgtggctttgcagggctcaaccctcatggctactctcatgggccggcattgcgtgcctatggcttttccaggtgcagtgtgcaagctgccagtggctcttccattccagggtcttgaggatggtgggtatcttctcccagctcctggcccagtgaaaactgtgtggagacacttaccccacattttgcttctatactgccctagtagaggttcttcatgagggcactgcccttgtagcaggcttctgcctggacattcaggcttttctatatatcctctgaaatgtaggctcccaagcctaaactgttgcactttgtgcacctgcagggttaccaccacatggaagctgccaagctttatgacatgtaccttctgaagcaacaggccgagctgtaccttgacccttttgagccatgactagagcagctgggatgcagtgagcagtgtcctgaggctgcacagggcagcagagccctgggcctggcccaaaatttattctgtcctcctaggcctctggtcctgtgatgggaagggctgctgcaaaggtctctgaaatgcctttaaggccttctccttattgttttggctattagcacttcgctccctttacttatgcaaatttctgcagcctgcttgaattcctcccctgaacatgggcttttcttttctaccacatgctttcctacacactttcagaaaactggatctcatgagaactcactatcataatgacagcaccaaggaagatggtgttaaaccatgagaaacattagtttatttgccaatgtctgaggtaggcaggtgaggacagcgtttgtgctgttgtggaaatgtgttctgaacagggaccttgaagtgaggtggaggaggtggccaagggagagaacactcaggaccccagatggctgctgctgcccaggacatccccgcctcttatggatgttacccagattgtagcagggagaggcttcctttaagtagagagtaaacggactaagaaagcgatagatggctccacatgccaagaatgttcttttccttttctctcccttttctccctctccttttcttttcatgatatcaaatgccagagaggcgtgcagagcacgtagggggccttccttgcgttgctgctacccaagcctgcctgggctgtaagttcccccggagcacccctttgcccccacctgtggcatggtcggcctctcttgggcccaagcctaccctctgcttcctcagagcgggtctcagaccaggcagggggtttcccaggagtccctgggaaggtttgttttctgcagtgccatggtgacataaatggttgctttccttatcatttttcaatatttagtggccactgattactgccttagaaacacggagcaattgaggttttcctgcccctttccaattccagttcaatgtaattttcctgctgtgactcctgtccctctctgatgtcctctcccctattcaggcttcaacagaagccttctatcccctctcaaagctccgtcctccccaggagacaccagccagtctctgtgcttcctcctcccaccctctcccagggagtcctccctcacctgtgagcaggagcccctgccaggggatgcatcctctgcggggaggggctgaggggggcctcatggtctctgctgcctgcttctcttctgtggagaggagcttagctccaggatgatcagagctactgtgactgccagttctgctgtctttcctccctctgtgctgagccttctctcagggcaggagcacttcctagggccaggggcaggggcgggactctgcccaggatgcttctctgtcccctcccctctcagtcctgccttctggttcctgcttccccttcccttctgtgtgtgtttggtccttaggacctgctgaggccatttgccttcttcagatatggctctccttccacacttgtccacacacacacacatatacacacacagagacacacacagagacacacacagagatgcacacacacatacacacagacatgacacaaacacagacacacatatatacagacatacaggcaaacacatatacacatatatacagacatagaggcaaacactcacatatacagacacacacacatatatactcagattcattgaaactgagacacatgtacacatacagatacacagagctgtcacaggacaaactagcacagataaagacttcaagtggctttatttgccgtcctaaaatcgggcgagacttcatcccatgagacaatacgtgggtcaaggagctgagcagaagcgcgggtttaatagagaggggagggctgcggaaagcaaacacaaaaaacagggccactcgggaaaggctcatggaacaagggagaaatctctgatgggggagaatcaggttcctgttttagaaacggtgagagcagaggggaggtcattgtcatgcgattgaaactggcctgtttgggaaatcggctattatctttcgaaggtcaggtagcagctcagttttcctttggtgacctgtgacattggggaaggactgcattgtgctgttggtctggtctgttggggcctggagcaggagctcagccactgccatggcctcctctgactgctgtttagcaaagctctcaggtggggctgatggcgctgtcctggggaggccctttcagtagcaaggctggtgcaaccctgtcccctgggaggatgacccgccctccccagggctgacctctgctatctcctggcctcaggtctgtcagctccacacacagaaccctggggatccaaacctggggaattctttctttgtgatgcagaaacccagctggccaggtctccccatgctctttagtgcttgggaaggtgggatgatgcccagcaggaaggtgacagaggtggctctgggggatagaaaggagctcactgggggatgactggggagggaccagccctctgtctccagtgtcaccagcctggcctctgacccaaagagacccaggctggactcaggtggagctccagctccagggtgtggaggaagttgtcctgtgtgtcctgggtagagaggactgtggtggagggaggtgggtggctctgagccctgctgtccttggggaaggcttcatggagaccctccctttctgtgtctgttggctgagctgtggctcagggcctgtccatgttctccctatgttcaccccttaaccttgcaggtggttgggggggcgagagagatagaaagactgtgtctgtctgtgtgtgtgtgtgtgtgtgtgtgtgtgtgtgtgtgtgtcctgtggctaccacaccttccccatgggtgatgccaggaggaagtggggagctgcacaaaaacccttggcagagcaggcaccatgaaggagcaggcacatggcagggaccagaagggtcatttggggcaagggctggaaaccaggctccacctctacctccttagcaaagccaggttcctgtccaggggaatccatttcctgagtgttatctgtgtgtgatgtcgccccctggagggcaagaggagacttgtggccttgtcaggggctgccccagggacactgaccagggtctgcatggtatgagctggccctgacccctgggcagaagtgggatctgacctccagactgcagggtcaggtcaccccaggtcctgttcactgcaggtccccaggctgcccaactccatgcagtgcaagatgagcccagggagaggacaggagttatccagagaacagcaggtcgagattcaagagaactgtccaccaggaggatgggctgccttagaaggagccacctgtccccaaggtttcaaaggaagggctcagggaggtatctctgggggctttagagagaggatgccagcctgggaggtaggtggtccccagaatgccctgtgttcctccatcacagcactgggggtgctgcctccaggtcaactgtgtccctgtctgatgcccactgtcactgctgttactcaatattgtactggaggcattggccaatgaaattggggtacagatacgaatagagatataagacttagaaagagggagaataagctataccaattcacaaccaatatgtgattatatatctaggaaattccagacatagtgaaaaactaatcaatgcaagaatttaatagaaagatgtaaagttaacataaggaggttaataacttttatacacagaaacaatactcagatagaaggtgtaatataagacctcttttattatgacaatataaagataaaacacctgggcatacccttaacaagaaatttgtaaaacctatacgagaaaactcttaaaacactcctaaaggacacaaaattcatcttcaaaagatgaagagacacatttagtttcttttcgatcactttattatgaaaatgttcaagcacacaaacaaattgaaaaagttgtacagccaacacttacatactcatcatgtagattctgtaattgttaatattttgtagtatttgcttgattaaatattcttacatccatgaaaataaatccatcctattttttcatgtatgtcagagtgagttgcggatctcagtacccttaggccctaaataccccagcactaacgtcattaactagagtttaatatttgtttctatcttaggtgaaatttacataaagtaaaatgcacaaagttgtagtgtaccttttgatgagttttgacaaataagtgcatacacccatgcaaccccttccaagacacacacagttcctgttgccccagtgagttccttcccagccaatcctcatgcccagtcccacctccagaggcaaccatcgtgctgagttttcatcataaattaatgttgtctgtagaagaattccatataaatagaatcatacaatgtgtacgttttcctgtgggttaaattttcttttgctcagcaaaatgtttttgagaatgaagtattttgttgcctctatcagtagtttattactttttttttttttgagacagagtctcgctctgtcgcctaggctggagtgcagtggcatgatctctgctcactgcaagctccgcctcccgggttcatgccattctcctgcctcagcctcccaagtagctgggaccacaagcgcccgccaccacacctggataaatttttttttttaaatatttttagtagagatgggatttcaccttgttagccaggatggtctcaatctcctgacctcgtgatccacccgcctcggcctgccaaagtgctgggattacaggcatgagccaccgggcccggccttgtttattactttttatagcaacataatattcagcagtgtgaatataccacatctggcttattcatcctcctattgatgggtattttgttttaatatttcctcagttttggaccattattattatgaataaatctgcttttaaaaataactttgtgtatgttttggatgggcacagtagctcatgcctgtaatcccagcactttgggaggccaaggaggcactgatcccttaaggccaagagttcaagaccagcctgggagacatgatgaaatctcatctctacaaaataataataataaaacaaaataacatctttgtatgtgtcttgttatgatcacatgtttcattcattttgggtaaaatacctaggaatgaaattgctgggttatggagtaggtatatgtttacttgtataagaaagggacagacttttcccaaagtggttgcatcattttacattctcaacaacagtatatgagagttctggttgctccatatatcctcatcaacatttggggtcttgtctttctactttcaggaatttggttggtgggttgcaacatttgattgtgattttaatttgcatttccctgatgactgatgatgttgagtagtttttttctgtgcatattagctattcgtatatcttattttgtgaagtttctgtgaaaatcttttagtcattattgcattcagaacaaaggattaaaaaaatgcatcgcttgaacccccgaggcagagtttgcagtgagccaagatcgtgccactgcactccagcctgggcgacagagtgagactccatctcaaaaaacaaaaacaaacaaacaaacaaaaaaaagcatgtggaactttagcatgagttgacttcactttgggcatgctgtctttagcagtcacaaaaaaatgaataggcgggtgaactattgtagaatgtaagagatataataaccaaatataaggcataagtcttgattggattccagttttaaaaatacacatggatagccaggcgtggtggcacacacctatagtcccagctactctaaagactgaggcaggaagatcagttgagcctgggaggtggaggttgcagtaagctgagatcctgtcactgcactccagcctggatgacagaacaagattctgtctcaaaataaattaaataaataaatacagatggaaaaatcattttggagaccaaaggggaagactgaaaaaggactatatattagatagggttagggagttattgtttattttctcaggtgtgatcatgggattgtgggccagtcactctggggagaggcacgctaaagcactcaaggacatagtgtcactcaaggacacagtgccttgatgcctgcaatttactctgacacagttcagaaaaaaacgaggaaatatggcaaaatgttaaacttgaatataaggagaggatgcgggtattcttggtattattttttccgcttttctggatgtttgaaattttcataataaaaagttgaaaacaaaggatgatgtgtaagaaagtaacttggtggcatcagaggtcatggatggtggcattggtgcaaagacatcaaggatgggaagggtctagttatacaaagagtagatgaaagacaccccaggcacaggaacagcaagtgcaaaggccctgaggtaggaactagccagcatcacattgtcagccctgcgagtgaccttcctagaaagcagacccttcaggcccagtaaagctgcagatgactgcaccctgactggcttctttactccaacctcatgagactcaccaagtcacaatcacccagcttcataataaaaagctgaaaacaaacactcttcaattcctgccccacagaatttgagaggtaacaaatatctgttgctgttttaagccctgaagccctggggtaatttgctaggcaacaatggataactaatgcagcttctgtcacatcttctaggaaacttcttaacctgctctctcagtacaaaatcccctttctccatttggttccatgtaaacctctgttcatccttcaaaattcacctaaaggagtgtttcccaaaatagggttcaggtgtcagtggctgagggcatgtgagatgattctaaggggttacacacgacagttgttaaaaagcgttacaggctatgcttgtgattaagcgcctattagagaaaaataattgaaaatagcatattaatcacatgattggataaacattattgttttaagatgaggccaaagaaaaacagtgagttgctttaaggaaaatttttgagtaaatagcagtgcaagtgctattcagatcgtaaaagtggaacacgactaaaatttggaagcgcagtgaggaatagcaggaattcctctaggaaaccttccctgccgctccaggtgggccagtttgcccctcattcagacccctaaatacctaaatatctctccacttggcgctggtggaatgtgtcaggatcccatctctggctgatggaagtctgtgaggaggctgtgggctctgcatctgacctgagctccaagtctgcagggcaggccctggggaaggggagatggatggaaagtggggagtaaggacaagccaggagcccacacaaggtggaaggtttcgggacccacagaacctgcctctattcttgctgcctcatcttggtggtgcaggggacctgcaggagtgacctttgtcacagaggtcaacgcacacctggctcaggaggtggagaaactgaaggaggattggggtaaaggtggagcagtttcaggtcctgctgctgctccaggctgaccagccgagctagcagatgagcaacacctggacctgagccacggaagctcctgcctggatttccccagcatgaaatgcacaacggcggctgctttgggcaggtgtgtcccgctcccaccctaacaggaacctacagggaagagagttctgagaggtgtcgttcagcctagccacagtcattgtcaccacaccctcttatgggcctgagcacccttttctgtctgcccttcctgggaatgagaagtccctgagagcggggatgggtctcattcattttggggtcttagtatcattcagcatagggcttggcacagagcaggagctcagggagtgcacagtgaattaatgaatgattcttaaagagcccctacatttaagtaagaaatccatccattgaataagaaatccatccatcacaggttcttcctgtgtccacctgggtggggaaagatggactcatcagtggcctgaaagggatcaagttaagtcaccccaaaatgtaccacgttggtataaggattgttttgagctgaaggccattgagaatcaacagatgctggaagagcactgccctctccttatctacctagaagcagggcatatatttccttttgggaaggtgtttcctccccagaccattaagaaaagcaactcatcctggagatggcgagtccacactgagatgagtatgcatagaccgacctcactaacagaacctgcatctccatcagtgccccaggtatttccgggtcactgtcccatgatgtatcaccctttgaagaacaagcccctttcctttgttaaaatggtatataagccccacaagtctagccgtttcattttttcttttctgtgaactcccatgcatgtaataaaaattctctgccctttctgttgttaattggtcttttgttagtttaattcacaggcctccagatactgaacctaagtggatagaggaaaagcattccctccctgaaaggcagttttccagactaacaaacaaatgtcataagtatgtacatcttccagaaaacggagttgtctagttacatagtatgccctgggcaatggattaatacatgtaacttaggcaattcatctgaatttcagatttttgaaggctaagagctaccttcacaggaccaagtgatggtctctggagtctgggtgttttacagagctccattgatagaaataatctttgcaagaacattgtaggatgatgaataggatctgcttatatctcaagttgtctgggaagcggggacatttgctccttcttatcttgctgggatttctgtcaccagcagttggaagggactccagttttaagacaaaggtttacagtttctttggcaccaagagcaaaagaagcataaaactaggcagaaaggggtataatattatcatgttgagaaaaggaatatggaaaatgtaaccttttgcatctcctgagttaatgaatctatactctgagaagggcagaaatgagaaccacctccccatctctgcaataaattccctagaaggtttggattttagccaagaagtttctgctttcctggagaatgtctctcaattcaaactctaaaccccaaagccagaaaaggcaaacgttaccttgtctgggctttaatccaagttttcagtggctggaaacacggttacactcctggagacaaggtggccttggacacccaggaagagccctgctcccgggcacacctggccctggagccagaccacctgggtttgaaccccagctctgcaccttaccagcagagcttcctgtctggaaagtggagatgatcgtgatatcactgacctcagactgtggttgtctcaattaaattaacaatccatgttatgagtgtacaagtatcgggcacagagcattgactcaattaatactgatctgtaatgaatggggattcatgccaagtgctgatgatgtgcatgacattagtgctgactgctgtaagtactggaagccgtcatgataatgaacagtgactttcatcacagttcatggggtcctttgtgaaacatgagggggcattaagcagaaacagccagcccagccctctccaccaccctttgaggaggtgtatctatgcctggtttacagtgtggaaactgaggctcagagacggggactggattgtgcacggtcacccagtcatgaaggccaagaaatgatggatgggatgcaggctgtgtgctcagccccctccctgtggagcagctcaggggcgtggggcatccagtcgccctgaagatgctgctcttgtctgtctgcctctctctctttccaccacactaggtctctgtttctggctctgtctcctcttcactgtgtgtctgtggttcactttgtgtcttttcatctctgtgtctccctgtctgtctctgtctttgtctctctaccaatgggtaccttctgtctttccttccttcttttcttttcttttctcttctcttcctttcttccttccttcctttcttccttcctttcttccttccttccttcctttcttttctttccagagtctcactctatcacccaggctggagtgcagtgtcatgatcttggctcactgcaacctctgcctcctgggttcaagtgactctcctgcctcagcctcctgagtagctgggattacaggtgtgtgccaccacatccggctaatttttgtatttttagtagagacagggtttcaccatgttggccaggctagtgtcaaactcctaatctcaaatgatccgcccgtctcagcctcccaaagtgctgggattacaggtgtgagccaccactccagcctcttctttctgtttctgtgtatttatgagtgtccttcctcctgcacactgtctgtctctcactctgtatctctccagctctgtccgtctctttttctgggtctctttccctctgtgtctctctgtgcctccctctttgtctctgttctgattttgtgtggccccatcagcttgactatggtggtgtctccatgtccctcctcctcctctcagatgctcttttggttctgtgttttccttctgtctctgtgtccctgtgggggtctcaggaccaggacgagggtgaagtaagtgaggtgtctctgctgcaaaatctaaggagacacccaaatccagggttgcacaagtgaccccttaatttttagtcctaggccctttctctctcccctcactctctctcttttctggattacaacaccattgatttttaatcaagaatccacaagcctgggtcctctcttgtctcaccctagtcctgccctgcatctctctatggctcaccttctacttctccggctctggctcttgagttctccctctctccgtgcctctcctctccctccatctctctatgttagtgtctctgtccccttcactctctgtctctctctgtatctcccctctccacccccgtatttctctgactctgtctctctctgggtctttatcattttctctttctctctccatccctgccccaactctctctgtgtgtttcccagtctctctgttttcccctaagccaggggcttcatgttgtccatctgtattgaggtcttgggtggccagcagggttctctgcttagtgggggcttcccctcagtgctttccatatgctgtccagactgggggtgctgcagctagaaagggaagaaggtttccatatttcctgagactggagtcacatcctgtcaccaatgcactcacctgctgactaaccagtgtacttctgggaattgcaaatgcatgaaatggcacccattctagactagtcacggcagtgttggtgatggtcacagaccgggaacgaccctgacgtttatccatagagaactgggtcatgagccatgatccacatcatggatactggtcagctgtggcaaagaatgaggtatccttctgtctgtgcactggggaaggtttccaagatacaccgcacagtgagaaaaacaagaagcagaacagtgcacggtgtgctacctcttacattacaaaggaggaaatgtaaaattaatttacaaatggccaataagcacatgaaaacatgctcaacatcactaatcattaggaaaataaaaatcacaactacagtgagataccaccttacatccattacgatggttgttctcaaaaaaaaagaaaaacagaaaagaacaagtgttggcgaggagaaattggaacgcttgtgtagtgtttgtgggtatgtgatatggcgcaaccactgtggtcatttctcaaaaaattaatcatagacttaccacaagatgcagcaattcggcttctggtgtattccaaaaagaacggaaagcaggggccccagcagatatttgcacgtctttgttcatagcagcattattcacaatagctaaaagttggaaacaagcccagtgtccatccgtccgtgaatgaataaacaaaacgtggtctatatgtacaaatgaatggaattcagccataacaagaagggtggttctgatggtgcttcaacatgaatgagccttgagttctttctgctaagtgaaataatcagactcaaaaagacaaatttgcatgattccacttaacagaggtgcctaacgtcatgaaatgcatagacagaaaatgaaaaggtggttgtcagtggctggagggagggggaaagaggagttggtgtttaatgggcacagaattccagttggggaatatgaaaaagttctgggtggggatggacagtggtggtggttgaacaacaacctaaatgtacttcctgcccctggatatacacttaaaagtggttaaaatgggctgggcaaggtggctcacgtctagtcccagtactttgggaggttgtggcgggcggatcacgaggtcaggagatcgagaccatcctggctaacatgacaaaataccctctctatctctactaaaaatacaaaaaattagccgggcgtggtggcatgcacctgtagtcccagctactcaggaggttgaagcacaagaatcggttgaacctgggaggtgaaggttgcagtgagccaagatcgtgccattgcattccagcctgggtgacagaacaagaccccttctcaaaaaaaaaaaaaaagaaagaaagaaagaaaagaaaagaaaagaaaagaaaagaaaagaaaaaaagtggttaaaatggtgaattctatgttatatatattttaccataatttacaataattcctattgttttgcataaaacagctgtagaaagctttgcaggtcatgaacagcacagctggccactggggctggtgtggggctaggacctgggtgcacagggaacaggtatgagacacaggctcttcatgcctgcacacacatatggatacacaaggatgcaaatttctgagccatctaaatacaacacctattcaaaaaatcaaacagaaaaaggaaatgaatggagctgaaggatgagggcaggtggggcggctgctcgggaggactctggagaccacttcacccaacattcgaggcctctcttagcagctggagctcatccgggggacttaggagctctggaaagaggaacaggagagggccatggccggaggaggcctgaaaaagatcatctctgccacagagaagatgctggctcggatactggtgtcccccgtggaggcagggagacccagggagacaactgtattcattcaaggaggaatgggtggtggtgcaaacttgggtggaggccacagggtgcagaagacaggacacagcagagatagatgtaggacatggaagggacagaaaggagtgatcactggacgtaaaggggcaaggaaagtggaagcatgagaacatctgctgggcatccggctgagaggttgggtgtccagggtgcccttccctgagggagaacccaggacaggagcagattcagagaaaaccacccagctcactccagcaagaagcagaaaagggactggttaaaggacagggtaggaaggtcaccaagctccaagggccctcatgaagccagcttggaggccacagggcccagggcaaggaccaaaccacaggcacaggacagctccggtcaagatcttctggccactgcaggaggcagaaaccacaccctgcaccctgcactgctgaggctggccctggagtccagaagcttctacaccagaagcttctgtcccccatccccactcaaaaaattaaaaacaaaaagcaaatcggtgccatgcaccctctgcttcctggtgctgttcgggatcctgagtctttcacgggggcacctgatggggaaagcctggacccgtgtctgtgtccctcctgcaaggagtgctgggaaaatgaactttccagcttcctccttgggaagacagaacattccccatgtgtactggtggcatttaaaaactgcacggcagccagagaacatggaccgtgttccaccaggagagttcctggagggatgtcccggtgcagacgcccgtcccaaggtgggtatttgagctgaggaactgagaagccggtttctgcctagagttagagatccgacaggcatcagcacatggaagggagggaagctacgatgcatcgagggtgggagatcagatgaaccaggagaggcagggcccgggaggaaccccggggagcagccgcctttaaagcctgggggaagtagcttcagagaaggtgaggtaggttgggtgggggttgctggaaaaagataattaagaaacaaatttctgctcagcccagaaacccccgtcatatccgtagaagcaaaagaaacctgtcttatgactgagtaagcattaagccaaaatgtgatgcaatctgctaagagatgacaaagacagaaagaaatcccacctttgtatccagccaagcaggtgcaacccgttacacacgtggtctccagatagacggtgactagttcccagttgagaggactcaacggcaccatttgtcacacatagttcatcctaaattcacccagtaactgtgttgattctctgtgtggttaattggctttatccacaggaaaaacaaacctctcttatctatgacaggaggtagttttgcaactgggagtgagatgcccccagaactgaggttccttccttctcacagaaactgggagacaggggcgctttctgcccggatgcctgcctttcaaagagagggctcctatggccttgaggaggacagttctgggttgtgaggcaggcaagatgcttatgtatgctttagaaagctttacatacatcttcaagggacagagaaagaattttcaattacacctcttctaaaaaataaatgctctcaaagtccagcctgggcaacatagcaagatccaatctccacacacacaataataataatcaatttgctgggcacagtgggatgtgcgtgtagtcccagctactcaggaggctaaggaggaaggatcacctgagcccaggaggttaaggctgcagtaagcttggatggcaccactgcactccagcctgggtgacagagggagactctatcaatgaatgaatgaatgaatgaatgaatgaatgaagagaaaatgatctgagtgaaaagaggagagtctctttatctttttgcaacaggctaaacaaaatttttaaaaatgtatatttgcctcacagagattattccaggaaaagaagtggccctcagtgtcaaaggatgcaaaactaacctgtgagttcctggcaggtttagcaataaagcaggatgttgctgatctcagtacaagcaatgttagagaaaggggaagatggaagtggacatggacgagtgagtggcaggtgacaaatggaagcaaagaaacgtatccagaccactgaagatgcttgaccgagaaaaaagaggcggtggagggaatggaagcccaaggaagtcatttgttgcaataagaggcctcagagcacgtgtagggtgcggggcagagcccatgcagaggggctgtggaaggctggtagggtgcaggtggccccactctccatcaccctgaggagtatgtggtcagagttaaagctcagtctgtttctgggatcaggtaagaggtcagcgtccggagaagagaggtggatcttcagatcctgcagacctccaccgcgccctctgtccctcttgactgctttttctccatctccattgtctggctcacattcctgtcacgtcttcctttctccctgcccctcttttctcttttctcctctctttttcttaacccttgtacctttggaagtcccactaatagaatttaaacagcttttcaagttggttttttgttcccagaaattgactttagactctccatgaataatgtggaaatcaaacgagtataagctggttcatgtctctgcaattaaacaaataaaatcaacattccaatgctttcttcttccagagtagcccacatttgattttttttttcttaattactgtcacttgcgatagatttttaaatcttgtaacctggttacacaaataccatggggcaaaagccttacttcctgtgagaggaaaccaggcttgactagcctcatgctggctttgaagaagtaaaatcaggggttgatgaatttgcatagggtaaatatcaaaggtcaaaagtcaacaataggtggtagagggaataccccaaattataaaagaacaaactgtttaagccacaatagaattatcgtagaaataaaccacggtccttcccactaaaatattccacttagaattgtaaaatattttcctcaataactcctggaagagcctattaagaaattaacgaggctgggcgtggtggctcacacctctaattccagcacttttgaaggccgagatgggcagatcacttgaagttaggagtttgagaccagtctggccaatatggtgaaaccccatctctgctaaaaatacaaaaattacccaggcgtggtggcaggcgcctgtaatcccagctactcaggaggctgaggcaggagaatcacttgaacctgggaggcagaagttacagtgagccaagattgtgccattgcactccagcctgggggacaagagcgagacttcatctcaaaaaaaaaaagagtcaaacttgagccaggcatggtggctcacacctttaatctcagcactttgggaagctgatgaagtcaggagttcgagaccagcctgggcaacatgctaataccctgtctctaccaaaaatttaaaaattagatgggtatagtggctcatgcctgtaatcccagctatttgggaggctgaggcacaaggatggcttgaacccgggaggtggagcttgcatttagccaagactgtgccattccactccagtctggagtgaaaaaaaaatccatctcaaaaaaaatcacaaaaagaataaatatggggccttatgactgtatattactgggcttctgacctagactgaaagatcagggaagactttcctgaaaagaaagtgagctatgatgggcccactgtactccagcctgggcaacgtaatgaggctctgtctcaataaaaacatgcagaataaaaccacaataagaaaataagacaataaaaccactacagaactattagaatggctaagattaaaaagagtgaccacgccaagtgttggcaaggatgtggaggcactggaacgctcacgctgctggtgggaatgtaagatggtacaaccactatggaaagcaatctggcagcttctaaaaatttcagcatacaccatgccactcgtcaattccattccattcccacatgatttttatttaaaggaaagtcaagtggaatgatctttaaagcatttttgcctgacaaatagatgaaatgtgggtagcagcccaacactccctggtcagtcttcacagggcatatgtggccttatggcccccaggaaatatggctctttccacaagtgctatgtccactctcttcaccaatcctaagatgttagttccacagcactgctagcattgggctttgtctatttctttctttctttgtcttttttgacagggggtcttgctctatcatccaggctgaagtgcaatgatgcaattttggctcactgcaacctccacttcccaggctcaagagatcattccacctcagcctcccaagtacctgggactacaggtgcacaccaccatgcctggctacttttttatatttttggtagggacggggtttctctatgttgcccaggctggcctggaactcctgagctcatgcgatccgcccgcctcagcctcccagagtgttgggacagcaggcgtgagccactgctcctggagtgggctttatttatttctatttctatttccttttcctgtatggtgaagagattgaaaagcatgccttattttgcaggaagagatggaaggctagaaagaggaagtaaattgttcaggtaatagtgaaatgatagcaggtctagaatatcagcctctttactcaaagcccacaatttccaaatatcacaacttcctttctctttatacactttagggattttatttatttatttatttattattttttgccaaagtgaaactccaggtcaaaggactttgttggtctagtgtcaaattagcttccaaggtgttgatctaatccatggggccaccagcactcaaggatataggcgcacagcaatgtcagcctcatgttgtaatccttttattcatttttgctcctctggtcagtacacgaaggcctgtaaagatcctttcttttatttttgagatggagtctcactctgtcgcccaggctggagtgcaatggcacaatctcagctcactgcaacctccgccccctgggttcaagccattctcctgccccagccaagtagctgggattacaggcacatgccatcatgcccagctaatttttgtatttttagtagagacagggtttcaccatgttggccaggctggtctcgaactcctgacctcaggtgatccacccacctctgcctcccaaagtgctgggattacaggcatgagacaccacacccagccaggcctatgaaaatctttaagtgtaacttttcattaagtgccatagatccctcctctttataacataaagtcctgtaaactgcatgcaggtcagtttgccataggaataatttgtctttgctggaacatgctgggtgcttggcagatgaagagattggaagtgaaccactgagatgactgatgagcgtcctcagcaggctgtgttgcagggggaagagtgcaggttgtttataaggcctgggtcgtgcccctggccaccatttcctggctttgtgactccagctttacttctccttcccagggctcagttttcctctccttgaaggggatgagtggaaccagctctggacgctgagctgcctgggtgtaaaggcttcctgtaatgggcagaagagtggataggagggcagcaggggagctggaccaaaagcatcatgtgatttgccgtgatcacagaggattttctggaagtagcttgggcacaatgtgtgcaaggagacagaagggtctcgtggtggggaataggacattcacacagcctcctccatggcttacctcacacagcagttgttaattagccaagaatttgacaaacaggcattaaaggccttctgaatgtgacacacgacacccagctagaagaatattgccaaaaatcattaaaactactctaatcatagtctgagtcagacacatccaggtggtggaagactttacaaaaaaaaaagaagtgaaccattgctttcaatgacattaaagaaaatgaaaggcaggtggggagcactcctagattaaaggggagtccagagatgagatgtaaaccaaaaggtatctgagacaggtctccatcaacttagaagcttattttgccaaggttaaggacatagaaaaaaccatgcaatcatagaaacagtctgtggtctgtgcctttttccaaagataattttgaggacttcaatatttagggtggaaaagctggctggcggtgaaagaaggagggtgtggtcgcattactgaatccacatggtgtaagagaaagcaggaggtaggggaataatcaatcacgtattcatctcacgctcagtaaattggcaccttgagaaagataaggtgaatatggccgggcgtggtggctcacacctgtaatcccagcactttgaaaggctgaggtgggaggatctcatgagcccaggaacttgagaccagcatggacaacatggcaaaacccatctctacaaaaaaaaccacaaaaattagctgggcgcggtggtgggtgcctgtagtcccagctacacgggaggctgaggtgacagaatgacttgagcccgggagacagaggtcgcagtgagccaagatcgtgccactgcgccccagcttgggagacaaagtatgatactctctcaaaaaaaaataaataagtaaaaatttttttaaagaaagataagatgaacatagagtagctacctacggagatacttaaccttttctctgtagctgtctgcttaggaacaaaaggaaaggcagtttcttgcatgactcagcttccagttttttttttttccttctgtcacagtgaattggggtcctgagtttttgtttctctttcataaagacaacgcagtgcagttcatgcttgaccccggatgttctcctgatcagaaagcaaaaacgcaatgagagatgtcattgggacaacagaggaaaactggaaatgggcttcctattagacaacagtgcatctgtgtaaactacacgggtctgatcctggtctgtggttacgcaggacaaagtccttaagaataatctatataggctgggcgtggtggctcacacctgtaatcctagcactttgggaggccgaggcaggtggatcacctgaggtcaagagctcaggaccagcctggtcaacatggtgaaaccctgtctctactataaatacaaaaattagccggacgtggtggcaggcgcctgtaatcccagctactcgggaggctgggacaggagaattgcttgaacctggagggcggaggttgcagtgagcagagatcacgacacttcactccagcttgggtgagagagcaaaactgcatctaaaaaaaaagagagagagaggaaaaaaaagaatgatatatgctttttaaaaatttttttatttatttattttttgtgatggagcctggctctgtcacccaggctggagtgcagtggtgtgatctcggctcactgctgcaacctccaccaccagcttcaagtgattctcctgcctcagcctcccaagtagctgggattacagttgtgtgtcaccatgtccagctaatttttatatttttagtagagatggggtttcaccatgttggccaggctggtcttgaactcctgacttaaagtgatccttccaaagtgctgggattacaggtgtgagtcactgtgcccagcccccttaagaataatcttaagaaggttcttgctgaagcacttagtggtgagagttacaatgtctactccttgtttttaaaatttaagaatattttaaaagcatatgttgtgtgtgtataaacagatacaataaaatgtgaagagtgggtgaatccagtgaaggggatacttgtgttcactgtactatccttgcaacttttctgccggtttgaaatttttccgtctttttttttgagatggagtcttactctgttgcccaggctggagtgcagtggtgcgatctcggctcactgcaacctctgcctcttgggttcaagcgattctcctgtctcagtctccggagtagctgggactacaggtggctgccactacaccgggctaatttttgtattttttttttaagtagagatggggtttcaccgtgttgtccaggttggtttcaatctcctgacttcaatagatccacccgccttggcttcccaaagtgctaggatgactggtatgagtcaccgctcccagcctgaaatttttcaaaatgaaaacaccgcaggtcaggagtttgagaccagcctgaacaacatagtgaaaccctgtctctattgaaaatacaaaaattaaccagacatggtggtgtgcacctgtagtcccagttactcgggaggctgaggtgggagagttgcttgagtccaggagatggaggctgtagtgacctgcagtgagctacaactgcaccactgtactccagcataggtgagagcaagactctgtttctaaaaaaaaaaaaaaattactgggcatgtactgtatgccatgtaggtggtggagacatagcaggagatcagacaaacacttccctgtctgtgtggcaaatattaaacttgcaataaacttgcaaagacaaataaagataaaatttatagagatgtcaaaaataaacatataattgcaagtcacattcatttctctttctctgctattcctgctctcgccttccctcttctgcttctcctctctccgtcacagacacccacaacgtccctctgcagtcactgacagataccccaggttccttcctgtcttcctccccgccaccccagtgtgttacagctgatttgtacagccctggacaagcccatggttaaatagctagggatttcatcagcctggttggcaaactgtaggtagcttaaaatcagacatgctatgagtatttacaccagagaaataggccaacactacgaggcaggatttgtgggtattgtttttcagaaaacttggtttttcagcacaacactgctctcccatcggcttccagcaaataaatgttgcatttttcagatatatcctaattctttcatagatattcagtctctactccacctctggccaagcctttcctggtggtaggaaactggggacttgagtcctatgttgtactgtgagggtagagaatagaagagaaagcatgagagaaaagcatgaaaagaagaatcaaaagaaagcaatataagaaggaaagagaaagaacagagaagtgggaagacagtggagggtagaaactaggaccggaagacatggggacaagctgatgcccactgcacaacgtcctcacaggtagttgggccatttccccatctggggtacagaggtggccagggagcccatgagaaatgaggaaactgccttcccaaactactggagaaagagggtgggggtggtgatccacatagctgggctcaggaggaaagagggctgggagtctggaccgggggaacctcgggtcaagatgccacagtttctaactatggagggcctgggggcctggactcctgggtctgagggaggagggcctgggggtctggactcctgggtcggagggaggagggcctcggggcctggactcctgggtctgagagagggaggcctggggcctggactcctgggtctgagggaggaggggctggggggctggactcctgggtctgagggaggaggcactgggggcctggactcctgggtctgagggaggagggactgggggcctggactcctgggtctgagggcggaggggctgggggtctggactcctgggtctgaaggaggaggggctgaggggctgggggtcctggaccctccatctgagggaggaggggctggatgcctggacccgaaggtctgaggaagaaagggggtccctgataggccactgcggccattgagacttggggtggggcccaagcctccattttgcaaggccctcccctccccacccttttctgggctggctgcttaagggctggtataaaggacttgtttcctgctgaaaaagcagaaagagattaccagccacagacgggtcatgagcgcggtattactgctggccctcctggggttcatcctcccactgccaggtgagtgatgagcccagcctggaggagattccctggaggccgggcaagggaaccctgctgagatggatttgctcttgccactccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggtgagaaggccctggcgtgcagagaccccgccctgtcccctcagtcccttgatccctgtgcagggacccgggagccacccctccgggggatcgactcctagggtcccggtgatcccctttccagcctctcagcctacgccgtgtagcagcgtctccctccaggaccctggaggcctgacctccatcctcgcttgcctccctctttcggtccaggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcaggtgcctgcgggagggtcgggaggagagggaggggctgctagaaggggatccgctgagcacagaggggctgttacggagtccctcccaccctcgctcgctatcccgaccctcgctggctccatccctcccctgactgctccctgaccatcgccccgccccgctccctttccatccctccccactcactcccgatccctcccaccgacctgccacccgggaatccccgcacccctcctcttctaagagcaaacaggacggatttctgatatgaaatcaccattaactgggttatcctgcattctttttttattctgttgcgtttggttcaagaagttctcctgcagggtttttgctatttcctcttcctaagggagactgaactgtaactttccactttccttgtctggtgttataaagagtctagggagatattttgcgcttcttttattggaacagcttgtgaacacagaagtctcctgttcttggaggtttagtagcgcttgcaggtgaaggcactggctcgttccagggcaccccctcattcccttgaccaatgagtctgcttctgtgtctcccctcggaaggccagactttgttgaaaggttcagacttgaccatgtctgagtctacatttggcctcagcaggcccctcctccaccctgcccaccccccacccccacttgccacccaagacacccccccttttcttttctttttttttttttttttttttttttctgagaaagcgtctcgctgtgtcgaccaggctggagtgcagtggcgcaatctcggctcactgcaacctccgactcccgggttcaagcgattctcctgcgtcagcctcccacgtagcagggactagaggagcctgccaccacgcccggctaatttttgtatttttagtagagacagggtttcactatgttgcccaggctggtcttgaactcctgacctcgtgatccacctgcctcagcctcccaaagtgctgggattacaggtgtgagtcaccacacccagccaagaccactttctgtacccagccctgggtgcctctacccagacctcc

SEQ ID NO: 813 - DNA, 1515 bp, Homo sapiens
ttagaaggtcctctcatccttttaagaagaacagagacagaaaatggttagtcaccatctaggacagactacaattccagatcattgcaggacgtgcccactcaaatggatgattattgagagctggccacctgaagtgttttacacaggcagtgatctaagggttgaagctatctggcctttttgcttgcttgttatgtatttatggcttttttccttttcaaaataattttactaaatatttaattcaccaactatatatatttatggggtacaatgtgttataaatgtatacactgtggaatgatggaatcaagacagttaacatgtccatcactccgcatactaacatctgtgaaaacatttaaaatctatgcttggctgggcgtggtggctcatgcctgtaaccccagcaactttgagaggctgagatgggcggatcaccagaggtcaggagttcgagaccggcctggccaacatggtgaaaccccatctctattaaaaatacaaaaattagctgtgagtggtggcgggtgcctgtaatcccagctacacaggaggctaaagcaggagagtctcctgaacccaggaggcggaggttgcagtgagctgagatcacaccacagcactctagcctgggcgacagagtgagactgcatctcagaaaagaaaaaatatatatatatattttggagctacatcgtgctagcgctgcagagaatgagttttgttttgcgacacagtttttagatgtctaccgggctctggtggagatggaatgtttggcctcaagtgggcaggtcccatgggacatgagtagccgaccatgacctggctgcgtactggcccaccaagcattcgactggcgtgcccagccactctccgtcatcgcagagaagtgctctatgtgagatttggttaaaggagtccctgaaggcctgtgggaggcagaatagtgacctcccagagatgtccacctcctgaggcccagaccctgtgagttggggaagcttatgtggcaaaagggactttgcagatgtgattaagtcaaggatcttgggttggggagattacccaggtgggcctgatgtaatcacaaggggctgagtaagtgaaagaggaaggcaggagggtcagagtgagagaaggaggtgagtgcatgcaagcagggggcagataacgggactggtggctttgaggttggagggaatggagaggcaggaatgcgggagcctgcagaggcttgaacaggcgagggaacagattctccttggagcctccaggaggacacggctctgatagcagcttcattttagcccagggagacccattttggacttgtgacctccgggacggtaagtcaataaacctacattatgtgaagccactaagcttgtggtgatttgttatggcagcaaaaggaagctttatggttcatctgtaccctgaaaatgcaggtttttggtttttttttttttttcacttgttcaatgatgtacccccagtgtcaggcgc

SEQ ID NO: 814 - DNA, 29147 bp, Homo sapiens
ccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaagagaaaaaagaaatttagaagaataacaagttattccaaatgaaggcgtaagaaagggaataataacaataataagaggagttgttcatgaggaaaaaccaaagcttgaaaattcaacaaagccagtgaagctcattcttgaaaacatgaatcacactcatgaattctaactacaatgaaaaagagaaagaaagagcaggcatgcatttccatatgggagtgagccagcagacagccctacagatcgtacacacgttttccaaaactaacaatggaacaggcggcaaacctatgccaatatactagaaattgcagattaaatagatgaaatattctaaactggagtttacataatgaacataagagtaatcagagaatctgactcattttagatgtgtgtgtgtgtgtatatatatgtgtgtgtgtgtgaaaaacattgactataataaaaataatctcgagttcacgaagcttcattggtgatttcttacaaatattgacacactaatgaaacacacaaacacacccagagcatcacaaatgtttcttgagaatagaaaaagtggcaatgtgcccaggtgcggtggctcacgcctgtaatctcaacacatagggtggcagaggcggcagattacttgaggctgggagttcaagaccagcctggccaacacggcaaaaccccatctctactaaaaatacaaaaattagtcggacatggtggcgcacactgcagtcccagctacttgggaggcagaggcaggagaatcacttgatcccaggagatggaggctgcagtgagctgagatcccgcccctgcgctccagcctggtcaacagagccagactctgtctcaaaaaattaaaaaaaaaaaaagtcatgacatataaaatagaattttccattctataacaggcatattttaaactctacagtttttctgtttcaaaataatatttttttaaattttattttaatgttttactttattttatttggcagtttaaaattctacatatttaggatgtgcaacatggtattttaatatgcctgtgaaatcgctaggtcaagctaattaacatctgtaacatcacgtagttatctttctgttaagagaacatttaaaatccactttcttaccaattttcgcgtatgcaatccattgttagcaactgtagtcaccatactgtacaacagatctcctaaacttactcctcctgtccaactgaagtgcggtatccttcgatgcagctctctgattccaccccagcccagctcccggggaccaccttctactctctacttccatgagttcaactggggcaatccgcacataagtgagatcaggcagcaggtgtcttcccgtgccttctttattccgcgtagcgtgacgtcctctaggctcgtccatgttgtcacaaatgaaacaatttccttcttctagaaggcggaatagtttttcgctgtgtttatactgagcgcttcattttctgtatccattcgcctgctgatggacgcttggccgggttccatgtcttggttatggtggctaaagctgtcatgaacatgggagggcgggcatctcttcaacgtactgattccatttcctttagatacacacccagcagtgaaattgttgaaacacagggtagctctgatcattaacttctgaaaaacatctatagtatttttgtggtcattgtactcatttacattaccactagcggagggcagcggttctattttttctacattctcgctaacacttgttattctactctttttcatagtaaccatcctaacagatgtgaggttatagcttcttaaagtttatatgtatgtaagtatatgcctatatgtatatatgcaaatgtatgtattcatacataaacatccatacgtacatatgtgcagatacgtatgtacatatatatgcatgtgtattgtatgtatatatgtatacacaggtatacacatatatgtgtagaaagtgaaattttgcagtgagatatcacctcacagctgttagattgcctattatcagaatggtgaaagatcagtgttggtgagcatgaggagaaaaaatccttacacaccattggtggacatgtaaattaacacagccattttagaaaacagtatggaagctcctcaaaaaactaaacatgccaccaccatataatccagcaagcccactgctgggtgtataccagaagaaatgaaatcggccacagaagagacgtccacactcctaagctcattgcagcactattcacaattgccaagttacaaaaacaattctatatttttgaaaaaggattcatttctcctgtccctgtagagaaaacgggctcaaattacacattagctgagctctgagtactcactcatgtgtgtatctatgagggtgcatgttcgtgtgtgtttcagtatgtggtttttccattctgtgtactcacccatgtctgtaactatgagggtgcatgttcacgtgtgtgtgtgtgtgtttcagtgtgtggtttttcccatttttcctcccttgaggatatcgcattgtatgttttggattctttgatcttccaattaaattacatcatttagaattgctttcactaagtgtgaaacaataaaaattttttttaattgtggctctggaaataccttcctttccctttcactctgtatcaagatttgtaaattttttaaaatttttgttgttattttaagttctggggcacatgtgcaggatctgcaggtttgttacacaggtaaacatgtgccatggtggtttgctgcacctgtcaacccatcacctaggtattaagcccagcatgcattggctgttgttcctaatcctctccctgtcccaactcaccctcctccaacaggtcccagtgtgtgctgtccccctccctgtgttcatgtgatctcactgttcagctcccacttataagtgagaacatgcagtgtttggttttctgttcctgcattggtttgctgaggataatggcttccagctccatccatgtccctgccaaggacatgatattgttcctttttatggatgcatagtattccatggtgtatatgtatcacattttctttatccagtctatcattgatgggcatttgggttgattccaggtctttgctactatgaatagtgttgcaaaaaacatatgcatgcatgtatctttgtaatagaatgatttatattcctttgggtatatacccagggattgctgagtcaaatggtatttctggttctagatctttgaggaatcaccacaccatcttccacaatggttgaactaattacattcccactaacagtgtaaaagcatttctatttctctgcaacctcaccggcatctgtttctccttgactttttgataatcgcaattccaactggtgtgagatggtatcccattgaggttttgacttgcatttctctaatgaccagtgatgttgagctttgttccatgtttcctggccacatgaatgtcttcttttgacaagtgtctgctcatgccttttgcccacttattaatgttttattcctgtaaatttgtttaagttccttgtggattctggatgttagacctttgtcagatggacagattgcaaaaattgtctcccattctgtagcttgtctgttcgctctgataatggtttctcttgctgtgcagacgctctttagtttaatttgatcccatttgtcaattttagcttttgttgcaattgcttttggtgatttcgtcatgaagtctttgcccatctttgtcctgaattatattaaataaagtctttgtcctgaattatattaaataaagcataagggaaaagatgtagaagggaaagtacatgtaatggttaaggcgtctactgccaatccctccccgttcctcaagatgaagcctgacatgctgggtttaatgtgtgagacaagctgccgacaggtcgtttgcctttgtctttaataatttagattaacacagaaatcttcaccatgaatttctgaaggcctttctttagtatctcctggtgttgaatttgctgttggaaggtccaatcccagtgagcatgcaaatccattggaaataatttgcatttttacaaataaataattttaggattttttttttgtttccaggacagacttccttgtatttttttaatgagttaaaaattatataatataaaaataacatttaaaaacccacaattcaggccgggcacggtggctcatgcctgtaatcccagcactttgggaagccgagacgggcggatcacttgaggtcaggagtttgagaccagcctggtcaacatggcaaaaccccgtctttactaaaaatacaaaaattagccaggcatggtgtcaagcacctgtaatcccagctactcgggaggctgagacaggagaattgcttgaacctgggaggcagaggttgcagtgagcagagattgtgccactacactccagcctgagtgacagagcaagactctgtctcacacaaaaacaaaaacaaaagcaaaaacaacccctcacaattcagcctaggatatgtttattaaatttacatttgtctttttgcttaagattgctttggtattcgtcctctttttggttccatatgaattttaggattgttttttctaattctgtgaaaaaaatgatgttgatattttgatgggaattgcattgaatctaaatattgctttgggaagtgtgatcattttcacaatattgattcttccaatccatgagcatgggatatatttctattttgctgtgtcatctacaatttctttcagcagcattttgttgttcttcttgtagagatctttcacctcctcggctaggtatatacttagatatttttaatttttgcaactgatgtacaagggattgagttttgcagcaacctggatgagctggaggccattattcatgacaccacatccagctaatttttgtattttttgtagagatgcggttttgccatgttgcccaggctggtcttgaactcctgggcccaagtgacccgcccgccttgacctcccaaagtgctgggactgcaggcatgagccacggtgcccggcctatcatagcacttttgatcattgggataattcctcctccttgtcatttttggacacatgcttcccacatgcctcatcttccagagagggtttccaccagggctgtgctgggagttaaggctggaaaaggggagatggttccagctgccagtgccacatgagtctactcagggctgtaaccagcagggaaggtccagtgtgagcctcagactcgcatgtgggacagacgcccatgtgtgacaacgctgcagtgaatctgtttcacacacatggaggaggcggctcagggctgaccatggacctgagtcaatgagcagagatatcccagtgccatccacaaacacaggggagaaggagccacaacttctcactttcatccaaaaccccgacccctccctgtctgtgagggcctggggttctcctctgtctcatacagaggcagaaacctcccccttagtgacccccagactttgcaagtcaccagcagccgctcggctctggcctcttctgcttcttaaggtttcctgcctatgacaggaagtctcatttctcattttcttcatcggaccatggctacatatttcagacacattataagtaggttttcccaatgttaggagcagatgtgggctgttgagcatttaagttgctcaccgtgactgtgcagtccaacaccaggatccactcatgtttcagcccctcaagacttaacccggtctggaaatgtaccatgactgaggccctcccatgacccaggcaccactggcccccaaaaccactcaggaggggggttcatgacaacaggctccaaatgaggaaaccgaggctcagagatgggacttactgcccaaggtcatgcacgcagggatgaaggtgagcaattcagaaaaaattaactccctatcccaccgccaaatcagagctcaagacaagtacttgttcccaaaaccttgaaggcagactgagatgcaggggaatgcccaaggaagcggggctgggggtgggagggaccccgaggaggcaggaatgactcagaggttacttttaagggaaggggagctgaacgctattaaaaaataggaagaaaaaaagaagggaagtctaagaaggaaactggaagaaataaaacccatactccaaagacaaaagaagagtcagcatttctttatttctcctttttttctcattgccaattgcagctcaacttgaatttcacagcccgatgtgagatgcgtctctgctgatctgagcctgtcctgcagcatggacctgcaactttcctgaagcatctccagggctggatgccatggtaaggatcccgcaatgctgtgttgatggacgggctgaaggagggaaggagaccccacggggaggctctgagaagaagaaaaagcccccagtcactctcacttggacaggacagactcagaaaggtgctgtgtcctgtgtcctgacccttgatgagatgaggacagatgaggcaaatcgcagaaaagggtcagggagataccatttctgtatgaaatatctgaagacagcctggtgcctgccccagtcccagccttggggaaatgaaagccaggctcctggagagggcagttccccttcttgtggggctgatgacgggacaacctcgtgatggagaacccaggctcccagtagatttactccatccaggaactgtggtctcgtccatctgcacagccaggggctgtggaggagatgccatgacttccacccgcaaacctctgatctgtcttgatgaaattgaaagagggagaggggagactgtagcctggaaggaatcccacctcacaacttggtcctgattgaatagaagaccccagaggttcacagagatcccaaggtggggaggatctgcccagggttcaggaggcgaatctccctcaggaagctccgtgaccccctccttagtgtcgctcctgtgcctcagtgggatttggagaggatgccttagattagagggtattgttcagtgggatttggagaggatgccttagattagagagtattgttcagtgggatttggaaaagatgccttagattagagggtattgttcagtgggatttggagaggatgccttagattagagggtattgttcagtgggatttggagaggatgccttagattagaggatattgttcagtgggatttggagaggatgccttagattagaaggtattgttcagtgggatttggagaggatgccttagattagagggtattgttcagtgggatttggagaggatgccttagattagaggatattgttcagtgggatttggagaggatgccttagattagagggtattgttcagtgggatttggagaggatgccttagattagaggatattgttcagtgggatttggagaggatgccttagattagagggtattgttcagtgggatttggagaggatgccttagattagagggtattgttcagtgggatttggagaggatgccttagattagaggatattgttcagtgggatttggagaggatgccttagattagaggctattgttcagtgggatttggagaggatgccttagattagagggtattgttcagtgggatttggagaggatgccttagattagaggatattgttcagtgggatttggagaggatgccttagattagaggatattgttcagtgggatttggagaggacgccttagattagaggtattgttcagtgggattaggagaggacaccttagattagagggtattgttcagtgggatttggagaggatgccttagattagagggtattgtgtctttcagcaacaaaaccgtacaaaaaacacctgggcatttcacatcagtggataaagcatatcttgtgccaaatcaggaccaaactgcggtgaaatttagggttcacactacagttaatcacttttgaggaaagcattccaggttggtgcctatctctgtgataaacatctcccttcctggctacaggtaatggattaaagtaacactggccgaacagacactatcttcacttgatgattatactgaaaaatagccataaaattgttccctccaaatccaattccccttttgactttagacaattctctaaagaagatatacaaatggccaacaaacatataaaaaacatgtatatatgcgtatatatacatatatacacacacacacacacacacacacacacacacacaccatggaatacttcagtcataaaaaggaacaaaataatggcattcgcagcaacctggaggcagttggagaccactattctaagtgaaataactcaggaatggaaaaccatcatcatatgttctcataagtgggagctaagctatgaggatgtaaaggcataagaaggatataatggactctggggacccagggggagcaatgggagggggtgagggataaaagactacgcattgggtacagtgtacactgctcgggtgatgggtgttccaaaatctcaaaaatcaccactaaagaacttatgcatgcaaccaaacaccacctgttcccccaaaactactgaaacttaaaaataaataaatagataaaaataaattcaccacattcaaaatgacaaccgctgaagccccagtgggcgcatgttacagggtgctcttttagtttcggccttccataggcaacttgtgtgtatcagctccattagacccctgccttcctgcaaggacagacggctctctgtatcccagggttctcgccttggtgtaccggaagaaccggatcacatgagggcttggagaatgagtgcaaggtttgattgagtggaaacagctctcagcagaagggcgatggttttctcctggagtcgggcccctggcggcccgggatcctctctgactgtcccagccaagctccatgtcgttctgccagtcggtggcctgtggtgtgctggtgcccgtccttgcgttcctctcgacatccagccatctgtgtgttcctgcactgacgtgctcctctcagccgccagtgtcttcttcttccgctgatctgcggacgtccagctgcttgtgtgtctgcctgctcaggtctcggagttgttttttttgtttgtttgtttgttttttaattatactttaagttttagggtacatgtgcacaatgtgcaggttagttacatatgtatacatgtgccatgttggtgtgctgcacccattatctcgtcatttaacgttaggtatatctcctaaagctatccctccccacccgccaccccacaacaggccccggtgtgtgatgttccccttcctgtgtccatgtgttctcattgttcaattcccacctatgagtgagaacatgcggtgtttggtttttcgtccttgcaatagtttgctgagaatgatggtttccaatttcatccatgtccctacaaaggacatgaactcatcattttttatggctgcatagtattccatggtgtatatgtgccacattttcttaatccagtctatcatcgttggacatttggcttggttccaagtgtttgctattgtgaatagtgccacaatatagttcaaccattgtggaagtcaatgtggtgattcctcagggatctagaactagaaataccatatattaatcacctcagttagttattatttctgtgtgcatgtgtgtgtgcagtgaaaatacttaggatctactctcagctaattttaagtgtacaatacagtattgttacctatagctttcattccatacattagctttccagaattattcatttcggagaattgaaactttgtatcctttgaccaacatcttatttttcccatttccagcccctgctaaccaccattctactctcagcttctatgaatttcactatttagattccacaattatgtgagattataagatatttatctattaagagttggattcatttcacttagcataatgtcatttgggtccaatcctgctatcacaaatgatctgattttcttctttttcaagactgaataaaactttatatttattatactatgttatcttaatccattcctccatcaatgggcatttatgtcatttatttacctcggctattgtgaatactggtgcagtgaattcatcagtgtggatatatctcttcaagatcttgatttgagttcttttggataattatccggaagttgaaatctggtgtcttatagttcaatttttaacattttgaggaaatgtgataccgtttctataatggatggatcggtttctgttaacttaaatcagggtattgtctttctcactcagaccgctgctggaatccttggaaattcttcactcctttacttttttagctttacttttatcacttcacagatattgagacccagagacctgattctcagccagctggtcttagccaacaacctggttcttttctctaaacgaatcccccagacaatggcagcttttggaatgaaatccttcctggacgaggctggatgaaacttgtcttctatctatacacagagtggccagaggggtttccctcagcaccgcctgtctccccagtggcttccaggccatgaagcttcaacctcagtatctctaggaggatggaactccgaattaggtccacaaagtgcattgttttctgctgccccctctgctggatcttgcaaattgtggcatatacccatattgcaatgcatgtaactggcccaatgaagagcaaaaacgtgagtatggaataaatgtataggtactctcctcacccattctaggatgattgctattcttagcaaatgcagtcattttctcccttgtggatggtatgtctttggccctcatggactacaccagcagctccatgatcctcttcttatatagacacaagcagacagtccaatgcattcgcagccacggcctctccccctgaaaatctcatgaaactagagccacacacaccatcctcgtcctggtgagcatgtttgtctcctctcatggtctagctggtattttatcactgtgggtaacctggattcagaacccaagccattggctgagaagcatctctttcctggtgtctgcaggattcccgacattcagcccctttgggttcattgtcagtgatgcccgcgtctcacagttctgcactgtctgctggacaaggaagacaaatgctccaagtgtggtctctgggctctaagttccctctagacaattgcgtcctttatttaatcacttctccccacaatatctgttggatcatacattatgccagttaatacgcaaggactttgggactcagtattgaataaaaatgataataaccatagcctcatattgcttcttaggctctcaaaaaatgaacgcagtgtaaaaattacccagatgtatgtcagttcctcagaagattaaacacagaattaccatatgacccggcaatttctgggaaaattaaagcaaggatttaaaaggatgctcatatactcatgttcataacagcgttattcacattaacaaaaaagtagaaaaaacccaaagatggataaatggataaacaaatgttatagaaactaggaaatactgttcagtctctcaaagaaatgaaattgtgactgacatacactataatatggagagccttgaagatattatgctaagtgaaataagccagtctcataaaggacaaatattgcaaatattgctaagattctatctatatgagctacctgtcaaactcacagactcaggaagtagaatcacggttaacagaggcttgggggcctggaaactgagagttggtgtttactgaatataaagcttcaattggaaagataaaatactttggggatggtgatggcgatggttgcatagcaatgtcaaaccacttcacaatactgcactgtagagttagaaagagtaaatatggtaaattttatttcatttgtttttttttttactataatttaaaatgagaaagagtagtaaaaacacacaaaagagaggagctaacagataaaaagtgcactaagttagccaagccagagctttaagaaccattatcacttctctctctctttcaccccacaatcaacattaatcaggtccaaccatgtgttctgccttcttagcactgctcacgtgtgtcccctcctctcttatttccatgcactctggcccagctgggcttcttctctctttgcctgtgatttgctctgttgtcctccctggctcagacgtgcagtcccagtctctcctgatgctttgtccccacattgagggcactgctgtttccccacaggccactcctttttttttttttttcttgagacagagtcttactctgtcacctaggctggagtgcaatggcacgatctcggctcactgcaacctccacctcccaggttcaagtgattctcctgcctcagcctcctgagtagctgggattacaggtatacaccaccacacccagataattttttgtattttttttagagacagggtttcactgtgttggccaggctggtctcgaactcctaacctcgtaatcctcccacctcagcctcccaaagtgctgaactcctaatacaccctctgtcctttcccaccttgtctgtgccctggaggctgactctatggattgcatcatcagtgtctccttgcctttagcgtctgattgagttcaaccatggaggcactgtcaggagagcagagggtgagaggagagagaggccggggaatcaattcccacacatatgccctgccaggctgtggtttgtcagcaactgtgctcctctacccatgacatcagctcccgcaaggcacctcccatctcccacacagggctctctccaccccttgacctcccatcctgggagtggcagtggcttcctggggtgcttcatccctctcatttgcccacacctttatacacttctttttcttttttcttttcttttttttttttttttttttgacggagtctcactctgtcaccaggctggagggcagtggcaccatctcagctcactgcaagctctgcctcccgggttcacgccattctcctgcctcagcctccaaagtagctgggattacaggcgcccggctaattttttgtatttttagtagagacagggtttcaccatgttagccaggatggttttgatctcctgaccttgtgatccacccgcctgggcctcccaaagtgctgggattacaggcgtgagccaccgcgcccggcctatacactgctttttctatttccatttttattttagaattgggggtacatgtgtaggtttgttaccaaggaatattgtgtggcattgaggtttggagtaagactgagcccctcacccaggtagggagcatggtacccaacaggtagtttttcagccccatccccctcctctccaccctcagtggtccccagcgtctactgttgccatctttatgggaagatgtgtacctaatatttagctcccacttataagtgagaatatgtggtatttggtgttcagtttctacattagtttacgtaagataatggcctccagctgcatccatgttgctgcaaaggacatgagttcattcttttttatggctgtgtagtcttccatggtgtatatggaccacattttctttatttggttcactgttgatgggcaacgaggttgattccatgtcttttctattgtcaatagtgctgcaatgatcatccaagtgtgtgtgttcttgactagaatgatttattttccctggatatatacccagtaataggactcctgggtcaaatggtagttccattcctagttatttgagatatcctcaaactgctctccacggcgactgttagtcctagctctttgagaagccaaggtgggaggattgcttgaggccaggagtttggggccattcgattctctaactactacccctgctgtatagaaatgtcattgatatggatttgtttttattttcttataaatcctaatggactttgaattttctatttagagaatcttactacctacaagtaatgaaaaaatctctctagccctcatatatcttatttttagttttttacttttactgatattattacatcagttaggacacctcagtagaaaatggaataaaagtggaaagaccattaagcctcgttttgttcatattttagtggaaattgatctaagcttcatcattaaatataatatttgctattgatttgttgctgggcatcctttaacatgtttatgatgtttcattctattcctaattcattaagattttttaaaccataaataagtgcagattatagtaatattgagcaaatattttcttctcacctccaatgggccaccctctagaccccctaccctcaccctcatctcccctacctcaccgcgggtctctgtcctcagacccctgctgcaggggacccctggaggtgacatatgctcagctggaccaccaggccttcacttggaggacagcccaggctgtgtccccagagtccatggtgcccatggctgagtctagcatgtacacagccctcgccaggcactgactccgggaccactgccccctgcgcctgaggaagtcatgcttggaaaagcctcaagaagccatctggagggcttccccttggaatcatcctggtctgcaaaaccagtcaactgttctggagataagaggtagagcccaaagttctctagtcagcatctagaaagttcattaaccaggtgattccttccacaactgaccagcacctcaaagaggtggcattgcagctacttctagaaacccagctgcaatcacctggctgtttccagacacctagttccagtcacctggttgtttccagtgatccagctgctgtcacttctctgtttcaagacacccagctccagtctcctggctgtttgctgagtctcagctatagccatcccagctgattccattaacaatgttgcatccccctgcagtttccaaatgtcttctgtaaatccccccagctgccccagcaatcgtctactcagctgatcctgaacattctcctagagtttagttgttgaccttgagaatgagctatacatatggatctgagagctgagaccagtcctctgggtcatgctttacttcatgcaccaatgaatagtttaaagacctcacatctggcagtcctgtgtcatgttctggggtgtatagatcacttggacccaatctctgccttcatgttgttcaaggttacatggggttaacaagagctacaaaggaggtgtcagtatttttttaaggatttcattggcagtgattgcatatattcaagatgcacaaggtgataatttgatatacatatacattgtgaaataatagccacggtcaaatgaatcagcgcatccatcaccagctacgctgtacataagatcccctgaacttgctcatcttaggcctccaagatggagcatatgatcagggatcaattaaggtgtctgagcggatgcatggatgggtgaagacagagagctaatcccacttatgcacttacacacatatgcacatgtactcacacattcacacatgcacacacatgcacaaacctgaacgcactcacacatgtcaggagacctctgaatcctctgtgcgctgggacttggttgtctccacccctcttagaaagttagatgctctccctattcagattaaaacggaaaattacttgagaaccactagggggagacagtacctcatttgaattaatttttgtgcacatttaaaataaacaataacacacttaccatgggcatgcctttggccggattgcaaaggtaaacatatatcaaagcatctcatggtacccaataaatatatacaattattatttttcaattaaaatatcgtaataaaataacagaaaagaaacctgcatacttgtaacagagtggatttttaaatgtcgttttatacaagaaaaagaatattttttaaaaaactcaacaataactcaatcagcttatcctatggagcaattactagttgaatactatgcaaacatcaacacattcactagtcttacatatgccccacagcttgtcctattttttccccacttgtggggattttgatagttgttgagtatgtctaatccaattatacattccagagcaaggaataaagccacaggatgcatttggtggccaagaaaattcaacaggagacaaatctgagctaaaggttcattgactacctgacctccataagcttctaatctgactggagggtcaccatgatgttttgggtcttctgaagttagtgttagctcagagccagtgtctagttgcacccaaaatatctgatcatttcctttacccagtacacagctaccatgataaaggccataggtccatttaagggaagctgagataaatataattgtttaactttttatagtatataccggggcagcgccttcaaggatacctggtcttccctttaattcaaggggttctgggtctataaactggtgaaattctagtaattgattaagagactgtaactgtctattttatgattttaattagattcttgttctctttgccaagaaatgttctgcttatacaaatcaagtaagaatgaagtaagtttcctatctatttcacgtcttagaacgctgcggtcaactagacaacactaaagggctgcatgagacagtctattctgattactgccttgattctgctttccattatgatcaccacacccagttctatgataaccacacccaattcaacacaccagattctcacctttgtcgactgacttctgacacttgagtcctgccactctaggatccaactactccccttacatttaggtttctcggttcagtggcagcagttcccactggaagttctggcctctcctaatacaccctctgtcctttcccaccttgtctctgccctggaggctgactctatggattgcatcaccaacatcttcttgtgtctagtgtctggttgagttcagccatgggaggcactgtcaggagagcagagggtgagaggagagagaggccggggaatctattcccacacgtacgccctgccaggcaataaactgtgctcctctacccatgacataagctcccacgaggcacctcccatctcccagctcagtcctcaaggtgactttccagagacctagttacattcggctgttactaaagagtcagctacagtcatctagctgtttccagtgaccacccccaatcccccatagctgcctgcctgtttgcagagacccagctacatgcacctagctgtttctagagacccggctacatccacctggctgtttccagagacccggctacatccacctggctgtttccagagacccggctacatccacctgactgtttccagagacccggctacatccgctggctgtttctagagacccggctacatccacccagctgatttcattatcactgacgcagtccccagctgctcctatgtctcctggaaatccccaattgccccagagactttgttgtaattttctgttcagctgactctagggatcttcctggagcttaattgctgaccttaagaatgggccatatttatgcaactgagagcagagcccagttctctgggccatgctttcctttgtacatcaacaaataatcctaaagacctaaagtctggcaatcccacgccaggtcctagggtgcacaggtcacctgcatccagtctttgccttcacagttattcaaagctgagcagggaaaaaggagagccacagagaagttcagtgttttcctttttatctttttaaaaaatccttttttatccttaaaatgatttaatcaaccaagattgtatatattgaggtgtacaacatgatgatttgatatacgtatacattgtgtaatgattgccacaatcaaattagcacactcaggacaaccagtgccctaaatagatcccctggatttgtacacgttatgccttaaagttggtgccagagttccatttatttatttttatccatatataatagttgtatataggtttggggtacttatgatattttgatacttgtatgcaatgggtaataataaaatcagggtaattagaatatccatcacctcaaatatttatcttttctttttgttggggagcattacaattcttttattctagttgttttgaaatacacaatatattattgttaactatacttcccctactgtactgtcaaatactcagttatttctcctatccagctgtatttctatactccgtaactaacatctccttatctcccaccctttccagctctagtaaccaccagtctacacattttttttttttgagacagagtcttgctgtgtcacccaggatggaatgcagtggcgtgatcttggctcactgcaacctttgcctcctgggttcaagagattcgcctgcctcagcctcctgagtagctgggattacagatgcatgccaccacgccaggctaaagacagggtttcaccatgttggccaggatggtctcgaactcttgacctcaagtgatccacccgcctcagcctcccaaagtgctgggattacaggcatgagccaccacgcccggccttttttttttcttttgagacaaggtattgctctgttgcccaagctggaatgcagtgacacaatcatggctcactgcagcctcaaccctccagggctcaagcgatcctcctgcctcagactcccgagtagctaggaccacagtgcacaccaccacgcccaactaatttttgtatgtttcgtagagaaggggttttgccacattggccaggctggtctggaactcctgacctcaagtgaaccacctgccttggcctcccaaatcactgggattacaggcacaagccaccacacctggccaaccagtctactctctctgtttaggaatccacttctttagctcccacgtatgagtgagaacattcgagatttgtctttctgttcctggcttatttcactgaccataatgacctccagttccaactatgttgctgtaaatgtcaggatttcattcttttttatggatgacccctcttccattgtgtatacataccacattttctttacccttttatccactgatggacacttaggttgattccgtatgctgacttgtgaagagtgctgcaataaacacacgggtgcagggactcttgtgatgtcctgagatttttttcctttgcatgaatattcagtagtgaactcactggattttacgataattgcagtttcagtatcttgaggaatctccgtgtttttttttttttttctttttttgagacagagtctcactgtcgcccaggctggagtgcagtggcgtgatctcggctcactgtaggctctgcccctcggggttcacaccattctcctgcctcagcctcccgactagctgggactacaggtgcctgccacctcgcctggctaattttttgtatttttagtagagacagggtttcaccctgttggccaggatggtcttgatctcctgacctcgtgatccgcccgcctcggcctcccaaagtgctgggattacaggtgtgagccaccgcgcccggccggaatctccatgttttccataatggctgtactaatttatattcccaccaacagtgtctaagagttattttgtcagcacatcctcaccagcatgtttttattttattttattgatctatttatttatttgtttgtttgtttagatggagtctcactctgtcgcccaggctggagtgcagtggtgccatctcagctcactgcaacctccagctcctgggtgcaagcgattctcttccctcagcctcccgagtggcaggagcctcctgattacaggcgggcgccaccacgcccggctaatttttgtctttttagtagagacggggtttcaacatgttggccaggctggtctcaaactcctgacctcgtgatccgcctgcctcggcctcccaaagtgctgagattacaggcgtgaaccactgtgcccagcccagcatgtttttatatgtttctttgataatagacattttaactgaaataagatgatactcattgtagtttcgatttgatgccagtgatgattgtgggtttttgtttgtttgtttgtgttttgagatgaagtctcgctctgtcacccagattggagtgcagtagtgtgatcttggctcactgcaacctctgcctactgggttcaagtgagcctcctgcctcagcctcctcagtagatgggactacaggtgtatgccaccacgcccagctgtttttttttctttttttgtatttttggtagagatgaggtttcaccatgttgcccaggctggtctcaaactcctgggttcaagtgatccacctgctttggcctcccaaagtgctgggattacaggtgtgagccaccgcgcttggccgatgattagtgttttatatagctgttggccatctgtacattttcttttgagaagcaactattcagatgctttgcatacttgttaatggaattatctggggattttttgttgaggtgtgtttcttctaggcctaatttgttgatagttttaatgatgaagggatgttgaattttgtcaaatgtttttttaacatctattgtgatgatcatataatttttttttttttttttagacagagggtctctccttcacccaggcaggagtgcagtggcgcgatcttggctcactgcaacttccacctcctgggttcaagagattctcctgtctcagcctcccgagtagctggactaccggtgcacaccaccacacccagttaatattttgcatttttgagagagatggggtttcatcatgttggccaggctgatctcgatctcctgacctcaagtgatccacccatctcaatctcccaaagtgctgggattgcaggcatgaaccaccgcgcctgcccatgattatatgttttttgttcttccttctgttgacatgagatatcatatctattgatttgagaatgttgaaatatcctcccttctggctgctgtgtggactgcgagctctcctaccctccatggtcttccaatcccactgtccccaggccaactgctcccagactatgcagtagtctcatgtgcatggagcagttgcaattgatcctggtggtgacagaggggttggtgtttcaggcatggcacagtcagaggaggtcccaaggagagaccaagaggtaaacttaagtagagctgcaccccttccttggcatctgtagaaccctggataaaatcaaatacgccaacccaaatgcccatcaatgatagactggataaagaaaatgtggcacatatacaccatggaatactatgcagccacaaaaaaggatgagttcatgtcctttgcagggacacagatgaagctgaaaaccatcattctctgcaaactaacacgagaacagaaaaccaaacatcacgtgtcctcactcataggtgggagttgagcaatgagaacacatggacacgaagaggggaaaatcacacaccggcacctgtcacgggctggggggctgggggagggatagcattagaagaaatacctaatatagacaacaggttgatgggtgcagcaaaataccatggcacgtgtatacctatgtaacaaacctgcacgttctgcacatgtatcccagaacttgaagtataataataaaaaaaaagaaaacgaaacaatgaaacatgggttcttatgaatcacagaacacccgtgaccccaagttaagatggaaatttatgattcattccaactaggtcctgttttcagtatctcacaaaagcttgactctagagtgaaatatacttggaaatgaatgaacgactcttgtggtctttttacttcttgtaaggctttaggatccacccgtttgaatacctatgaccaggacctcctgcaatgcttctctctccacctccaggcatcccttcattcagataataccaattcatcatcaccatctgacctctccttcagcttcttcaccaccctccatctcaattgctttctgtttttcttctttattttttgaacttcaacttttattttagatacgaggatacatgctcaggtttgctacatggaactattgcacccaggtggtgagtgcaggacccagtgggtatttcttttatcctgtcctattgcgttaaatctttccttcccgggactggtcctatctctaaactttttgcgtagtgattttatcaacttaatttttgctaggatgctagattttctaggaggggaggtaatttgaaatgaagtctgggttactgtgaatccagtatatctgctttgctcgcctttatctcttgtgtcctgggatggccacaggttgacatgtttaaatgtttcttaagtgaggatggataagatttactgagtggtgagtgcacgaatacaaaagcaaaatgaggccgggcgcggtggctcacgcctgtaatcccagcactttgggaggccaaggcgggcagatcacctgaggtcaggagttcgaaaccagcctggccaacatggtgaaaccccatctctactaaaaatacaaaagttagccgggtgtggtggcagctgcctgtaatctcagctctcagctactcgggaggctgagttaggagaattgtttgaacccaggaggccgaggttgcagtaagccaagattgcaccactgcactccagcctggatgacagagtgtcaccctgtcacaaaaaaaaaaaaaaaaaagaagcaaaatacaagaagtccaggactggtaaaggcaaggcatgttgagcggttagaaaaggggtgatgacatcgaaaaacctcctggcatttcccagtccttgcctagcacaggttactctgaaagcaggacttaagacaaggatatgagcgcaggtaactgatttgggaaccaagtttaagggaatagggttcccttatgaaagagagaaggagaggaattcctgaaatcagcatgcattgcggacaccactacagcaggtaatatggacaggtccacaccaggatctctgataatgtgcagaccatcatccagaacttcccgccaaaacaggagatactcgccaatatgtgtatggctttctagcccccatttctgggagtttctttttccccagccactgtcagacgcatcaagctttggctgaaatagcttccaataaggtccttacacacaaatgtggagagacacatggaaatcctcgaaatgagatactgtcccgtgattctgagagtgacccaaaaggatacggaatgaggtactaaaagcaggtgcttggaaacctgagggcagtggtgttcatgcgtttcccggcactttgactttcagcctcctgcaagcctctccttctttgccttcctgaccgttagatacaattaatttggggtttgttttttctgcttcctctttcccctcccaccctatgtttcagttctaaagttagaaggtcctctcatccttttaagaagaacagagacagaaaatggttagtcaccatctaggacagactacaattccagatcattgcaggacgtgcccactcaaatggatgattattgagagctggccacctgaagtgttttacacaggcagtgatctaagggttgaagctatctggcctttttgcttgcttgttatgtatttatggcttttttccttttcaaaataattttactaaatatttaattcaccaactatatatatttatggggtacaatgtgttataaatgtatacactgtggaatgatggaatcaagacagttaacatgtccatcactccgcatactaacatctgtgaaaacatttaaaatctatgcttggctgggcgtggtggctcatgcctgtaaccccagcaactttgagaggctgagatgggcggatcaccagaggtcaggagttcgagaccggcctggccaacatggtgaaaccccatctctattaaaaatacaaaaattagctgtgagtggtggcgggtgcctgtaatcccagctacacaggaggctaaagcaggagagtctcctgaacccaggaggcggaggttgcagtgagctgagatcacaccacagcactctagcctgggcgacagagtgagactgcatctcagaaaagaaaaaatatatatatatattttggagctacatcgtgctagcgctgcagagaatgagttttgttttgcgacacagtttttagatgtctaccgggctctggtggagatggaatgtttggcctcaagtgggcaggtcccatgggacatgagtagccgaccatgacctggctgcgtactggcccaccaagcattcgactggcgtgcccagccactctccgtcatcgcagagaagtgctctatgtgagatttggttaaaggagtccctgaaggcctgtgggaggcagaatagtgacctcccagagatgtccacctcctgaggcccagaccctgtgagttggggaagcttatgtggcaaaagggactttgcagatgtgattaagtcaaggatcttgggttggggagattacccaggtgggcctgatgtaatcacaaggggctgagtaagtgaaagaggaaggcaggagggtcagagtgagagaaggaggtgagtgcatgcaagcagggggcagataacgggactggtggctttgaggttggagggaatggagaggcaggaatgcgggagcctgcagaggcttgaacaggcgagggaacagattctccttggagcctccaggaggacacggctctgatagcagcttcattttagcccagggagacccattttggacttgtgacctccgggacggtaagtcaataaacctacattatgtgaagccactaagcttgtggtgatttgttatggcagcaaaaggaagctttatggttcatctgtaccctgaaaatgcaggtttttggtttttttttttttttcacttgttcaatgatgtacccccagtgtcaggcgctttgcaaacacacgatacatacgggttgatgtttggtcaagagaggaattaagaccaggcagacagcaggctgggatcagagagaccccatttctgtctgaaatgtctgcagagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcggtgagatttaaagagggggaggggagacccgagtcttggaggaaatttgcctcacagccaggccctggttctttaggagactcaaaaatctcagggtagccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggggtggttgcaggcgcctgtggtcccagccactcgggaggctgaggcaggagaatggcgtgaacccgggaggcggagcttgcagtgagccaagatcgcaccaccgcactccagcctgggtgacagcgagactccgtctcaaaaaaaaaaaaaaaaaaaaaaaaaaatctcagggtaaagagaggacctgctcaggcttccggggcaaatccctcacagggaactctcttccagggctgagtctgggccccaggacccacatgcaggcaggtgagtctgtccccagctgtcccaggtccctcctcctcactgggacaaggggccacccatgggcagctgggggaggagacagcagttctgggtgactgatgaggatgacgggggggtcctggggctgagagctgggatctgagggctgaggaaggtcttgggatccagcctctgattttcttccagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggtgagaggacactcaggggtcccagccccaggctctgccctcaggaagggggtcagctctcaggggcatctccctctcacagcccagccctggggatgatgtgggagccccatttaacacggtgcctccttctctcctaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggtgaggctcctgaccctgtcctctctgagctcagtggctccgttcatgccctgctgccaggagagctctgggcagggatggagggagaggggctcagccagtgggggactcagccctcagaggggaggaggacaacaggggccctcccaggcatgcccatgctcttctccctcacctagggtccagaaggtgccaggtggacagagaaatggtccttgggaagctgcagggcagatatagggagaggttcaatttgatgtggagacccaagggcaaccccagactctcaccctcctcttgtccttctacccaggatccttggaggatcccaggccctcacccacaaggtccgtctcaacagctggtgagtctcagaggcctctgtccagagagtttccaaagcccgaggcctgtctcaagacatgctcagtggatctaagtcctcgttccaattctcagctgggcttgcttccacgggtgtgggagtcgggcagcgacttgggaggcaccacaggctcccaaggccctgaggctgggctggtgaggggtgagggggtcaaggctgaaggagatgttgcggggagaagccgagctgatgcggggagcagggcagccccagccctcacatccctgttctaacccagcaggccctgaggaccagcccctcatgcctacagggtcagtcccccacagtggtgagtgaggggctctgagtgggaggtgggcagggtctaggggagccaagggtgggttctgtcctaggttaaggctcctctggaggtggtgatgtggacaggcccctcccctgcatgggcctcagtttctccaagtgtaaaggagagaggcctgcgggtgggaaagttcctttcagctctgactcccagctgtgccctcctgggagaggaggcctcccagggaacctcccagacccgattccgcaggggcctgtccggtcccacctgcagcagagacggtgacctggggcaggggaggggagcagggcggtggttcaagacagtcaggctctttccctgcaactctggggcttggctctggtgcaggaacaagggctgcagctcagactcccgggtttccttcccagctctgccgcttcctggctggaggggtctggggcaggcgattcccctctctgagcctcagtttgtgcatctgtgaaatgggtggagagagggtggcaatctcaggttgcacaactgctgtgagggttggaggtaatgaaagaaagacccagcacacacagtaggtgcacacacagtaggtgtgcacatcaatgacatcatccccattcctgatgtcatcacgcccaaggtctgagaaggcactgggaggtactgatcggggtcttggtggtctccatcctgcttctctccctcctcctcttcctcctcctccaacactggcgtcagggaaaacacaggacattgggtaagtaggaaattgggggacccgtgggctgatggagggtgggctcagggcaccagccaaagggactccagataggagaggtcatcttagaaactctgctccagaaattcccagtgagaaaatctagaaagaagaaaatgaatgagggagtaatggaagtgctttattctttcggtttttctaaacttagaaag

SEQ ID NO: 815 - DNA, 23710 bp, Homo sapiens
tccacatcttgcaataataaaataaacagtatttcaagtcaccttaaaatagataatgtctacattaatagatgttcatccacacagccccgtttatcacctggaaccatacttgagaagtcctgcctaccagtgtccatcaccagctccattcctctgtagttggtgccatctgcaagaatcgagccccttcctggggtttgcacaggctgcagcctcctcctactacagcagatgccaaagggcactgggcatggtgtgggggtcagttcactttcacacagggcttgtgttttccgtggtctcggcaacaccaacagtgtctgaacatgactgcacagacattggtgcccgccgctgcttgtgagctccaagaccatctctccttctgtgggtgccccacttatctcactttttgacccctccccaggtctctggaaccctctcttcagtcttgacttcctgctggcctgtctggaccaggtctgtcagtcctactccccagcaccagatgggccctaagaatccccctcctgccacacctgctatttcctcatatccagcctctcaggctacgatcaccacgccacccttccagaaggttccttccaaccgcccttccgaaaaggccctctccatggccctcttgtcaatgactcactcccagcatggacagcagagacgtgacccacacctctaacccatgaggctctgcccagccctccctggacatgtcagaaaacagagagaccctagtcactgtgggtccagaggcaggaccagcagccacgtccatgccttttcagagcaccctcaccagggtaaggcaagttctagcaaggcagagagggatctgtgtgaggaggtacctctcattaccaccactgttaatcatcattgacttattcattcatagagaaaaagtcatcttgaaccatcaaacccgagagcataatgtcggatacggaaagtcggtgggagaagtcatctgtcattaggggtgggagcggggaacttaacacgggcatccaggaaaaggcaggatgagaagaaaccgtggacttggtaaagtctgtaagaaacgtcaccatctgagccatcgctacagcatctgcctgtatttctcacatgcttacatgaaaggcattatttattcacttggacaacaaaggctgcttttcgtgagagtcactggtcctcccatgagggcatccaccgatacttcaagaatccttcctggggccgggcacagtggctcacgcctgtaatcccagcactctgggaggctaaggggggggcggatcacgaggtcaagagatcgagaccatcctgggtaacacggtgaaacctcgtctgtactaaaaaatacaaaaaaaaaaaaattagccaggcgtggtggcgggcgcctgtagtcccagctactcaggaggctgaggcaggagaatggcgtgaacctgggaggcggagcttgcagtgagccgagattgcgccactgcactccagcctgggagacagagctagactccatctcaaaaaaaaaaaaaaaaaaaaaaaaaaaggaagaaagaaagaaagaaacaatccttcctaggacagtgaatcactcctataatcccagcactttgggaagctgaagcaagacgatcgcttaagcccaggagttcgagaccagcctgggtaacacagtaagatcccaactctacaaaagaaaatatgttttttttaattagcaaggcatgatggtgcatgcctgcagccccagctactgggggggatcacttgagcctaggaggtcaagggtgcagtgagcgatgatggtgccactgcactccagcctgggtgacagagcgagaccctatctcaaaaaagaaaaaaaaaaacaaaaaaaccagtccccacactagcagccacccataagaatataaagaaagcatggtgccctccaccaccttttacttctatacctaaccagcaattttggggggaaaagacataaatgggaaagagttctgacacatgactagctaagaaggttttgaaataaaagtaaagagtaggaattccgccaggtgcagtggctcacacctgtaatcccagcactttgggaggccgaggcaggtggatcacctgaggtcaggggttcgagaccagcccggccaacatggtgaaactccatctctactaaaaatacaaaaattagccaggagtggcggcatacacctataatcccagctactcaggaggctgaggtgggggaatcgcttcaacttgggaggcagaggttgcggtgaactgagatcaagccactgcactccagcttggacaacagagagagactccttctcaaaaaaaaaaaaaaaaaaaaaaaaagagagaaagaaaaagaaaaaaaaaaaaaaaaaaaaaatatatatatatatatatatatatatatatatatatattacaagcctatgctaattacagcagcttgggacaggagaaacagaaagacttatagaatgaaattaagaatacgctgggtgtggtggctcacgcctgtcatcccagcacgttgggaggccaaggcgggcagatcacctgaggtcaggagttcgagaccagcctggccaacatagtgaaaccccatctctaccaaaaaaatgcaaaaattagctgagcctggtggcacatgcctgtaatcccacctactcaggaggctgagacaggagcatcacttgaacctgggaggcagaggttgcagtgagcccagattgtgcaactgtactccagcctgggtgacagagtgagactacgtctcaaaaaaaaaaaaaaaaaagggtgcagtggctcacacctgtaaccccagcactttgggaggccgacgtgggtggatcacgaggtcaagagttcaagaccagcctggtcaagatggtgaaaccccgtctctactaaaaatacaaaaattagtcaggtgtggtagtgtgtgcctgtaatcccagctactcaggaggctgaggcaggagaatcacttggttccgggaggcggagtttgcagtgagccaagatagtgccactgcactccagcctaggcaacaagagtgagactccatctcaaaaaaaaaaaaaaaaaaaaagaagaataaaatgtgtgtcaccagcccccagcacatcccctccacaatagtagagtgtagggtagggctctgcctgctcatttcgccccaggaggccaaccctccctgatagtccaggatatttttggaaaaaaaaaaaaaaggtgcttttccgtctccccaagatcctcaagttcaactagacatttcctatataaatgttttgttctgcctgttcattttggtgggtgcccttttctcccttccccaccacccgtgctcctcccagtctgcccctggcctccagccctgaggatcagttgaggtagggtccctggtattccgtaccctcctccctttgtttctgttggttgtcactcctgctgaatgtattgctttttaatactgtactgcaggttttttttaaataaaattgtttggaaagtaaaagagaaaaggaataacgtgtgtgatatattgaataaaaaacacttcatagatctgtagtctagtgggggaataagaaaaagttttaaaatttttatttattttagagacagggtcctgcctctgttgcccaggctggatggagtgcagcagcacaatgatagctcactgttacctcaaactcctgggcttaagccatcctcctgcctcagcctgcccagtagctaggactaaaggtgcacaataccactcctggctaatttttttacttttaattttttttctagagacgtggtctcactatgttgcccaggctgatcttgacctcctagggtgaagtggtcctccgaccctggcctcccaaagtgctaggattacaagcatgagccactgcacccagccaaaaattatattattatttaaatttatttatttatttatttttattttattttttgagacggagtctcgctctgtcgccaggctggagtgtagtggtgcaatctcagctcactgcaacctctgcctccccagctcaagagattctcctgcctcaccctcccgagtagctgggactacaggcatccgccaccacacccagctaattttttgtatttttagtagagacggggtttcaccatgttggccaggctggtctcgatctcttgacctcatgatccacccaccttggcctcccaaagtgctgggatttcaggcctgagccaccgcgcccgcctatttattttttctgagacggagtcttgccctgtcacccaggctgcagtgcaatggcgccatctcagctcactgcaacttttaccttctgagttcaagtgattctcctgcctcagcctcctgagtagctgggattacaggcatgcaccaccacacctggctaattttttgtatttttagtagagacggggtttcactatgttggccaggctggtctcaaactcctgacctcatgatccactcacctcggcttcccaaagtgctgggattacaggcgtcagccactgcacccagcctcaaaaattattattattattttgagacagactctcagctctgttgcctaaagtggagtgcagtggtgcaatcttggctcactacaacctccacctcccaagttcaagcgattctcctgcttcagcctcctgagtagctgggattacaggtgcataccaccacacccagctaatcaaatattattttttaatccttgcaaatgtaatagcaaaaactatgaatgccccaagctagctagggcttagggaggcacggatttgtataaagtgctggtgaacttgtaaagctgaggatccacagtgagatatttctacaacatccacaccctctgatccaacacctgcaacaatgggcttggcaagtaactcatggggaaagcacctctcttggctggggcttcctcaactatggtgggagcaacacaacacaactcatcccatgagatgtggtgaagatatcagctctaggccaggcacagtggctcacacctgtaatcccagcactctgggaggccgaggtgggaggatcatgaggtcaggagatctagaccatcctggctaacacggtgaaaccccctctctactaaaaatacaaaaagaaagccgggcgtggtggcgggcacctgtagtcccagctactcaggaggctgaggcaggagagtggcatgaacccgggaggcggagcttgcagtgagctgagattgcaccattgcaccacagcctcggtgatagagcgagactctgtctcaaaaaaaaaaaaagtatcagctctagcctggccccaggtgagtccacaagggttattcttctttttttcccactatactaacaaggacgtgagggttcttttttttttttttttttttttttgagacggagtctcactctgtcacccaggctggaggagtatgaaggaactggacaacctactgtgtgcgtgggaggatccaagtccagttgtatgaaagggccagggctcttcagggaacatgtggggctccactggccacacagggcacagaaatagcaagtcacaacaactatcacttcgcagaagagaattacagtgcacggccaccaccaatgacaaacagatgctcatagtgggaccccaactgaaaaggatactgtctcagctccaggctgcagggctgacaggaagagcctcgaatgctaccaggaactctgtgaagcccagctgcctcacagcccacgtggggtgctgcctgcactgctcccttcgaaggctagttctgtctcaaagtggcccatagcctgatgaggaggctgaggcacgggagagcacagtattgtgccaaacccctactgactccaatggggacggcaccaggttcaagaggccgaagaagagactaagagccagcaaacaagatgtagggttttactgggggcttacataccggggagagtccaggggcggtgggctgggcaggagaaccacttgcaaaaagcatgcagtttatatggcattttcacttaacatcctccccctggcaaccttcatttaactgaaagcaaaaggccaggatcccttataccaccagcattccatgggacagggctaaggacccagatgttcctcaaaaataaggaatgaatctctgagattccttagctgggaactctgaaccacactcaggtgcgtctgccacacagggccattctcaggtgtgcttaagcattgctgtggggtgtgtttactatgcacacgagaagggatgggcagggtcgcagtctgcagcactgcccacggacagccctttgcatatggcgtttactgctgtggggttccttttctcaccatcatcaccccagctgtgctcccaaagttaacccatggaccaccggcctggcaccaccacaactgttccagtgtctgtagcctcaccttcagttcctactgggccgagaagccttggaggcagaggctcagcacccacacacccccacctacatctccactaggcttcgggtagcaggtccaactcctgagactgtgcagactcccattttccagaggcctctgctcccactgctccccacctacaaagcttgccccagggcctctacacgtgccgttcacagtgccagggacactcctcccccagttacctcctgcttgcccttctagcctcagtccagcaacctccaggctttgtcagattgtgtatccacagcacttcacaggggagttatccacatccactggcccagccaccgcctcagtggcccaccaaagacccacagatgagaatcagagttctcatctctctacctcagagcagctgcgaggctggccagctcctcccacacccttggcgttacacagacagggtcatcccacagggatggctgaggttctttgctgggagacagggaagaccctaaaataaggtcttcagggcactagcccctgcactcctccattgctccttcatccacgcagacatacagacttctgtgaacacatctgagtttattctgccactgctacagggcccactgtcatttccagcccactgaggttgagggtatggccaggctgggattcacacaggcccaggatgaaagggacaccgagtgtgttggggtgggggtggctggctttgatccctaccccagtgggttggccaggtgatcagagcctccaggttccctcacacacagcctggtacatttctgccgtcaggggccggaaggactgggcccggttgtccagtacaaacagagggtcaaccacgatccccacattgaagccctcacgcaccaaccgggtcttcatcagtttgaacgtgctggtgacctccatggcgtcctgcagggcagtgaccatggtccaatcactgtgacatccacccgccccctggctatgatcttccacccacccaccaggccaccctgggctcacctggatgcggatgaaatggggggtagcgtaggcagggagccaagcgcgaacgtgctggtacaacttctccccgtcgaaagtctggccgggggctagctgcacagcagccatgcccaccttaccctcacaacctagagagcagtctggtcactctcggctgacccatctcgagggcccatagctgaccctccagcctcgcccagctctgctcactggctgtgagagccagcaagtctctaaacctctctgggccctagcacttccccacctgtaaaatcagaataacgacccctccacccacaaagctgttggaagtttaaaatgagaaccctccgcacctggcacgcacacgccatacacgttaacctgttgcaagaagtccacctgcgacaacacgccctccacctcgtgcgtggacacgttctcgcccttccatctgcaaggagggagccggcgcttgtgaccacgcccccgggaaggagaggccccgcctcttgcccccgccccgccccttttggggatcaggaggcccagtcagccccgccccctcgaaaatcgagaagccccgccttcgcgtgagaagtcctgactccaagttccgccctcttacgacaggaaagtcccgcctcttcagcctgactccctctaggatctgaaagcgtccgtggccccgcgccagccccgccccgagaaaccctgcctcggaccggaaggtgtccccgaggcggtcgcggaagtagaggaagccttcgcggtccatggccagtacgtccccggtgttgtagtaaacgtcgcccgattgccgcacgttgcgcaccagcttccgttccgacagctctcgggggccgcggtagcccacgaagggttgctggcttaccaccttggtcagcagcagccccggctcccctggggtaggagcaggaacaagaacccctggagcccaccagccaagccccctgctggaggttttcaacaacggtggactcttcatcacccagcaccctgccaaggacagacccaaagacacagacagggagatccagagatgagagagacattcagagaccttgagagactgcgacaagcgacacagaaaatgagagagaagtatagagaaggcggtatggggagcccatgagaaacaggaaaaggataacaagggatggaagacggacagacaaatggcagtgagaatagatatgaccaggaccttgcaaggccctgggagaagacactaacagaaggtacaggacaagggaccaatggctggaatgccgtcttccacagaaagctcaagagaacaaatcagatggacacccagagacccagtaaatcagagcaagagatcaaggcaggggagctggacagagccgagaagctgaggcggaggccccagatggtggtaaggcaggccactggctcagggtccagatgaaggctgcagacccctctagtgagcaccaacgtcaagcttttgagcagctcgttccagccaagcagaagactgagggtcgccacccctgccacccaggaaaggctcctcaacccccatacctagccctacagggatgcagaagccctgattgtccctcacaggctccgccgcctccatgtcgaactgcaccagctcaaagggggacagcatctggggtggagggtggagtgttgacataggtcctgtgggctcagcctcagggcagctgcacaccaggtacccgcacactcactcggaggaggcagctcatcttgcccagggccccgcagcgccccacatagttgactaagcccatgttgccttctgtggagccgtagacttcccagatccgaataggaccgaagcgctgctggaaggtctcccacacatcagcccgtagtccattgcccattgccaggcggactgtatgtgtccggtcctctggttgctacaggaatgtccccagaagggtgaggaggaggtgctcttggggcatgccttggaacctttacctagagggggtgttatcctgggtccttaccttgggagttacctggaaggtgatgggggacctctacctaagggatctacctgggttacttacatgagagtagttactggagtcttaaatagagggttacctgcaggggcgacctcagagctttgcctgggggacgttaccagaggtgactggaggcctcatctggggtctcacctaagagtagttacctagaactttaatttaatggaaatttaattttaattaattaatttttaatggaaattctcatgataggggtaggggctattatccctgttttccaaatgaggacactgaggctcaaggtagcacagctatcaaagaaaccattattggaagccttgtctgaaactcattatctggggttcttgcatgaggtgtattatctgagggacttgagttcagtacctgaatctttacctgagacctttacctgggatttcatacttgggtgttcaccatggagccctaatcttagagcctcacctggggaatgttacacaagtaccgcaggagctcgcccacatacaggatcactgtcacgccatgctgccgacagtcatcccagaagcaggaagtagagaacttgggggccagaacacaggtggctcctgggagatgacaggagagggggtttcaggtcatgcttccaaattgttgtaagaagctgcttttagcacctgtgctcacccacccccacaccctgaaatacaggacaatactgagttcatctttgtgtccttggcccagccaggactgctctcactagaagagcataggcaggcctgggttcaaatcctgtctccaggatgccgggaaagctccgtgcctgttataaagtgagcaatgctaaataagggctgtaaatattaaattttttatttttatttttgagacggagtctcgctctgttgcccaggctggagtgcagtggtgcaatctccgctcactgcaacctctccctcccgggttcaagcgattctcctgcctcagctttctgagttgctgggattacaagcacccgccaccacagctggctaatttttgtacttttttaagtacagacggggtttcaccatgttggccaggctggtcttgaactcctgacctttcaggtgatccacccgcctcggcctccaaagtgctgtgattacaggcatgagcctctgtgcccagccacatttttaatttttattttggcttgtcactgactcgaagctcaaatcactcttgattacgataaatgaatgcccagctaagcagatgggtgggcaggtggatggatatggtggatggatggaaagatgaatggatggacagttagagtagtgagtgagtagatgggtgggtggacagagtagtgagtgagtagatggatgggtgaacagttagagtagtgagtgagtagatggatgggtggacagttagagtagtgagtgagtagatggatgggtgacagagtagtgagtgagtagatggatgggtgaacagttagagtagtgagtgagaagatggatgggtgaacagttagagtagtgagtgagtggatggatgggtggacagttagagtagtgagtgagtagatggatgggtggacagagtagtgagtgagaagatggatgtgtggacagttagagtagtgagtgagaagatggatgggtgaacagagtagtgagtgagtagatggatgggtgaacagttacagtagtgagtgagaagatggatgggtgaacagttagagtagtgagtgagtggatggatgggtggacagttagagtagtgagtgagtagatggatgggtggacagagtagtgagtgagaagatggatgtgtggacagagtagtgagtgagaagatggatgggtgaacagttagagtagtgagtgagtagatggatgggtggacagttagagtagtgagtgagtagatggatgggtggacagttagagtagtgagtgagtagatggatgggtggacagttagagtagtgagtgagtagatggatggctggacagttagagtagtgagtgagtagatggatgggtggacagttagagtagtgagtgagtagatggatggctggacagtgacatgcagaggcaggggggtagaaagatggataggtggctgggtgaggatcgtcacgcctgtaatcccaggacttagggaggccgaggtgggcggatcacgaggtcaggagatcaagaccatcctggctaacacggtgaaacccgtctctactgaaaatacaaaaaattagctgggcgtggtagcgggcgcctgtagtcccagctactcgggaggctgaggcaggagaatggcgtgaacctgggaggcggagcttgcagtgagccgagatagcgccactgcactccagcctgggcgacagagtgagactctgtcttaaaaaaaaaaaaaaagaaaaagagaaagatggataggtgtaaggatggatagatgggtgggtggatgaatgaatgaatgagtgaggaagtaggtgagtaggtagatgggtgggttggtgaatgtttgtatggttgtattgacgtatggacacatggattaataagatatagggggctgggcgtggtggctcacacctgttatcccaacactttgggaggctgaggggggtggatcacctgaaagatcaggagtttgagaccagcctagccaacatggtgaaaccctatctctaccaaaaaatgcaaaaattagccaggcgtggtggcgcacacctgtagtcccagctactcgggaggctgaggtggaagaatcgcttgaacccaggagggggaggctgtagtgagccgagcttacaccactgcactccagcctgggtgacagagtgagaccctgtctcaaaagaaaaagaaaaaaactgaatctaacaacacctctagttaaagtttccaatttaacaagaaatgcagatgaaaggggaacagagacctacaagcaaatacaatggggagactgtttaattgttaaaaacaaacaaacaaacaaacaaacaaaaaaacagccaattggctgggcacagtagctcacacctgtaatctcagcactttgggaggccaacgtgttcagatcacttgaggccagaagttcaagaccagactggccaacagggcgaaaccctgtctttactaaaaatacaaaaaaattagctgggcatggtggtccacacctgtaatcacaactgctcaggaggatgaggcatgagaatcgtttgaacccaggaggcagaggttgtagtgagccaacatcacacaactgtactccagcctgggtgacaaagcaagactctgtctctaaaaacaaaaccaaaccaaaacagcccattggagaaatctgaacatagactggacatcatatgatattaaggggttacatcatatgatattaaggacatcatatgatattaatgttgttacgtgtaataatcactttggttacagtttcttcagtgcttatatgttagagatatgtactgcaatatttacaagcataaagatgcagtgtctaggatttgctctgatatattctggaaaaaaatagggaagtggctgggcacggtggctcacgcctgtaatcccagcactttgggaggccgaggcaggtggatcacctgaggtcaggagtttgagaccagcctggccaacatggcgaaaccctgtctctactaaaaatacaaaaattagccgcttgtggcggtgcgtgcctgtaatcccagctattcaggaggctgaggcagaaaactgattgaaccctggggggggggggggggcgggcggggcggagcttgcggtgacccaagatggtgccactgcactccagcctgggcgacagagcgagactctgtctcaaaaacaaacaaacaaacaaaaaagaaacagggaagtacatgtgaaattaaactggccctgggcgcggtggctcatgcctgtaatcccagcactttgggaggccgaggcgggcggatcacgaggtcaggagattgagaccatcctggtgaacaccgtgaaaccctgtctctactaaaaatacaaaaaaaatagccaggcgtggtggcggtcacttgtagtcccagctactccggagacttaggcaggagaatggcatgaacccaggaggcggagcttgccgtgagcagagattgcgccactgcactccagcctgggcgacagagcgagactccatctcaaagaaaaaaaaaaaaagaaattaaactggcagcatgttaacaattattgaagctgggtgaagatacctgagatgtcatcaaactattttcacttttttttttttttttttttgagacagagtctcgctttttgcacaggctggaatgcaatggctagatctcggctcactgcaacccctgcgccccgggttcaagcgattctcctgcctcagcctccctggtagctggaaatacaggcgcccaccaccatacccagctaattttgtattttcagtagagacagggtttcaccatgttggccaggctggtctcaaactcctgacttcaggtgttccgccggcctcagcctcccaaagtgctgggattacaggcgtgagccaccatgccccggtaatttttgtattttaggtagagacggattttgccatgttagccaggctgatcttgaactcctgacctcaggtgatccaccagactcatcctcccaaagtgctgggattacaggcgtaaaccactgggcacagcctaaacttttcataattaaaaaaacaatttggccgggcgcagtggctcacgcctgtaatcccagcactttgcgaggctgaggtgggcggatcacctgaggtcgggagtttgagacaagcctgaccaacatggagaaaccccatctctactaaaaacataaaaaaaaattagccggtcgtgagggcacatgcctgtaatcccagctacttgggatgctgaggcaggagaatcgcttgaacccaggaggcagaggttgcagtgagccgacatcgcgccattgcattccatcctgggcaacaatagtgaaaccccgactcaaaaaaaaaaaaaaaaacatttggccgggcacggtagttcacacctgtaatcccagcactttgggaggccgaggcgggcggatcacgaggtcaggagttcgagaccagcctggccaacatggttaaaccctgtctctactaaaaatacaaaagttagccaggcacggtggtgggagcctgtaataacagctactagggaggctgaggcaggagaatcgctcacaagtgctcaccaccatgcctggcttttttttttttttaacagatggactctcactatgttgcccaggctggtgttgaactcctgggctcaagtgatcctcctgccttggtaccccaaagtgcagggattataggcatgaggaaccacacctggccatgataaaagtttgaaaacaaacagacgccaggcgcggtggttcacgcctgtaatcccagcactttgggaggccgaggtaggtggatcacctgaggtcaggagttcgagaccagcctggccaacatggcaaaaccccgtctctactaagaatacaaacattagccaggtgtggaggcgcatgcctgtaatcccagctactcaggaggctcagcctcagcagagaattgcttgaacccgggaggcagaggttgtggtgatctgagatggtgccactgcactccagcctgggtgacagagcgagactgtgtctcaaaaacaaacaaaaaagaaacagagaagtatatgcgaaattaaactggcaacatgttaacaattattgatgctgggcgaagatacatgagatgtcatcaaactattttcactttttttttttttttgcaagggagtttcactctttttgcaacccccgcctcccaggttgaagcgattttcctgcctcagcctcccgagtagctggaaacacaggctcgcatcaccacgcccagctaattttgtattttcagtacagacagggttttaccatgttggccaggctggtctcaaactcctgatttcaggtgatccagtggcctcagcttcccaaagtgctgggattacaggcgtgagccaccatgactggctaatttttgtattttaagtagagacagatttcactatgttgaccaggcttgtcttgaactcctgacctcaggtgatccacccgcctcagcctcccaaagtgctgggattacaggcgtgaaccaccgggcacagctaaacttttcataattaaaaaaaaaagaaaaatttggccgggcgcggtggctcatgcctgtaatcccagcactttgggaggctgaggtgggtggatcatgaggtcaggtgttggagaccagcctggccaacatggtgagaccccacctatactaaaaattcaaaaattagccgggcatagtggtgggcacctgtaataacagctactcgggatgctgaggcagaagaatcgctcacaagtgctcaccactgttgcgggaagtcagggacccctaacagacggaccggctggagccacggcagaggaacataaattgtgaagataacatggacatttatcacttcccaaataatactcttataatttcttacgcctgtcttactttcatctcttaatcctgttatcttcataagctgaggatgtacgtcacctcaggaccctgtgataattgtgttaactgtacaaattgattgtaaaatgtgtgtttgaacaatgtgaaatcagcgcacattgaaaaagaacagaatgagagtgattttagggaacaagggaagacaaccctaaggtctgactgcctgcggggctgggcaaaaagagccatatttttcttcttgcagagagcctataagtggacgtgcaagtaggagagatattgctaaattattttcctagcaaggaatattaacattaagaccctgggaaaggaattcattcctggggggaggtctataaatggccgctctgggaatgtctgtcctatgcagttgagataaggactgagatgcaccctggtctcctgcagtaccctcaggcttactagggtggggaaaaaccccgccctggtaaatttgaggtcagaccagttctctgctcttgaaccctgttttctgttgtttaagatgtttatcaagacaatatgtgcaccactgaacatagacccttatcagttctgcttttgccctttgccttgtgatctttgttggaccctgatcagtagttccgttttttgccctttgaagcatgtgatctttgtacctattctcggttcttacacccccttcccttctgaaatccttaataaaacttgctggctttgagctcaggtgggcatcatggtcctaccgatatgtgatgtcacccccggaggcccagctgtcaaattcctctctttgtactctttctctttatttctcagctggccagcacttacggaaaatagaaagaacctacatcgaggccgggcacagtggctcacacctgtaatcccagcactttgggaggccgaggtgggaggatcatgaggtcaggagattgagaccatcctggctaaatgtgaaaccccatctctactaaaaatacaaaaaattagccgggcgcggtggcaggcgcctgtagtcccagctactggggaggctgaggcaggagaatggcatgaacccaggaggcagagcttgcagtgagctgagatcgcaccactgcactccagcctgggcgacagagcgagactccatctcaaaaaaaaaaaaaaaaagaacctacattgaaatattaggggcaggttcccccgataccaccatgcgtggctttttaaaatttttttttaacagatggcctcttactatgttgcccacgctggtgttgaactcctggactcaagtgatcctcctgccttggcacccaaagtgcagggattataggcatgagcaaccacacatggccatgataatagctggaaaacacaaaaaggccgggcgtggtgggtcacacctgtaatcccagcgctttgggaggcaaatgcccgcaaatgtgggcagatcacaaggtcaggagtttgagaccagcctgaccaacatggtgaaacctagtctctagtaaaaatacaaaaattagctgggcgtggtggtgcgtgcctgtaatcccagctactcaggaggctgaggcaggaaaatcgcttgaacctggaaggcggagcttgcagtgagccgagatcatgccaccgcactccagcctgggcgacagagcgagactctgtctcaaaaaaaaaaagagagagagagagaaaatagccaggtgcggtggctcacacctgtaatctcagcactttgggaggccaaggcaggtggatcacgaggtcaggagttcaagaccagcctggccaagatggtgaaatcccgtctctactaaaactacaaaaattagccgggcgtggtggtgggcgcctgtaatcccagttactcaggaggatgaggcaggagaattgcttgaacccaggaggcagaggttgcagtgagccaagatcatgcctctgcactccagcctgggtgacaaagcaagactctgtctcgaaaaaaaataaataaataaaaattaaaataaaaaaaaaagagagaaaacaaaaagaacaagctatggagaggtccccatctagactctgaatcaagagtccagagagacagccctgtggagtgcttgagagcactcctactccagctgcccttggggccatgtcacaaatctgggccagcatccccatcatctcctgagcaccacaccttccttggatgcctgtgaccatcactcgtatcaggtcttgtcacctcctgaccaaagcatggccatcagggactgtgtgggtgtccaagcttctgtccatgcggccctggtagtcattggtgggtgtcccttctcaaaagtgagaacacagggtgctgggtaacctatggtgtctttttgccttgacagccccacgccgacacttactcccgtggtcctgtagactggagggatcctcagaagtgggcttaccgagatctaagcagccgaggatcccaacgacaagtcccatcacgtggtacagaggcaggaccgtgtaaaccacatcatcagctgtggccccagataaggacagcatcttgctcatctgcagtacccgctcatgcgtgaggatggctggcttcgggaggccttgggatgaaggcatggcaagggcagggtggtgacatgacagcacagagaggggcctgaccagagggatagatctccaacagccaggcctacattggggtttgaggctctcagagaacagtcaagtatagggatttgtggttgggttcacaggctgaatttggactgaaagtaatatgtcaagatcaaaggtttcagtggctgtttactggacacaggaagaattctggcattgacctctcaaattacattgggggtcagagttcaggccaaatatcaaaatcaagtctgggagcagtggctcacgcctgtaatcccagcattttgagaggctgagttgggcaggtcccctgaggtcaggggttagagaccagcctggctaacttggggaaaccctgtctctaccaaaaatacaaaaattagctgggcatagtggtgtgtgcctgtaatcccagctactcaggaggctgaggcaagagaattgcttgaacccaggaggtggaggttgcagtgagccgagattgcaccactgcagtccagcctaggcgacagagcgagactctgcctcgaaaaaaaaaacagccaaacaaaaaacaaatgtcaaaatcagagggtaaagtggtttcagaggtcaacactgagtcacaagtcaagtgtggggtcaggtcagcctgagagttcagaggctggtgctagggctaatgggcaccctcaccagtggtccccgaggtatagatgaagagggcagggcttctccatgtgatcccagcacgcaggtcagcaggcactgggtgggagggcgctgcatccagggcagcccccagagcccccacccctggtgtaggggaggtatggctgaggtagaagcagcggatgttctcagcctgcagcttgggaaggatctcctccaggctctcccggaggtctgcagagatgggtcagaggagaaacagaggcaaggctcacctttgaggttgcgaggcgggatctgagacccacagatgcaggcagaggagcagctagtagagaaaagcatccatgttgtttggtaaagaatcccatcattagtatttttggtcaaattgtgggaaaattaaactctgatgacctgagaactactttctgctcataagtcttgattataattgcctgtgaaagtaggcaggtggggaccaagggcctctgccagtcccagcagaacccctgtcctatagtccctgcccttgcccccttccattctccactggctccaaggccctcacctgggtccaccaccagcacccgggccccagagctcagcacagagtgcgccaggggcatcccccggccatgcgggttgatccaggctgttgggcagcccagcttggccagccccagccacatacacagggctggaacggcctgggaagccagcacaaggagggcagtaggctccccggcacacaggctcgcagggtcacccagctcagccttcagggcccatgccgcctggcaggcccgggcatccagctcaccaaaggtgactgagccggccccaggccccgtccacaccaagagtgccctgccaggctgcgctcgtgctcgccgctcgaaggcatctacaaaggtgtcaggcggctgccggctcaagcatcccctgatcttcaggcccaggtggaggatcttggccaagaagatcacatcagccggcagccagcgtagtcctgggggcagccgtgctggcaggagggttagtgccagggccgcagctgccaggctcagcccatggggcacccaggggccgagccagggccgtgctaacatggccagcccaagtagcacgcaacatgtgggatcccccaggagccagcgcagggtcaaggccacagcgactggccacactggctgccccaggccccagagcaggagcagcagcagcagcagcaaggccaactgttgcctgacacccatggtaccagctcctccctaggagcagcagctgtggagtgttcaggctcacctctggcccctcaagagtagcccaatggctcctccccaggggtggtggccctggcactgctgacagtggctggtcctctccccaggactttgcccccagcccttctcctctacgtttgtttgctctgcctggtcttgtgtgtgggtccagcccctctctgcctggcgctaaccctttccatcactggcctctgggttcccaggtctctgccccttgggcaccactagcctccttcctgctgtcctgcttgccccatccaccctccagggctggcatctaactcccttgcctcccctcccatccctgctgggtaccagacactcagagcacagaaatccctgcccttgggaacactccaatcaggccaaacagaaaagcaacaggacagcaaggtggacctcattgggaggtcctcctgtgacacccactgaaaccctgaggagaggggctcagccaggctaagccccttgtcccatgatccgaggaatcgtaccctcctgccaggcatacagcaagtgctcagtaaatacaggaacactggcatcgcctggattcaaacccagctctgccccccacccatgtgcttgctctgactctctgctccacctctggctttgacgacgatggagtcctggggttcaggagactgaagtcagcccatgatgcacacagttggatcatgaaagccctggcctctcaccttgaggaagcagtctcagaaggtgaacccagaggagctgccattggcctaggagcctggcaggtcaggctggggtatggcctggggccataccccactccaccagctccaaatccttatggcagggcacctaggctaggagccactattgtgctgaagaggagaggggcaaagagtggctgctctctccgctggatgcaggggcctgggacactggctggccagtaggggtggtgtccccaaccgcccagcagtcagccccaggatcccacccctcactgtttcctgcccccaacacggccatcggagccctccctgaactttgcccccagcaccaagggcagatatatgggggcttatataccctcagtgcaacctggccccaaagatccccctgggctccccacaagtaaggtgctcagccatgtccatcaaggtcggggaggggaagtcttaagtccaaaagacccttagagcctgactggaagatctatgggaggggccttaaaggtcgtggacagcagcaaccaggagtatgatggggctttcacgtggcctccctctcggagacccacctcagatgtggcctgcctatcctactccccacaggactgagggatccaagagaaccaagtgctggttatatatgcagcccaccttagcccctacagaatagaggtcctagatggcaaagtggaccatcctgttcctgcccaggacagcctgtgggccgcatggatgccacccaagaacagggacgctgaaccctgacactcacatcttgtctatgagggcaaggcacgcactgatccaggtgctcacagcttcgtggtttaggccccatggcctacagtcctttattagagcgagagtcccgaggcccagcccccatatatgatgggtccacttgagtctccttaggcgccccatgagggagtaacagcttgggtagagagctagggaccttgcccagcctgaccctggggcaggcaagcggccccccagcccccaccaccaccccaggagagggcggggtgagaaccggagtcaaatcttgggccgggtccaagcgcctgagcgcccggtttacgcaggaaatagtccagttctcagaagtggtctaaccagccccagccccagcccggcaccacctggagggttcaagtacatggaggagaggagtaaggcggacttaggccctggtatggagaaagggtgaagggagagagaggacctgcgctcaggagggagcgtggtctagtggcgggaaccacgggtcccgcagcgggcgtggccgactgtgcgggaggccccggatccaccgtgggcgaggccaggccccagcgccatcagggcgcagggtgcgccgccaggtggcgctccagcagcgcgcggtgcgagaagaccttgccgcaggcggggcagggcgcgcgctcgggccggtgagtgcgcatgtgcacgttgagcgagctcttctgcgtgaagcgcttggcgcagacggcgcactggaaggcgcgcacgccggtgtgcgtgaccatgtgtttgagcaggtagtcgcgtagagagaaggatcgccagcacacggcgcactggtgcggcttctcccctgcggaagacagggcgggccgcgaacgcaagtcagactctacagctccccgcccccaccccaccccacccccacctgggctcctggacctagcaggggctcccctcccctcccgaaccaccaccccgggatcccttgcctatcagagaaccctcccctcactatgggatcttcctgcccagcagggacaccccctcctctccaggacctcccttcacgttgggactttcctgcccaacagggatcctcatacactgtgaggtacccctctcccatcccttcctggcagggaccccctttctgttatcctgggatatcactgtgacagggcacccctaaatccagcaagcaccctgtctgcaaggaacccagcctgtctggaacatctgttggccatctggactgcccactgggatctccctctaccctcaggtaccctccccctcaacccctacccacccggcacagggagacactgggtcctggcccccctcgcctatgcccatagagtcccctaaactcagtctgacaaggccagtgccctttcataaggagggacctgggcacatctgccaccttcctgcaggaagccccagttgcccagaacccctgcccgctggccactataatgtccttggtgtgatagagagagctcctcattctgggttaggggaggggaggc

SEQ ID NO: 816 - DNA, 221167 bp, Homo sapiens
gacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctctctttggaactgctagggatccttgcaacatggcatctggcttcccacagaacaagtgatccaggagagggcaaggtagaaactgtaacaccttccatgacctggattcagaattcacactcttgtcacttccacggtgtcttactggttacaaagtcaaccttgttgagtgttggaggggaccacaccagggctggaggtcattggcagaggtggtgggggagcatcttggagactgtccatcacaggagacaaggaccagaatggagagcttcaaggtccagtgttttatctggttatctgtgtctgctgtaacaattcactacaaattttgtggcttaaaacatttgttcttaggttctggaggtcagaagtctgaaatcggttttctggtctggaatcaaggtatgagcagagctaccctccctaccaaggttctagggtagaatgtttcctcgtcttttccagctgtgagaggtacagaccttctattccttgcctcatggccctttgcctgtcttcaaagcctgcattgtagcatgttgcttcagtgatcatattgccttatgtcttctatagtcatagctccctttgtctacctcttataaagacacttgtgattgcatttagggcccacctggataatccaggataatttttctgtttgaaaatcctaatcacatctgcacagttccttttaccatatatagtaatattcacaggttctaggaactaggacctggatatccttggaggccattatatatctcagtctaccatagccaggctgagaggagccatccagtattcagtgatgagaaggagccattcacgtgttttaagcaggactggcatagggttgaaaaaatccacttatgcattaggggctggtgggaagggagatactggcagctcaactaaggcagtgggaaaaagagaggagtggttaggcccagtgaccaggtgttggctgatgctggggtgaaaagaatatgtaaaggagaaacatcagagcacagccccaccccttcaggctccagaagtgcaagacaagagggaaggctgcagggatctgatgtagggcagaaagaacatcatgagacaacaaggagtgggcttctgctagaattccaagaaggaagccaagaggaggcatgaaggacttgtatgatgccactgagaattctcatggcttggacagaccagtactcagtggacgtggtgtctaggctgtcaccagtgactcttgcagaatgggtgatgatgggaggtgggggcaggaggcacgggaagcacaaatcaaaattggtgggcattctgagtggaggaaagcgaagacacagagacaggagcagagacctcagttcccaaccaaaggcatctttctgtatgtttcctattagagccacctgctacctgtactaaaatttctttcttattttttaatctactcatgtttttcttaaaaggaaatgtccttttaaaattgaagtatttggggcctggtgcagtggctcatgcctgtaatcccagcactttgagaggccacagcagatggatcacttcaggttaggagttcaagaccagcctggccaacgtggtgcaaccccatctctactaaaagtacaaaaattagctgggtttggtggcacatgcctgtaatcccagttatttgggaagctgaggtgggagaatcacatgaaccagggagatggaggtcgcagtgaaccgagattgcaccactgcactgcagcctggtcaacagagtgaggccctgtctcaaaataaaaaataaaaaaattgaagtatttagtatatgtggttttgttttgttttttaacctagcagcaacactggtggtgtatagttttgatttttcatttccctgatgactaatgatgttgaacatcttttcatgtacttatttgccatttgtgtatcttcttttatatattcttcaaagaaataactatacagattctttgcctattttaactgggttgtctttttattactgagttgtatgtgttcattacatattctagatacaagtctcttatcagatatgtgattcccaattattatctcccattctgtgagttgtcttttcactttcttgctaatgtcctttgaactacaaaagtttttgttttgatgaagtccaattgattacatttagttgcttatccttttggtttcatatctaagaatcccttgccaaatccaaggttacaaagatttatctctctgttttcctctaagagttttatagttttagctcttacttttaatttaatttaatttttttttttttgagatggagtctcactgtgtcgcccaggctggagtgcaatggcatgatctcggctcactgcaacctctgcctcctgggttcaagcaattctcctgcctcagcctcccaagtagctgggactacaggagcacgctgccacgcccggctaatttttgatattttagtagagatggtgtttcaccatgttgcccaggctagtcacgaactcctgagctcaggcaatccactcgtctcagcctcccaaagtgctgggattacaggcgtgagccactgcgcccagcctcttacatttatggctttgtttctattttattttatttcttttttttctcttcttttttttttctttgagacaggatgtcactctggttgcttaggctggagtgcggtggcatgatcttggcttgctgcaacctccactttccagactcaagcactcctcctacatcagcctcccaagtagctgggactacaggcagcctggctaatttttttcaaattttttttgtagaggcagggttttaccatgttgcccaggccagtcttgatctcctggactcgagtgatctgcctgcctcagcctcacaaagtgctgggattacaagcatgagccactctgcccagccagcctaatttgttttgagttaatttttatatatgatataagatagaagtctgtgttagtttgaatgtgtctcccaaatttcatgtgttgatagtatttgaaggtggcgacttttgggagaaatttaggattagataaggttatcaggattggactcccttgatgggactagtggctttagaaggagagagagacctgagctggcacactcttgccctctcgccatgtgatgccctccaccatcttatgtcataacaagaaggccctcaccagatgccagtaccatgatattagacttcccagccttcagaactgtaagaaataaactcttttttttttttttttttgagtcggagtctcactctgttgcccaggctggagtgcagtggcgcaatcttgactcactgcaagctctgcctcccgggttcacaccattctcctgcctcagcctcccatgtagctggaactacagacgcccaccaccacgctcggctaattttttgtatttttagtagagacagggtttcatcgtgttagccaggatggtctcgatctcctgacctcgtgatctgcccgcctcggcctcccaaagtgctgggattacaggcatgagccaccgctcccagcccacaaataaactgtcttcatcaaagttattgaaagagagagagagaaaaaaagcaactttctttataaattacttcgtccttaggaggacaaggcgagaggatcacttgaggtcaggagttcgacaccagcctggccaacatggagaaaccctgtctctactaaaaaatacaaaaattagctgggtgtggtggcgtgcacctgtagtcctagctactcaggaggctgagccaggagaatcaactgaatccgggaggcagaggttgcagtgagccaagattgtgccactgcactccagcctgattgacagagtgagactcccatctcgagaaaaaaaaaataataaattattcagtctgtgatattctgttacagcaacagaaaatatgctgggacagggactatctttactcttttccatgtggctatccagatgtcctgtaggaagtgtttgtaaaccacttaatcattatacagcccccaaggggtgatgctttgttgacatggaaactgggaagcaaagatgcttcttggggacgaagtgactgagccaagactctgatccagaaatatctggctttcaagcatggctgcagaagggctttgtttatgggacacattttaggtaatgttgcatcaacttataaaaatcagaatttttcacgtaaaggccaggcgcggcggctcccgcctgtaatcccagcactttgggaggccgaggcgggtggatcacttgaggctaggggttcgagaccaacctggccaacatggtaaaaccccatctctactaaaaatacaaaaattagccgggcgtggtggtgcgctcctgtagtcccagctactacggaggctggggcaggagaatcacttgaacctgggaggcagaggttgcagtaagtggaggtggcaccactgcactccagcctgggtgacagagcaagactctacctcaaaaagaaaaataatttttcacataaaaatctgacctaattttcagcttctcttcagagatgagcagttctgacaaagggacctgtattttcccgtaatcagtgagttctgagtccctgctgctccttcagacagggtccatgctccccatcacctccagtcccaccactcataggtaagtgtccttgtgggctcttaaactggcccacttctgtcatgtgagcctgccttgccctgaaagcaggcgaatttctgaccccagccctgtgtgcttctcttttcaggaaggatggtgaacctgtttttttgttttttttttttgagatggagtctcactctgtcgcctcagctggagtgcagtggtgtcttggctcactgcaacctccacctcctgggctcaagcgattctgctgcctcagcttcccaagtagctgggattacaggcatgtggcccagccaatttcactttgtatctaagtattagtgagtgtattagttagctgctgtgtaacactgtcctaaaacagtatctgttttacttaaaacagtaactgtttctttagctcacaaacctgcaaataagtggtttaggccagtctctgctggtaccctcgtctgtcttgttagatgtaggtcagctctgcctggcgttgttgatcttggtgagtcctctcacatgtcctcactgtacaacccacacctatgtgtagtggcctaataggtgcccagtgagacctgactcccatcattcataacgtgcagtctctcgtgacacaggcctgcctgttttctccttttccattcttcctctgccagaaagcactgatggagatagtccagctgattgagaatgtgtgtgatgtttcaggaaccagtgaccttccgggatgtggctgtggactttacccaggaggaatgggggcagctggaccctacccagaggatcctctaccgtgacgtgatgctggagacctttggtcacctgctctccataggtaagccctgcttcgcaaggtgtgatagctgattctctctgggttataagtcatggggcctctggtgtgaggacctgaccttgggtcctcactccctatggggagtgcatgaagagggaggtctgcccttttccatcaccatgcagagcttcaccatgttgtgaggtgcccacgtgtcctcacagtcgggagtctggtctggagcctgggcttgttgtttctctcctgagcagcccctcacctcctgtgtttttccccatttccaggtcctgagcttccgaagcctgaagtcatctcccagctggagcaagggaccgagctatgggtggctgagagaggaaccacccagggctgccatccaggtgagaacccactatgtgggagcagctaatgggagcagcctagcaggtcactggagatgcacttcatggaaagggtggtggttggtggtcctgaagaccaccccattcactaggagtatacaggactcagcatagagtcatgctgacagctctcagtataatgagaccaacaaaggggaaaggcgcgtggggataagttcagaggaagccaggcatgagcctccagagtcccctcactgtggagtcattcaggatgtgccaggctcccccagcactcaggtgtgacacctcatgagacatgagctctaccagggaatcttgttaagagactcagtgctaggagttttgactgaggctgccacatagacactctctgcctagcacagaccaaggttccagactaccaggagaaagccagtgtttggaataaaccacatagtgtgtgcagtgtgggtgtagtaaaccactctcatcagttagggttgtgggaaccatccccaaatccaaattctcagttgcagccaaaggctaaccttgtgaataggcttctcctaagaatgctggtttcaggcctgccctgttaaatcttttctgcacagtgctccatagccttctcacctgtgctccccatcttctaagctcagaggtcatcacctgtgctccagtgctgagaatcccaccccttcctccctctctgcttcatcttcccttataggttccaggtcattccctctctcaccatccttctcagcatgtcctttctgtggcatcatttctaatatgtgaacctgcccttcatcttctccatttcattcttgcatgtccagattctttgtgttttgttttgtttttaagacagggtctcactctatcgcctaggctggagtgcagtggcgtaatcacggttcactgcagccttgacctccctagttcaaatgatcctcccacctcaccctcccgagtagctgggattacagacatgcaccaccacgccctggtaatttttgtatttttagtagagatgggattttgccatcttgccaggctgggctcgaactcctgggctcaagcaatccacctactttggcctcccaaagtgctgggactacaggcgtgagccaccatgcccagcttttttttttttttttttgagaccgtctctgttgcataagctggagtggcagcagtgtgatcatggctcagtgcagcctcagccttcctgtcacaaatgatcctcctgcttcagcctcttgagtagctgggactacaggtgtgtacccccacacctggctaattttctttttaaatttttttgtagagacacagttgcactgtgttgcccaggctggtctcaaactcctgggctcaagcaatcctcctgtcttggcctctcaaagtgctgggattacaggtatcagccactgcacctggcctttttttttttttttttttttttgagacagtctcactccgttgcacaggctggagtacagttgcattatcttagtctcctaggctcaagtgttccacctacctcagtctccctagtagctgttactacaggtgtgtaccaccatgtccagctgatttttttgatttttttctttttcttttttaaaaattattttactttttttctttttttttctttctttcttccttttttttttttttttagagatggggtctcgccatcttgtccaggctgcaggctgctcaaactaactcctgggctcaagcaatcctgcctcaacctcctaagtgctgggattataggcgtaagccactatgcctgactttttgtttgtttgtgtgtccttttttttttttttttaatagagatgagatctttctacactgcccaggctggtctcaaactcctgagctcaaacagtcctcctgcctcagccactgaaagtgctgggattacaggtgtgagccactgtacctggtcacatgtctagattctgtaaacttgttccccacacccttctttattctcttatgaggaagaattgtgtttagctataaataccctaaaaccaggttggagcagctcaaaataaagaagcatttttcttgtaaaacaggagccctgagtctgctggtactgtcttggcatctcagaggtgccagggctgattgttctgtgattttcccaggctgtccttgggattacagtgcagctgcagcagctccagccatcacagttgtgctccatgcaggaaggaggggaagaggtaggaagaattctgccagccacatctgtccccttttggcagaactctagatgtcacctgctggggtctctttagccagaactaggtcacctcctcttgcactgaccctagttgctagagaggctggaaagctaggggtgtctagattgtcataattggcttgggcgagtcatggtccccttgctgtggcttgtgtgttggtaccctgaccacattctagagtaaatagcatctggccatgggatgtacaaccagcaatgcctgcagattagcctcccacccaaatacttctgatgccacccagggctttctgattctgcagaaaaacacatatgcccccatgatagcgtatgacctatcaactgggagtcgggtgaatctgctgcagaccctgttttcctgcccctttcatcggttgtcactgctgttacttcagacatgtatgtcggaagcaaattctcatcaccctggacatatgcctgtcactcacaagtcttatgccataaccaaatccaggatctaaaacgtgtgcccataaatactaagcaaaatgttgtgcttgcatggattaggagtatggggtcaaaatcatgatggacagtttcaataacttaatacctagacagttataaatactccagaagcagaaggttttcaaggctttatgttaagacagaaacatattttccatgtaatgctttgtattagtttcctgttgctcctgtaacaaagtaccacaatctaggtggcttgaaaaagcaccgatttggctggacgcagtggctcacccctatcattccagcactttgggaggccagggcagacggatcacttgagtccaggagttcgagactagcctggccaacatggcacaacaccgtttctactaaaaatacaaaaattatccaggtgtggtggtgcatgcctgtaatcccagctactcaggaggctgaggcacaagaatctcttaaacccaggaggtggaggttgcagtgagctgagatcatgccactgcactccagcctgggcgacagagcaaaactctgtctcaaagaaaaaaaaaaaaaaaaaggacagatttattttcttatagttgtggaggtcagaagttcaaaatggttcatcagggctagttcctctgacggcgcccagagagaatgcatttctgtctttctcagcagctggaggctgcccagactccttggttcatagacccttcctccatcttcagagtgcttcactctgacccatttccattatcacaaccgcttccctgactcagacccttctgcttccctcctatatggactctttggtcagatttagggccccaggataatctcccatttcaagattctttttttttttttgagacagagtctcgctctgtcacaaggctggagtgcagtggtgtgatctcggctcactgcagcctccgccttcccaggttcaagcgatcctcctgcctccacctcccaagtagctgagactacaggccgtgccaccatgcccagctaattttttgtatttttagtagagatgggatttcaccatgttggccaggatggtctcaatctcttgaccttgtgatccgcccgcctcagcctcccaaagtgctgggattaaaggcgtgagccaccgcgcctggcccatttcaagattctttttttttttttttttttttttgagacggagtctcgctctcttccccagactggactgcagtggcgcaatctcggctcattgcaagctccgcctcccgggttcacgccattctgccttagcctcccgagtagctgggactacaggtgcccgccactgcacccggctaattttttttttgtatttttagtagagacggggtttcaccgtgttggccaggatggtctctatctcctgacctcgtgatccgcccgccttggcctcccaaagtgctgggattacagacgtgagccaccgcgcccggccatcaagattcttaatcacagctacaatatcccttttgccacataaggttccagggattgggatggggacatctttgaggggccgttattcagcataccacatgattaaaatagagagtaaattttttttttattatttttaaggaaaagaagcctagtcaatagaagaagaccgcgtctctacaaaaaaatttaaaaattacctggcatggtggtgtgttcttgtagtcctagctacttaggaggctgagcggggaggattgcttaagcccaggagttcaaggctacagtgagctacaatttgcaccactgcactccaggctgagcaacagagcattaaaaaataaaggaaaagaggccaggcatggtggcttacgcctgtaatcccagaattttgggaggccgaggcgggtggttcgcttgagtccaagagttcaagaccagcctgggcaacctggcaaaaccacatctctacaaaaaatgcaaaaaaattagctgggtgtggtggtgcatgcctgtggtctcagctgttcaggaggctgagcccaggaggttgcagtgagctgagatcatgccactgcacttcagtctgggtgacagagtaagaccttatttcaaatataaaataaaataatggtgaagaatccctgtccaggcagatcccactcccagtgcactcacaggggtttgtgggctcagggatggctgggcgatctcaagcccctccttggcccctgtcactcgtctggcatcattccttactggttccctcttgcggttgctcagcttcacctgctgcaggtcacctcctggctgactacagtcccagctcttctcccatttcctctcttcatcaactgctcaccctctctctcggagactccatggcttcccatgtgccaggatcagtgagttgttctgggcagccaggagtcaggctggagttggagcctgtctcaacctcagtgctctttgctgttcctggccaggccagttcactagtgttctcaagtccccctcctccggatgttcttccgcactctcccagcaggcagcgttagtcttggctggggtcacagtgttgtctttagtctctgtgttttcgtccgtgttgtctctcaggcagtctcccagctcacgagcctgttccatggatgttcctgaggacctgccatgtgctgctgtttgtgctgtggatgcagcaaagaatgacaggaaaggctgagccctcactcagcatctgggagatggaagtcttgagagatggatgccagtgccaggcagtgatgaggccgtaaaggaaatgcacctggggagggcaagatggggtgctcatgccccgggactggcagggaggcctctctgagaaagtgactcaaactggggcacagggagcaaggtgggcagatgtctggggatgagggttcttggcagagggagcagcaggtgcaaagggccccaggaaggagtatgggggatgcattagagggatgtgaggagccatgtggagcagagtgggcgtggggcaagagtcaggaggtgagacgagccagggcatggtggagaagggcacagggtcgtgtccatcctcagaagtgactgcagagtgaatggaggagtgaccagggctggcttgcagtggggaggagggtgggtctgtttggttttgcataatagctttatcaagataaaattgacataccataagttcacctattaaaatgtaccactcagcggttttgagtatattctcagattgtgtgcagctatctttactatctaactccagaacatttcatcaccatcttagtcagcttggggtaccgtgacaaaataccaccgcctgggtgtcttgtacaacagacatttatttctcacggttctgtaggctggaattctaagagcacagtgccagctgattcgggccctggtaagggccccttcctcaattgcagaaggccgccttctctctgtgcccttatatggcagagagaggaagcaagccctgtggtatttcttcttataagatcactaatctcattcttaaaggccccaccctcgtgacctaatcacctcccaaaggcctcatctccaaataccctcacaatggggattagggtttcaacataggaattttgctatcgacattcagtccatagcagtcactctccgtctttcccatcccctgccaaccagtaacctactttctctctctatggatttgcctgttctagatattccatacgaatggaatcttacaatttgtgacctttgtatctggcttctttcactcagcagaatgttttccggcttatccatgttgtagcgtatgtcagtactttgttcttttttgtggctgcataatatcccgtcgtatggatagaccatattttgtttatgcatttgttgaggggcatttgggttgtttctacttttggctattaattaatagtgccactatgaacattagtgtataaatttttgtgtgaagtgacttatattttagaataaacctctgggtgctatgtagagagtcagtttttttttttttttgagacagagtctctgcttggtcgccgaggcgggagtgcagtggtgtgattttggctcactgcaaccttcgcctcccaggttcaagcgattctcatgccttaggctcctgagtggctgggactacaggtgtataacaccacacccgaataatttttgtatttttagtagagacagggttggccaggctggtcttgaactcctgacctcaagtgatcctccagcctcggcttcccaaagtgctaggattacaggcatgagccaccgggcctagccagagagtcatatttgggggccagaggtgacagagcaggaagcctggcacctggccagcctcagctcctccattatctctcccgttgtcaagctctcattcattcattccctcgatacgttccttcagcattcactgagagatatttttgagcttctactacttgtcatttctaggcactggctgtgaacattctagtgcggtgaggtgtacccagaatgaatgaacacatgacctgtattttggtcaggacaagagcagatgagggggcttgaagagggcttggggaaagcgggaagcctggcttataacagagtccctgtcctaatccccagaactggttatcttggatactgggtgagcaagagggtcagaatcagacaaggagatgtgacagcagaagcagaggtgagtgagagagatctgaagatgctgtgctcagctctagaggtgaaggaaagggccaggaatgcaggcagcctctaggaacgggaagatgcaaggattttccccagaacctcccgaagagaaaccagccctgccaacaccttgattttaggacttctgtgttccagaactataagataataagtgtgttttaagttacagcagcaaacagggaactcatataccttgacttcattgccagtgcatggcccacagcaggtgctcaataaatgtttgttgaatgagtggagccgtgtctgagggcacttgatgttaaaataagaggagaatcaggggacttgccagggcagctggttaggaccccatttcaatatcaggcctatggtgttggaggcctgtcccccttccgtttttttctcccaacagctcagagatctttgggttttctttcagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgtagagtaacgtgtactgacttggtgcagtatttctccttgtcactgtgggcccaattttgccaggagacctagggcaatagcctgttgcttgtggactggtagagggtatgatgttgaccatggcaatactgtgaggggccttcccatgtggaacgtgaccttccaaagtagtgactaactcttggaaaagtttttaacaacataatatgctattgcatttctgggaaattctgggtaaattccaagcatgcagcaattagtttgtgcttatgtgtgaagtccagttaggttctcagttcataccctgaaaactgcttattccacatctgttgatgtggtccactgggggcagttctgttcctcaccatcttggcagcatgcatggctcctgcccacatttcaaccacacccccaacccaattacgtgaccagcccccacgaaatttcacagcattccgtgcaggggagtgtcacagctcctcttgaaaaacatctggtgttgctatgagccagaagttcttttttttgttttttgtctgagatggagtctcgctccgtcacccaggctggagtgcaatggcgcagtctgctcaccacaacctccgcctcccaggttaaagcaattctcctgccttagtcccccgagtagctgggattacacgcacctgccaccacgcccagctaatttttgtatttttggtagaaatggggtgttggccaggctgatctcaaactcctgacctcgtgatccacccacctcggcctcccaaagtgctgggtttacaggcatgagccactatgcccagctgagccagaggttcttaactggtggtgcttttgcctccagggcacatttggtgacatctagggacatttttggttgctgtgcctggaggaagggtgccgccgtcatgtagtgggtagaggccagggacgctgctcaacatcctttagtgcccgggacagctcctcaacaaaggattctctagctcaaatgtcaatagtgccaaggtggagaagccacctgggtataaacccagcccagaaatgtagctgacatttttaaaacttgcagccagctgtggtggctcacgcttgtgatcccagcactgtgggaggctgaggagggcggatcctttgaggtcaggagtttgagactagcctgggcccatggcgaaaccccatctctactaaaaatacacaaattagccaagtgtggtgacatgcgcctgtaattctagctacctgggggaggctgaggcacgagaatcgcttgaacctgggaggcagaggtttcagtgaaccgagattgcaccactgcactccagcctgggtgacagagcaagactctgtctcagaaaaaaaaaagaaaagaaaaaaaaccttcaaattgattaatcagggctggactagactagaaatcatataagcttgattttaacagatggcatcattagctagtttatacatgatgtactttttagtacatcctttacggttttgcagcattcataattgatgtgaaataaggaagataatcctttttttttttttgagacagagtctcactcttttgcccaggctggagtcagtgttgtaatcactgctcacttggcagcctcgacctcctgggctcaagtgatcctcccaccccagcctcccaagtagctgggaccacaggcatgtgccaccattcctgattttttttattttttgcagagacagggtctcactgtgttgcctaggctggtctcgaaccttggcgtcccaaagtgttgagattataggcatgagccactgtgcccagccacttatttttctgagtaacctttaaggatgtattgtggacattttcaaacatgagtcatatatttttgctggtactcccatctacctccccaccattctccttccctggatatatatataaccatgtttgtccactgggacaaaaccattttcacaatcatactaagctgtcatttcacatttttgctgtgcactgatagtgtgaaagcaatggcaggtaaaactgctgagcctgagttcaaagcagggcagtagccctgaggttggttgttcatattcttctccactgggaaatgcagtaaagaaaaagaaaagctaatttcacttaatttcttttcttttcttttttttttttttcttttgagacggagtctcgctctgtcgcccaggctggagtgcaatggcgtgatctcggctcactgcaacctccacctccacggttcacgccattctcctgcctcagcctcccgagtagctgggactacaggtgtgcgccatcttgcccagctacttttttgtatttttagtagagatggggtttcaccatgttagacaggatggtgtcgatcttctgacctcataatccgcccacctcggcctcccaaagtgctgggattacaggcatgagccactgcgcctggccctctttttctttttgagatggagtattgctctgtcgcccaggctggagtgcagtggcacaatcttggctcactgcaacctccgcctcccgggttcaagcagttctcatgcttcagccctctaagtagctgggatgacaggtgtgcgctaccacacccggctaatttttgtatttttagtagagatggggttttaccatgttggccaggctggtctcaaactcatgacctcaagtaatctgcccgcctcagtctcccaaaatgctggcattacaggcatgagccaccgtgcctggcctactttcactgaatttctgtgatgaaacgggaaaaattaattttgttaaatctcaagtagaactatattgtcattatcacatctaaacagatatcatcaaatacctagtgttcagatgttctgggttgcctcataaattttgttttctatttgtttcatagtaatcataatctaaacaagatccacacagtgcatttggttggaatttttcttttttctttttcttttttttttttgtgatggagacttgctctgtcacgtggttcactgcaacctcccaggttcaagcaattctcctgcctcagccgcccctgtagctgggactgcaggcatgcaccaccacactcagcagatttcttaattgtttgtagagatggggttttactacattgcctaggccagtttcaaactgggctcaagcgatcctcccaccttggccatccaaagtgctaggattacaggtgtgagccaatgcaccctgccaaacagcaattttttttttttttgagacagagtctcgctgtgtcacccaggctggagtgcagtggtgcgatctcggctcactgcaagctccgcctcccaggttcatgccattctcctgcctcagcctcccgagtagctgggactacaggcgcccgccaccacgcccggcaaattttttgcgtttttagtagagacggggtttcaccctgttagccaggatggtctcaatctcctgacctcgtgatccacctgcctcggcctcccaaagtgctggggttacaggagtgagccaccgcgcctggccccaaaacagcaatttgaataaccatgttggaatggttgagcattggaacgcattagcatcagaacttcccgtgtcaggccaggcgcggtggctcacgcctgtaatcccagcactttcggaggccgagatgggcagatcacgaggtcaggagatcgagaccagcctggctaacacggtgaaaccctgtctctactaaaaatacaaaaaattagcctggcgtggtggcgggcgcctgtagtcccagctactcgggaggctgaggcgggagaatggcgtgaacctgggaggcagagcttgcagtgagctgagatagtgcctctgcactccagcctgggtgacagagctagactccatctcgaaaaaaataaaagaacttcccgtgtccgtttttgctttttggatgctgggagtgtcacaactcagctatccaatcaaggcagagctggcctccaggatgccagagccagagctttgtggttcatctctagaggttcaacaggaccctgtggatggcccaagttcgtttctctgcacttacctcttcggggttgtcctcaaaacgttgccgtgtcagctctcacttttcacagcaactctggcctcctaccttggactgcgccacttctgtctccttagataacctccattcgcatagctaaatgctgcaccctccgacactgccacaataatagttctgtgagttagtaccattttatagataggcaaaatttggcacaggacaaaagttagtggtaactagaacaaaagtaaccagcccaagctaggaagtggtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagaaaagtcctgggaagtggatgatggaggcagctagccgtagctgctgcttttctcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttccccactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttctcatttcagttcacattttctaagcatgatattcctactgatttccttgtagatattttgaaacagataagaaactcctccgtggaaattactgttaactagggaaaagacatgtttttttctgttcataaaagtaatgcgagttctttgtagcaaaacttggaaaatgcataaaagtaaaaaaaaaatgaaaacttgtgtaaaattcctcatactttagccatccatagatggtccttaccattaggattttactaattttccttgcagctttttcttaaaatatacacgtgtgtctacacatacatagtgtacactaaattttacatacacacagaggaatatatatgtgtatagttatcttgtgtttagaaatttggaatcccttctagttgtcttgtaacatgtgcttactctattttgaggattttctctatgaatttcatgtagctctttaaattaactttcaggaggattgtaacaatgtgctctccacccagtattttaccagccttgagttttctcaaagggggcattggaggggttcttatacatttacagtgggaatgtgaattgatacaacttctgtggagggcagtttatcagccactatctaaattacacatacataaaccctttgtctaagcaaacttgctgggaataaatcctacacatatatttgtatgtgtgcagactgtttgtacatggttttcattatgctattgattttaaaagtcagaatttggaaacaaccctccatgtccaccatggggaactggctaagtcatttatggtggaatggagatcatagccttaaaaatgaagactctttatatacaggttgagtatcccttatccaaaatgctcaggaccagaagtgtttcagatttcagatttttgaattagggatcctcaaactatactaatgtgagaaagagctctaagatagttaagtagataaaagcaaggtgtcaaactgtagagtatgtttccatttatgtaaagaagaaacaggctaggcaaggtgactcacgcctgtaatcccagcactttgggaggccgaggcgggtggatcacctgaggtccggagttcaagaccagcctgaccaacacggtgaaaccccatctctactaaaaatacaaaagctgggtgtggtggtgcacacttctaatcccagctactccgtaggctaaggcaggagaatcgcttgaacccaggaagtggaggttgcagtgagccaatattgtgccattgcactccagcttgggcaacaagagcgaaactccatctcaaaaataaataaataaataagaaacatttgtttatatgtacacacataatctctgaaagggtaaaagtggcatactggttggccagaagaattgggaggacagtgatgaggaataattttcactctttatcattttatatttttggaattttgaaacatgtaaaattattaccagttcaaaaaataaatttaaacaaaaatcttaactgtttcaaattaaagtaagtttgataatttctttcattgtttactgtctgcatcccccatacagtgttcacatgagcagagagtgtgtgtcttggtcatattcatacttgttctatatatactcgtgtgtgtgtgtgtgttcagttgacagaaacagttgagtgtaaaacagcttcaactcgatgataccaaagatacaagataaaggtccctggagggtggctgtagcgcacacatacatttccaagttactttgttaaatttcctgtatcaatgagccccaattatgagagccccctacatacaagttttagccaatagccaagtcccccatttccagtgttatcttcatgtcctccaaggtattcaagttgtttctgcaatgggtaactgggaagaaatcagcatccagtctgaaaagcagtctcccataggtcttttgtaaggagatccaacatggacatcttccagaatgcactgtacaacatggtagccactagtcatgtatagctatttagatgtaaatttttttaattaaaaaaatttttcatttatagcaacagggactcactgtgttgcccaggttggtctcgaattcctgggctttagtggttctcccactgtggcctcccaaagtgctgggattacaggcgtgagccaccatgcccggcccagagctgatagaatttttaaagtccccctgtgatgatctgactgtggtaggagtagggaggtgtaacccgagtcagtatgcacattgggagcctcctccactaggtcatacaggccttctgcgtgtagatggaattatcatgtcccacactgtaccccggcacctccctcgattaaggtgatttgcatcatgcagggcctgcctgttatcagagagtctcctggacatacagaaataggaatgtacagggactgcatacacctgttgctcaatttctagctaaatggctggaggtgggggataaagaaatggcattcatacggtgtaatactagccatgtttcagaaagttttcaaaaaatgtttagtggagaaatgtgcagggtcagtggaagaaaacctgtaaaattatattatgattgttttatactctatacggacaagcctaaattggagggcattttggaaaactcgcttggatacatgaaaactgccaagatcattataaagaaacaacaggatccattctagattgaaagcaacttgaaatgagacagtagagtgtaatgcgtgtttagtttgtgcttgaataaaagacgaaaactacgtaagacattgggacaactggagaaattagcatatgggctggggattgggtacaggcttcaatgtcgttacttgggtgagttgaagaatgtacgtgttcttaggggacatctgcttaaggatatacaaggttcaggggggaaaaatatctccaaacgatatacttttatatctatgtgtgtacatgtgtgcgcgtagagaaagaaaaaagtacatacgctgtatatttcaaagaacatataaaaccatggatgtcaatatacttcccttccggtgcgctgcctgcgcagaaccgagaggttctgacgatccgcagctcccacgctccccttccggccccgcagcgctgtgaactccatttcccagaaggccttgtatcccgtgcatggccgtttccaggcaggaaggcgaagggccttctgggaggtgaggtcctgggcggccgctggccaccaggcggaagtgcgtaccggaagtgccggcggcagtgtgtaagacgctcacgggcgcgcggactatcgggcggctaggctctctgaggaggctgccacagtggtgagtggtgtgtggaggagaggcgagggtgattgtgagggatggagaggcgcccgtggcctaagtgtgctgatggtgggagtgaatgagtggacgggtgggacctgtgaggggaacgcgaccccgggtcggcgcgggcagagaggcgcgcggtgcgtgagggcgcgacctgccatgtcctgccgggtgtcaccgcttatgcgcccgtgggaggggagcattctgtgttggaggcagaaggaatgagggtcgtgaccaactcattataccactggaggctctatgagcaaaccgcaaactgttctcatgaaagcaggatgttggtaaactgacaaactgcgtctgccgccagaaggaatgctgggggcagtcatgtcccaggtcccctgctccttgaggttatctacaggaacatctggaacctgctgaacaaagaaagcagtcatgtgggcctgtgttaaatcaaatagctgaccgtcagttaccctttcctccctattcagtctacctaacaaatatgaagggctgtaaaagctcagggccctgttccctagaatctaggagccccctgaccccttctttcaaacagatccttttgtctttgtcttcatttctgccttcgttctccttcgtttggtccagaagcaaccgtgacaagtggtgcccgaccagggacctgaacgaggaaggtctgccagagcagagaaagtgaaactgatcagacgaactacgaacccctggacgggagagtctgccggcggagaatataaggtcagttccctgagaaggtatcgggagcgggaggtttctgaatcagggtaacatggggcagaatctgtctgttgaggagcaacattatgtgcagctgcttaaagttttacttaaacaatctggtgctcgggttagttctcaaacattaagcttctgcaggaggttattacacataacccatggtttctgcagacaggtactcttgctgtggaaaattgagactgagtaggagaaagattgaaacgagctcatcagaaagttcttaaagtggatccttctattttctctgcttggggtttggtctgtactgtcctcctgccattgtcctcttcttattctgccagacagcaggtgctatgttctgaatctcaaaaattgaaagaatcttttgtctcaccagcagcgcccattgaaaatgataaacaggagagggaggatgagaactggcctgtactgtcccctccagtagcagaaatagagaccccagtacaaaaaattctacatgctgtggccatagctggcgagccactaggaccttgcacttttcctattaccttaaggcctgatccaaataatccacagcagtttattcatgaacacactccagtaaaatttaaattattgaaagaattaaaagctagtgtggttaataatggaatacagagcccatttactttaggattgttagaatctgtattcagcactatgcgcctcccacccttggatataaagcatttagcttgcacttgtttctctgctagtgcatatttgacatggaatttaaattggcaagaaatgtgtgcagaccaggctagacagaatctcaccgctggacatgggaacattacagaggaaatgctattgggtagtgactcttattcagatctggtgcaacaattgacacttccagatgctgcttaccatcagtgcgcctggccgctaagcgtgcctgggccaccattcctgagaaaggggtctcaataaaatcttttccgcatatcatgcaaaaatcacaggagccctttgcacaatttattgcacagttacaacagtcagtgaggcatcagattcctcatactgctcctgcgaaaatgcttactttgaccctagcttttgaaaatgcaaatgcagattgtaaatgtgcattagcacccgtgagatgtacaaacagcttgggaaattttctcaaagcctgtcaggatgtgggaactgaactccatcgttcaactgtgttagctcaagtaatagctaatttagtagtgaacaaatctgaaaagggccaagggttgagccctaaagtgggaaaatgttataattgtggaaaaattggacatttcaaaaaagaataccatcagacctctgggcagaagggatcttacaatgcaataccgcccccccctccccgccccgctccccccaacacacacacacagaaaaaaaaacaccaggactttgccctcgccgtaataaaggaaatcattgggctaatcagtgttgctcaaaatttcatcagaatggcaccccgctctcaggaaatgagaatggggcctgggcccctcaaacaatgagggcattccccatccaggccacaaccctgctacaggggtgggttcctggaggaacattgactccctctcctctggaacaccggggagtgcaggattagatcgctcagtcagagaatgggtcacgttagttggaggagacaaacccaccagaattcccacaggcatttgggaacctttgccaacaggatatacaggattaattttaggccaaagccatctgaacttacagggcattactgtgatccctggattgttgactctgattatgaaggagaaattcaagtaattgtaatgtcacaagatctttgggtttttaaacctgggaaatatattgctcagctattgcttattattattctctgcaaattacacccttcttcacgaaaggagaaaagaggaaatcaagaatttgggagtacaactacacaggaaatttacctatcccaacccatagcttctaattgacccacctgtgcagtgcaaattaaaggaaagaagtgttgtgggtgtatggacacaggagcagatgtttcagtaatatccaaaaacaattggcccctgctactaacctctgcatccttagtgggagtaggaacagctcaaagtgtttaacagagtgctgaaattttactttgtgtcagtccagatggacagccatgtacttttcaaccttatgttgcaaatatacgtgttaatctctggggctgagatttacttacagcatgggatgtgagacttacaaatgaaaaggttgataatccaggatttaaaatattgaaggaaatgggatatcagagtgggaaaggcttgggaaagttcctacagggaaaccccggtccggtatcggtaactgggcaaacagataggaaagggctaggtcatcaggatttctgataggggtcattgatacttcttctccacccactgccttgctgctagagtggctgactgataaacctgtgtgggtggatcaatggcccctatcacaggagaaaactgactcaactccatcagctggtaagaaagcaattggatgcaggacatataaaagtatcagttagtgcttggaattcaccagtatttgtgacccccaaaacgtcaggaaaatggcaactgctgcataatttgagagctgttaatgcacaaattaaaccagtgggtgcattacagcaaggtctgccatccccggcaaccattccaagagattagcctcttgtagtaatagatcttaaagactgttttttcactataccattacacaagaaggacaagcctcaattcgccttctctgtgccttctattaatcagagagagcctgtctcttgtgatcaatgaaaagttttattaccccaggcatgctcaacagtcctacgttatgtcagcattttgtaggaaaagcattgaaggagcctcggaatatgttttccaccacctacatcattcattatatggataatattgttttggccactcctacagatcaagtattataccagttattcagagaaataaaatgggctttaactaaatggaatctcaaaatagctcctgaaaaggtacaaacaacctcctcataccaatacttagatactactgttactgaaaaaagtattcagcctcagaaagtagctcttcgtaagaacaaattacaaactctgaataacttaggggatattaattggctgcgcccaatgctaggtattgcttcttatcaactcactcatgtttatcaaaccctccaaggagattcttcattagattcccctcggcaacttactaaggaggcagaagctgaattacagcttgtagaaagatgcttcagcaacgacatgcctcctggctacaaccacaaaagtctttggttttgtttattcttcctaccccccattctccatcaggacttttagctcaattcatagacaaaactataatggtaatagaatggctttttttatccagtcaaacagtaaaatctttgcaagtttatcttgctttagtcacacaacttataacaataggcaggcatagatcaaaaatgcttacaggatatgatcctgataaaattattgttaccttggattcccaacaacaggctgcggcctgggagatgtccactgcatggcaaatcactttcgcagattttgtagaaataatagataaccattatccatcagacaaaattttgcagttttataaaattcacccttttattccccctgtgattgctcatcacaaacccatttcaggtggacagacctattttaccgatggctcttccaaaagccacacagccatttatggacctaaatatacttaaataataaagacccctagagtttcagctcaacactctgaattaatggcagttattcaagttttaaagctcacagctttatttcctattaatattgtctgtaattcagcctatgtcgtaaatgtagctagttgcattaaaactgccactatcaagagtgtacggaccagccccacagggtcggtgggtctctccctgtgtgcggcgacgagagagtgtagaaataaagacacaagacaaagagataaaaggcagctgggcctgggggaccactaccaccaatgcgcggagaccggtagtggccccgaatgtctggctgcgctcttatttattggatacaaagcaaaaggggcagggtaaagagtgtgagtcatctccaatgataggtaaggtcacgtgggtcatgtgtccactggtcagggggcccttccctgcctggcagccgaggcagagagggagaggagacagagagaaagacagcttacgccattatttctgcatatcagggactattagtactttcactaatttactactgctatctagaaggcagagccaggtgtacaggatggaacatgaaggcggactaggagcgtgaccactgaagcacagaatcacagggagacggttaggcctccggataactgtgggcgagcctgactaatgtcaggccctccacaagaggtggaggagcagagtcttctctaacctcccccagggaaagggagaccgccccccaccctttcccggtctgctaagtagcgggtgttgttccttgacacttttcgctaccgctagaccacggtcttcccaaacgctggcgtcaccactagaccaaggagccctctggtggccctgtctgggcataacagaaggctcgcactcttgtcttctggtcacacctcactatgtcccctcagctcctatctctgtatggcctggtttttcctaggctatgattatagagcaaggattattgtaatattggaataaaaagtaattgctacaaactaatgattaatgatattcatatataatcatatctaagatctatatctggtataactattcttgttttatattttattatactggaacagcccgtgtcctctgtctcttgcttcggcgcctggatggcttgccgcccacacaagagcaccttaaaaccagaactgcttaacctatttctgagactccaaaaagctgttcgctctcatgctgccccttttcatatttctcatatccgatctcacacacaacttcctggggccactatctctaggtaatgatagagcagataaattcatcagttctatatttcaacaagcccaagcttcccatgctttactgcatcagaacaacttgcccttactcgtatgtttcatctgcctcgcagccaggcttgagttattgtgcaagcctgccccacttgccagcatgtccctggtgttgcacctgtggaaggatgcaacccacgaggcttggctccaaatgaaatctggcagatggatgttacatatatatagcagcctttggctaactccgctatgttcatgtaatatagacacttactcccatatgttacatgccacatgccaaactggggaaacagctggtcatgtctgacgatactgtctgtcgtcatttgcccatatgggggtccctaaacaatttaaaactgacagtggactcgcttatgttagtcatgctttcccaattttttacaattgtgggcaatcaatcataaaacaggaattccatacaatccctgagggccaggcattattgagcgggtacatcaaacactacaacgcatgctgaaaaaacaaaaagggagaataggggaccaattaccacttcaaacaaaattacatttagccttgtttactttaaattgtttgactcctggtacggatggcaagaccccagcagaacgacactggcaactgctagaggaaaagaggcaagtttatccaaaagtgttatggaaatccccagaagaaggacaatggaaaggtccggtggatttgctgacgtggggacgagggtatgcttgtgtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcggtatgtttcccctgtgtagaggcaaaaacatattgggcatatgttcctaacccactggtagtacgactggtactctggagcgacactcctcctgagatatattatgatcagggagcgtgggcaccaggacccctaactccgtctgacacagagcaatagcatcaattacaccggcccattggaaggactccctttatgtatcaccatggatacgtcactcaactgcagctgtcttgcagtccaatctcaggcatggttaagtcaccatggaaaaattatgtatttattaggcctcagctttattaatgttactggcgtgttcaccaatcactcctagccccatcactcaaattgtatggattatatggaatgggctccctttgatatttctcacccccctccttggacccagtgtcttggccccttggccagacaacagtctatgttaatgggaaacattgactggggtccccgtggccatttagaggggagagatgaaaatcagacctcttggcacaaacttcactggcactggtggtggaccttcaacacctcttcatcacatcacactgggattcagtcccccagttggctgcacaacttgcttggtataggacaggctttaacccgcccttacctcagtgacgtcatctaggaaacagaggcccaattcaggaatcgatatggaaggcaacactcccatttatgaataacagcatctgggtcagaacattatccaacaatagtaatattactcaacacagttttaatatcacctttgtaaaaaatattaccactcaatttacggtttgtgggttttttgttgttgttgttaactgtttgagatggagtctcactctgtcgcccaggctggagtgcagtggcgcaatctcgggtcactgcaacctttgcctcccgggttcaagcaattgtctgcctcagcctcccgagtagctgggattacaggcacccgccaccgtgccaggctattttttgttttttgtatttttaatagaaacgggatttcaccttcttggccaggctgctcttgaattcctgacctcgtgatccacccgccttggcttcccaaagtgctgggattacaggcgtgagccaccatgcccggccagtttgtgtttttaatccctatgtttttctagcatctaagaaggaccaactccacgtaaacatcacccagttgacttgtgactcttgtcaactgtatcactgcctcaatcatagcacaatacaaacacacaacatatccactctaataattctgggtcgtatccctggattatggatccctgtcaatttgtgcaaaccttgggctgccacccctgctttacattttgtaaaactccttcttacccagctcactcatcgtgcacgtaaagccttaaacatagtaatttttactgtaatctccttagtcacactaataacctcggttgtagtgtcctcagtagcactacatagttctattcaaacagcccaatatgtagaaaattggacatgtacagccaaccaggcatggatgcttcaaaataaaattaataccgaattacaaacaaaggtagcaatgttaaaggctactgttctgtggctgggaaagcaggtacaaagtttgcaattgtagcagcaattgcactgtcatttcaatcatattcatatttgtgtgaccaatttggaatagaaccaaagtgaatatccatggaaccttgtaaaagctcatttgcagggagcttttacatccaatattacttttgatatcagtaacttacagagtaaaattcttaacttgaataagcaaactcaaaaataacagccctttttagaagcttaaacagaattccagcagggcttagaaagcctcaaccctggccgggtgcggtggctcacgcctataatcccagcactttgggaggccgaggcaggcagatcacgaggtcagaagatcgagaccatcctggctaaaacagtgaaaccccatctctactaaaaatacaaaaaaattagctgggtgtggtggcgggcacctgtagtcccagctaatcaggaggctgaggtgggagaatgacgtgaacccgggaggcagagcttgcagtgagccaagatggcgccactgcactccagcctgggtgacagagcgagactccatctcaaaaaaaaaaaaaaaaaaaaaaaagcctcaacccttggacctaccttaaacataacttcaatgtctcttttataataattacaagaataatgttgttatgtctctgtttttttgctcatagtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcatgtacaggtgtttgtgtggatgtatatttttaatttgggaaggggaggccatgggtgggacctaggcttgtgaagagcctggcctgggtgtatctgtttgtccgaggagtgcctgtatgcatggccatgaccacacccactccttgctgcctgtgctcattagccatacttcattttccagaatcccaggcctgggcccctgaagtcaaagccaggagcctagagccacactgatgtgtaggatcaaagagaaggcggcagtggccctggaaacaaacctgtctctgcaagagtcactagcaacctgggacctctgcccaggactgagacctcgggtgccccctaccctgtagctgctgaggccaagcaatgtggagacagagagagggtgaggtgatggagcctgaggtgccgagtgaggtagatggtggggtggcagtcacagtggcacaggaggcaggtacagggctagatgttttcagaaaccagatatccctctaaaacacaccctgcttctgctgccttcattccactgccctgccttcctcagcctgctctacaccactacctcctcatggttctcctgcctcccgttgcccccttcatcactctccactcagcattgggtagagagggtcttttacccctgactgatgaggccacccctctctttaaaccctccatcactgcccaggccatcagagtatggttggcaaactcttctgtaaaacacaagcagcaggctgggcgcagtggctcatgcctgtaatcccagcattttgggaggctgaggcaggcctgaggttgggcctatgagaccagcctggccaacatggtgaaaccctgtctctactaaaaatacaaaaaattagctgggcgtggtgatgcatgcctgtaatcccagctactcgggaggctgaggcaggtgaatcgcttgttcccaggacatagagattgtggtgagccaagatcgtgcctttgcactccagcctgggcaacgagcgaaactctgtctcaaaaaccaaacaaaaaacacacaagcagcaaatgtcagctttgtaggctcagagagaaaaccaagaatgttacaaaggtacctatctaacaagagaaaaacatgtccatacattttattaataaaatccaaaactttgttaaatgtaattcattccttaatgagcaaaaagcttttcacaggaggttccattttatagataggaaacagaccccaagggaggtgagcagcccagaattacagcagagagtggtgaagatttgatcctagatctgacagcctctaccatcatacttgccattctcagcttaggaataagatggggaggaaggtgtgggtaatgggcaaatcagggcccaaatagtctgttcagtactcttgtctcgtgggaaggaacaaaaggccccacatctgcccttcctcctgggagtctctgttaggacctgaattcagtacagcaggaatgatcaatttttctctttagagcactcacccacttgacatctcactttgttctcacatagtcctcatagaggtatcctgtggctgctgtccttgaagcctgatagcatggagctgaggcctcagactataacagggcacataattttcatgaagttcaagaagaggctgggctgggcgcggtggctcatgcctgtagtcctagcactttgggaggccaaggagggtagatcacctgaggtcaggaattcgagaccagcctggctgacgtggcaaaaccctgtctctactaaaaatacaaaaattatcctggcatggtggcaggtgcctataatcccagctactcgggaggctgaggcaggagaagcgcttgaatccggggggcagagcttccaatgagccaagattgcactatttcaccccagcctggacaaaagaggaaaactacgtcttaaaaaaaaaaaaaaaaaattaggctgggacacctttcctggaagggctacttactacaggggagctgtctaaggtgctgaaatgtcctagccctgcgctgtccaatatggtagttatgattaaattcaaataaaattacaagttccatgtcccagtcacaccagctatgtttccagtactcaggagctacctgacactgatggtgccatattggacagcacaactccagaacttttccatcctcacagaacattctagaatttaatttgaatgctagttacacagggctgtgcatttaccaaattcactaagctgagcacttgtaattctgtaaaacatgtatatgtatttttgaaagcacaaagtttcacgtccccgcctgccagtcactttaccaaacaacctttggtttaacttctctgtgccccagtttcccaacctgtaaaagagagtaatgatacctcccctttgattggttgagagtaccaccaaaggtgtttgctgggtggcctgacctgcaggaggtgctcaggaaaggggagctgctgctgtcatttggtggaagtgggtccccttatctggctagcagatgccttgagttatggtgagtatgatggggacagactcccaggaggatggaatggcatcactctgtggaaagactgtgaaacagaacacgaacacctcatggcatctttgctgcctagagccatgccacttgcacaccctccttctgctcctgactcccaggaaggcaagggggtcactgggcttggggctccacagaaagaggcttcctgatttgatgcttaagagctgtgcctcagacgcctgcctctaaaacagaaagccgtccacacagacaccccacctcatctgggtacctcctctggacctaggctgggtccccacaggcagccacagccatctatgctgctgcccccacactgcctctggctgtgggcttctcgagggcttgctgtgtgatgctgagttccttaacgtggagacaatgtgttggagtgtggcagtgttcaggccctgctagccaaataaggggacccacttccaccaaatgacagcagcagctcccctttcctgagcacctcctgcaggtcaggctgctcagcaaacacctttgatggtactctcaaccaatcaaaggggagctatcatcattaccctcttttacaggttgggaaactggggcacagaaaagttaaaccaaaggttgtttggtaagtgactggcaggcagagatgtgaaactttgtgctttcaaaaatacatgtatattttttacagacgtacatgtgctcagcttagtgaggaaactaggaaacaggcccagagctgggatatggtcagtcagtggcatgaagagccgagagtggagcctggcaggaatttccagctggcatccatttgttactgaatatcagggcactcccccagagacacaagccacccctaaccacattctggaaaacgatctcacgtgtgtttccgtcctagatcgggggtgctcctgccaaggagagggtgtatgtggggaggcctgcagctgtttcccagaccttaatcagccacaaggagtccacgctggggagggtgtactgccatgtagtgggtgggaagatacctttggcaagaacacgtgccttgtgagctatcagcagattcccaacaaaaggagaccctgtacgtgcgaagagtgtggcaaggcctttggacagagaagtcaccttgttcagcacaccagtgagaagctgtatgcatgccaggaatgtgggtgtaccttcagcaacaattcatctctagtcaagcactggcacgtccacacaggcgagaagccctacatgtgtggccactgtggcaagtgcttccgagagagctcatcccttgccaagcaccagcgtgtgcacacaggtgagaagccatacgtgtgtggtgagtgtggacgcaccttcagcgagagcacacaccttgtacagcactggtgattccacaccggggaaaagccatttgcctgccaagagcagcaaagcctttgctgacttctcggccctccttgcatgccacggaacctacacgggtgagaggccctacgagtgccgggtatgctgcaaggcattcagccccagcttgtccctggctgagcacatacgctgccacacgggagagaagctgtatgcgtgtcaggaatgtgggaaagctttcagccacagctcatccctcagcaagcaccagcaggtacacacaggtgagtggccctatgtgtgtgcagaatgtggaaaggccttcagccaggggtcctacctgacccagcacctcaagatccacagcggtgagaagccgtacatacgtggtgagtaaaggaagccattcggtgactcctcagccctggtcctacaccagcgggtgcacacaggcgagcatccttatgcatgtggaaaatgtgggaagactttcagccacagcaagtttctcacccagcatgagcaagtccgcatgggagagaagcccttcatgtgtggtgactgtggaagagccttcatgcaaacctcatccctcgccctccatcagaggactcacaatggggagaagccctacaagtggaatgagtgtggcaagtcctgcatccagatgtcacacctcaccgagtattaccaggtacacgctggggaacgaccctttcagccgtggcacacacctcacgcagcaccagcatgtgcatgcatgtaccaagccattcatatgccatatatgtcagaaaaccttccaggaggccacaactcttgtactacatgagaggattccctggagagaagcccttttgagtgttgtgagtgtggcaaagccttccgccaaagcagattcctggcccagcaccagagaattcattcccagggaaaaccatgtgaatacatggatatcagaaagccctcagtgacgctttggttcttgtatgtcagtgaactgggcatgtgccaaatatggcagagatcttcccatctatccttggtgtgttgtcctttgcaccggggtggcaggtgaagagggactgtgagtgtgaggaaatcagggtcagtgtgagaagcccctattatacatttctcccttcagggtcaccggggcgggtgaggaagctgggagtgggcctaggatatgtctttcagatgtcacatggagatacttctccataattatcaaggggcacaatggccacttccactttaattagattcccatggatgctaaccaagtggtaggaggtacacaggtatgaacaggtttcctctcagcagtcctagaagactttatttcagtttttgccaagacaaaaatgaaatttaaaaaatgtgggtttttttgttttttgtttttttgtttttttgagacggagtcttgctttgtcgcccaggctagagtgcagtggcgcaatctcggctcactgccaacctccgcctcctgggttcaagtgattctcctgcctcatcctcccgagtagctgggattacaggcccccgccaccaaacccagctttttgtatttttagtagagatggggtttcaccatcttggccaggctgatcttgaactcctgacctcgtgatccacccacctcggcctcccaaagtgttgggattacaggcatgagccactgcgcccgcccaaaaaaatacatatttttaaaagatgcttttgcagttgtttgtgccttgtattaaggtagaccatatagtttggggttttattgcccagaaccaaaaaggtaaaatttatatgctgaagtgtgtgtcacagagtctagctctttaagaagaaaattttgtgtgttcctcagcttcagcatgaggacgtcactaaaactagttgagacagtgatgatgttcgttaagattttactgagcactttagaagcactttaagtagattgtcccattccatcctcttagccggcctgggatgtatttttattcccacttcatacatcagggagctgagactttgagaggttaaatcacttgcccagtgcccctagctaaaaggcactcacttttcaggacgaaaatacttgagttaatggataaggccaaggtggcagaagtatttccttcccttttaccaatgcccagaggtatttactggaattctagaactgaggaggcagttctagaatataaagtcctattgagcatgggagacaatggaatgattgggttccacctgaagaagcaagttgacccatttagctgacttgaggcaaacgcaaagtagtaactgggagccactgctcaatccagatgttgattaaatgcttcctgggagccctgcatgtgttcccactctcccctgtaacattgctcaggggttctctggctgtcaggctgagatctagcctctagctggcctctatgcgggggtccccaagatcctcaggtgtgaagattcactagaggaacatagaaaactgatatacttaacatttacggtttatagtcaaaggatacagattaaaatcacaaagataaaagatgcgtagggcagcaaccagaagagaggaggtacagctgttgtagagactgctgaattctcccagcgctgagtgacaatatagagtagcatcaaccaaggaagctcacccaagccttggtgttcaggacatttactaggtgatgatctagtgggcatggagtgcccacctgactgactttagtcacttagtctcccacccctctagtggtcagactgttacagtgtggcctaagatcctcaccataaatcacattgttgacaaatacttggcatggcccaaggtcctcaggtaaacaaagatactcttaggcagcatgatcaccacatgccttgaactgaaagaaaccagggtcacaaatgattttgttggctttctacatggaaggaaaagaaaccaaaagtattattgtagtggattgaattactagctcaattcttcactgctccttgcatatatacacccacggccatatttatggttcttcccagtaaaggcaaatttgatgtccccacccattccttgagtttgggtgtggccatgtgacttgatttggccaacagaatctaagtggaagtgatagcatgctagtcctgagtccaggcctaaagcccattgtgtctctgccatcaggatgagaagaatttttcctgtgagccttgcaagacaaatacagcagacctggacccaaactgcagcctagagccaagcccagctgagcccagcccagatcagccaaccctcagacacatgacaaaaataagcactttttttgctgtgggccacagaggtgtcgtagctgtttgttacagagcaatagctgatacaattgccaaattaaagtgaatactccctgaaaaagataaggtttgaaatctggggagaggataagaaagagacaaagggagagaggaaaggaggagcatccactcaggagagtccagaggccagaatgctgattgaacagagcacaagcacaaaaggggtggccaagggaaagggccttccaaggtctgcagtattgactacaggtgccatggtgggtgcaggagatgaatgaggagaatccagctatgcagctccaggcaagggaacattgttggtctgccagtcattcagtcattcctcagccaactcttagtacctagccctgtacaaggcatcaaggataccctggcctcggctatgtaaagggcaggacccctctcaggcctaacagcacagactcacaatctaggcagaaaaggagccaatgaggagagattccattggctttccaagtcaccctatacccattaaatgtcaaccagggctcttcttcctctccctgacaccagagtcccctccagctgctgccctatctcgctcgtttcctccttagaatctccctgaaaaggggtctaaggatccccacactgatgccactgtccattcacccgttatggactgaattgtgtccccccaaaattcatatattgaagtcctaacccccagtatacctcagaatatgactgtatttgaagataagacctttaaataagtaattaaggttaaagaagatatggatgggtcctaatccaacatgactggtgtccttataaggagagagagacagtaggggcatgtgcaaacagaggaaatgccatgtgaggacacagtgagaaggcagccatctacaagccaaggagagaggcctcaagagaaaccaaacctgttgacaccttgatctggggacttccagcctccagatctgtcagaaaataaaaaaaatttttttttttttgagatggaatctcgctctgtcgcccaggctggagtgcagtggcgtgatctcggatctctgcaaactccacctcccgggttcacgccattctcctgcctcagcctccctagtagctgggattacaggcacctgccaccacgcccggctgattttattttatttatttattatttattttgtatttttagtagagacggggtttcaccttgttagccaggatggtctcgatctcctgacctcatgatccgcccacctcagcctcccaaagtgctgggattacaggcatgaaccaccgtgcctggcccagaaaataaactttaaactatcgtttaagccaccaaatctgtggtattttgttatggcagtcctagcaaactaatacaccctcctcccacccataatcagagggcactatcaggcacctgggtcagccttgctcaccccttggacactgtagttcaacccatcaaccctatcatctataccaaacttgtccaacccacagcccacgggctgtatgtggcccaggacagctttgaatgcagcccaacacaaattcataaactttcttaaaacattatgagattttttttgcgatttttaataaactcatccgccatcattagtatattttatgtgtggcccaagacaattcttctaatgtggcccagggaagccaaaagagtggacacccctgatacaccttcaaaacagatccagatctgaccacctgttagcatctctaccacaccaccgtttgaccaccctgatctgagctacctgcctcaggtgccagtactctcaaagcaattgcatctttggtctccctgactccactctcatcttgacagtcttctcctgcagcggccagagaattcctatgaagagctaagtcacagcacagccctcctctgctcaaaggcctcccatagctcccacttctctcaaggtggaaatcaaagtctgtatgtgagccaagtgtggtggctcacgcctgtaatcccagcactttgacaggctgaggcaggaggattgcttgaggccaggagttcaaaagcagcctaggcaacacagtgagacattgtctctacaaaaaataaataaacaaagtcgtatgtggctcacaagcccttcaagatctgcccccacaggcctcccttttctgtccttgtcccctcccatctccttcccttaatccaccccagccagtcttcctcatccatgcctcctcctgacgtgggcatttgtgttccatctaccttgaacttactctccctgagttcttcgctctattcaggcctcagcttaaataccaacttctcagaaaaatgacttctttgtttaccatctgcctccccacacaataacatcacctccataaaggcaggccatgcttatcatcattgcagtatccaatctgcagtggtgctggctgcctgttgtgggtgctcagtatttatctgtggaaggaaaagaatatatgctcattccagctgctagcagtctgcagggcaaagtctgagaataataggggatgtgagcacaggctggggccaagaaacaccaccagcaccaccaagcaatcatacacaccctgcctcaaaaaggcctcacctgaacataggctgggccaccaacctctatgtatcgggccccaagccagagtctcctgctcaatgtctcttacacatacacacacacacagagaagatacattctcacacacagtccaggcatcgactgaatcacacaatcacactaccattcacagtcaccgtaacaacatcacacacagtctagggcctttatactgtgtcaggtccaccccattacctctaagtatctgtctcagacacaattacacctggtgcaggcaaacacagctgcatgattatcacatatgatgattaaatcacaggtcacacacacgcagagtaagcacacagaacaacccacaaacctggtcacagagtgactcatgcagacagacgcccagctcaaattcagtaaaaaatgatacacatttataaaaatgattacatgtgttcacagagagccacacatagctacactcaatacacaccctgacataggcaaccacaccgctcacctctcacaaaggcaccttcagtacttacacagacactcacacccacaagccctcagacaggcaccctctcccctcactcctaacatgggcaccctcacctctcacccaggtacccttgttactggtggagggtgtccaggttcttggcatcttgaacaaataattggacaaaatgcacaaagaaaagaatgaagcaacaaaagcagagatgtattgaaaatgaaagtacactccactgtatgggagcaggccggagcataggggctcaagagcccggttacagaattttctggggtttaaataccctctagaggtttccattggttacttggtatatgccctatgtaaatgaagaggacgaagtaaagttacaaagtgatttactccatgtacgccctgcataaatggagaggatatttcctaccatagctgcagtttccatttgatttacttctaggaagtccttaggttccctgcctccagacccgattttcttgcctcacccttacccctcacccctcacacaaacaccctcagccctcccaaagccaccctcagcctcacacagccgccctcaccctcagcctcacacaggcaccctcagctctcacacaggcaccctcagccctcacacagccgccctcaccctcagcctcacacaggcaccctcagcctcacacaggcaccctcagctctcacacaggcaccctcagccctcagccctcacacagccgccctcaccctcaccctcacacaggcaccctcagcctcacacaggcactctcaccctcagccttcacatttccctcacctccaagtcccgcctttcgcgcatcgcctgctgctctcccactcagcgccacctcagtcccacaaaggccgggctgggatcctgtggcctccgtgctgaccaacgtcaactacaattcccagcaggcaccgcgcctgggtacacttgagcttccggaggacgccgggaattgtagtcctggcgggcgtgggcccttgaggtgtgctgggagctgtggtccgggtcggcgggcgcgcaagttggctagtctctgcggccacctccggaagggtccgccggctgtgctggtgaggtgggtttcgggggtgttctccgtcctgatccaggctggagaggggcacagcaggtccagaagccgcgaacctctggggcggccagagcgagatgcggggtaccgcccagcgggtagagagtgagaggctgactaggggacgtgagtagacggactgcgagtgccggacacacgcgcagaggatgtgacggactgacggaccaggcgtggacggaccgtgtgtgcacggactgacggacccggtgtggacagactcacggaccgaatgtggtgcggaatgacacactgagtgccggacggaccgacggagaatgtgtcggactgacggagtgtgtgtcggatggactgattgaccgggtgtggggcggacgaagtgtggagcgggcggacagataacagataaaatgtaggaccagtggcctgggagggtgtggggcggacccgtttatgtgtctgataggcggttctgtgtctgacacctcttgggtgtgtgtatctgacgggttggagtgtgtgattctgataggttgagtgtaacactaaccatggagtgtgtgactgacagagatggttgccgtttgagacttcctacgtgggttgtgagatactgtgagagggtgagcgtgtgacggtgggatttcaagtgtgactgattttctttgtgtgtccttgagatggtgactaagattatgaatgactgtgatcagaataatactgtgtgatggaaatgctgcgagggcctgtgtttatttttgagacggagtcttgctctgttgcccaggctggagtgcagtggcgcaatctcggctcactgcaacctccatctcccgggttcaagcgattatcctgcgtcagcctcccgagtagctgggattacaggcaccggccaccacacttggctaatttttgtatttttggtagagacgggctttcaccatgttggttaggctggcccggaactcctgacctcaggtgatccacctgcctaggcctcccaaagtgctgggattataggcatgagccaccatgcctggccaggcctgtgtttatttgactgattataggtgacattgagatatttcctgtgtctgggtattttgaaggctgtggctgacagactgtacctgagataatatgtgttaatatctgattgactgagatttttatcagggagactaaaacttgggtgatccacaaacagtttaccaagcatatgagagaggatttgtgctttgccatgtctgcagctgaaactgagtgactagtggtcattcagctgggcttatggatatgtcccccagtgtttgcttacgtgtagcagggggctatggtatccatacatctactgcatgtttactgtgcaccaggcctgtgctggacacttataataaatcacctcacataatctcatagcaaccctctgaggtaggtaccattatcaggcttggtataatccatgtgtgagaaatgaaaagaaccaccctccttggttggtaaagcagctgtggatggggaacctcaacctgataggagttgaggttggctgaggaggctgaggaagtttcacatacatgtatttcagagaccgtcatgagggatttctccagaacaggtgttccaggggtgcaaaagagaacttggaagctgttgcagcatctattgtcatccctgccacccttgctcctccttcccctcatgattccctacattcttgggtaaccatgctcagcctttactggtcattccatttgcttaatgcctgcttattgtgaacctgctatagggcaagtcctgtgtgctgtggctccaggacagcccagcctctctgaggaaacagtacagaactagcaaagagttacccagggcactctgggaagaggacttagactagtaccaggtatctgggatgacacctgaggaaagtggcagctaagatgaggcctagagagcccagaggaatccgtcagagacggatttcagaactcgagagcagcaggggcgacaaggggcttagaaaggccacaagagacccaggagaactttacagtgcggcgaaggggcttaaacgcagcttggccagaggccaccagaggtcaccagcggtcaccaaaaggtttcaggattggggtcttgttttagagtaacgttctcttcttcctgtgcccaaggccattgctctttctcaggcctcctgcatctctgtccagggtgacttccttgagcagagactccaggcacactgagcgtcctggctgacattgaaggaaaggaaaaagaactccaaatacttaaaactgtgggagtcgtggatgggagagggagaggctaagtctttgagtaaggagtagtatgtggccaaagcaaagtgtcgaggtctcctaggagaggttacacttaatttagggtattcttcctgactataagagaaaacaaattcactgtgggaagtagagaatgtcaagaaaagtaatacagtagtcacccctcatcttcagttttggtgaatatagtacaataaaatattttgagagagagagaaagaccacattaatatagcttttattacagtgtattgttataattgttctattttattagtcattgttgttaatttcttactatgcctaacttatgaactttatcaagggtatataataagaaaaaaatatagaatatataaggttcagtaatatccatggtttcaggcatccactggagggtcttggaacacatcccctgcagataagggggaactaccatagtataaaataccttggtaaggatgtagagaaattggaaccctcatccacaactggtgggaatgcaaaatggtatagccaatttgcaaaacagcctggcagtttcttaaaaagttaagcattgcctacatgcggccaggcgcagtggctcatgcctgtaatcccagcaatttgggaggctgaggtgggcggaacatgaggtcaggagatcgagaccatcgtggctaatacggtgaaaccccgtctctactaaaagtacaaaaaaaaatagctgggtgtggtggtgggtgcctgtagtcccagctactcgggaggctgaggcaggagaatggcgtgaacccaggaggcagagcttgcagtgagccaagattgcgccactgcactccagcctgggcgacaaagcaagactccgtctggagaaaaaaagaattttttcaaaaagaaagtattatctccctctgaatgtcggtagcacccccatctagaaatggggctagattctgagaagtagaattaatattgaggcagagagcacagtcattttaaagctcttacaacatactgccaaattgtttgccaaagatattctaattgattgccctcaccaatagtacatgaaagtagttttttgctgtccctgaccagcattcagtgctcacagttctagaatttggaaaggctttgagtgtggaggaaagatcgcagatagcctgagctcaaacactagctttgttcctactgaccagatgactctagcagctgactttccccaacttggaaaatgggagtggtaatactgactcacagggtggagctaaggcttgaatgggataacagatgccaaaggctagtgtggcctggtagccggtaggttcccactgactgtctgttcccattttcttttattcctgttgcacactatacccatatccatcatcataattatcttatcatgtgttggtcgctgtccttccgttgaggccattgagcccagcacccatgccttccccgtatttgcattcctagtacagtgctgggcacagagtaggcacctaatggggctgtgctgaacaaaagtattattattgatgtatgtgcccagcaatgctgtagacactggggataaagcaaagacctaaacaaaaacccctgcccttaatgtgctgatactccaacagggacaagtaaataataaacaagtaaccacatacgtgtatcacacatcaggtggtaaagagcaaataaagcagtgtagaagcacagagacttactgataaggcgtcttttgtgtagaggcctgacttaaataagggagagaacacccaacaattatcaaatgcactttttttttttttttttttgagacagaatctcactctgtcggccaggctggagtgcagtggcacaatctctgctcactgcaacctccacctcccgggttcaagcaattctcctgtctcagcctcccaagtagctgggattacaggcccccgctgccacgcctgtctagttttcatatttttagtagagatggggtttcgccatgctggccaggctggtcttgaattcctgaccttgtgatccacctgcctcagcctcccaaagtgctgggattacaggtgtgagccaccgcgtccagctgacgttattattattattattattattattattattattattattattattttgagatggagtctctgttgccaggctggagtgcagtggcgtgatctcggctcactgcaatctccacctcccgggttcaagagattctcctgcctcagcctcctaagtagctgggactacaggcacacgccaccacgcccagctaatttttttgtatttttaatagagacggggtttaatcatgttggccaggatggtctcgatctcttgaccttgtgatcggcccagcttggcctcccaaagtgttgggattacaggcatgagccaccgtgcctggccaacattatttttttaaaagctgtatttttattttattttattttttgagatggagtttcactcttgttgcccaggctggagtgcaatggcagaatctcggcttactgcagcctccaccttccaggttaaagggtttcttctgcctcagcctcccaagtagctgggattacaggcatgcaccaccacgcccggctgattttgtatttttagtatagatggggtttctccatattggtcaggctggtcttgaactcctgacctcgtgatctactcgcctcggtctcccagagtgctgggattacaggcgtgagccaccgcgcctggcctccagaacatttttatcatccccaaaagaaattcccaaacctattagcaaccactctcatttttgtctctcttcagcctctgacaaacactaatatgctttttttttttttttttttttttgagatggagtctacctctgtcgccaaggctgtagtgcagtggtgtactctcggctcactgcaacctctgcctcccaagttcaagagattctcctgcctcagcctcctgagtagttgggattacaggtgcctgccaccacacccagctaatttttgtattttttagtagagacggggtttcactgtgttggccaggctggtcttgaactcctgacctcaggtgatctacccacctcggcctcccaaagtgctgggatcacaggtgtgagccaccgtgccctgccgtgtctttcttcttttacttagcatcatgttttcaaggttcatccatgttgtagcattaatcagtacttcatttctgtttatggtgaatagtgttccattataggtatatacagcattttatccattcatcaggtggacatttggattgtttctccttttttgctgttatgagtaatgctgttatgcacatttatgtataaagttttgtgaggacatatactcatttctcttgggtctatacgtaggagtagaattgctaggtcatggggtaactctgtttaagcttttgaggaactcccagactgtacttcccacagtggctatcccatcttacattcccagcagcagcatatgaggattacagtttctccatatccttgcctacacatgttatctgattataggcatcccagcaggtgtgaagtgctatctcattgtggttttcatttgcagttccctggtagctagtgatgttaagcatcttttcatgtatttattgcccatttgtgtatcttccttggagaaatgtctagtcacattctttgctcattttaaaattgtattattcatctttttactatggagttgttctagatacaggtcccttatcaaatatatgatttgcaaatattttctcccactctgtgggctgcttttttactttcttgatgtggtccttcaaatcacaaaagcttttaattttgataaagtccagtttatttattttttcttttgttacttatgcttttggtgtcatagctaagacagctttgcattattttcaagtattcatggaacattaaccaaaattaaccatacactgggtcacaaaccaagtttcagcaaattttaaatgatcgaaatccattgtagcatgttttctgaccacaacagacttaatctagacatcagtaataaaaagacaactagaaaacccccagttgtttggcaatgaagcaggagagttttaaataaataaccaatgggactgggcatggtgactcatgcttgtaatcccagcactctgtggggccgaggcaggcagatcgcttgaggtcaggagttcgagaccagccccgccaacatggcaaaaccccgtctccactaaaaatacaaaaattagcctcacatggtggtgcacacctgtagttccagctacttgggaggctgaggcaggaggattgcttgaacccgggaggcggagttgcagtgagccgagatagcgtcactgccctccagcctgggcgacagagggagactccgtctcaaaaaaataaaataaattttaaaaaataattaatgagtaaggtagaaattgtaacagaaattagaaaatatttttaactaaatgataatgaagatacaacatatcaaacttgtgatgtatagctaaagctgtgtttagagagaaatttatagccttaaatatgtgcattagaaaagaggaaaggcgaaagtcaattatgtatcaatctcaaacactacaaaataattagcaagtaaagtgagagaatgaccatgtggctacctggggaacagagggagaaagacttggctctgttggggaggagcacgccttaaacaggctggctgtaggtttgcgtgggtttgtagcttagctctctgttaacccttcactagctgagggactttgggcaaatattttcctcctgagtgtctgtttttccatccataaaataggtagaaagtcccacctcctgagtttgttgtaagttttttgtttgtttgtttttgttttgagacagagtcttgttctgttgcgcaggctggagtgcagtggcgtagtctcggctcactgcaagctccgcctcccgggttcacgccattctcctgcctcagcctcctgagtagctgggaccacaggtgcccgccaccacgtctggctaatttgttttgtatttttagtagagacggggtttcaccatgttagccaggatggtgtttgttgtaagttttaaatgagtctacatgcaagcagtagtagcttagaacagtgctcagcaccaagtgggtgctgtcctaattatgaggattgtctatgtctttgtgagagtctttcacatctcacgggccacaagcctgtgttttccctgctctgtaggcatgaggcagggcccaggttccatgtgatgctgaagctctgacattcctgcaggcccagttccaaggctccggcatcctgtgtctcactgagcactgctgcccgatggccatccccaagcactccctgagcccagtgccgtgggaagaggacagcttccttcaagtgaaggtggaggaggaagaggaagccagcctctcccagggcggagaatccagccatgaccacattgctcactctgaggctgcacgcctgcgcttccggcacttccgctatgaggaggcatctggtccacacgaggccctggcccacctccgagcgctgtgctgtcagtggctgcagcccgaggcgcactccaaggagcagatactggagctgctggtgctggagcagttcctgggtgcgctgcccccagagatccaagcctgggtgggagcccagagtcccaagagcggagaggaagccgctgtgctggtggaggatctgactcaggtgctggacaagagaggtaaaggggcgccgtgggcagcttcacggcacaccagagatacaccctggacaggaacatgggagcacagggctctggtttggggttgctcatgcacccattctcacatttgtactttaccgtaactctcacacactgttgtagacaggtgtgttttggttgcaggtgaccaaaagcgagctgaaatgggctgaagcaaagaagggtaaggaggcagcagatacggctatatccagaagatctgttgacagcatcagaactctcttcttcctctcttgttctgtttctcagttggttttttctgtgttagcttcattcttattttaggttctctttccaaaggggttaaagatagccaggaaccccaggcttatgtcttaccaatgtagaaaccccggggtaataacaataagaggtccctggtctgagcccccactggcctggttgggatcttatgtttgtgtttggccaaccaaatcccagggactaacagtgagcaactggctgtttctcagaggaaaccagacgagggcctgggtgcctggggtggctgttgggggtgacggaaataccagatgtccctgtgtaccttctctatgcccaccctgggctggcctccaggatttgggtgggtcagacctgccccaggctcagctgggcactgttactcacagagacccacacaaacatcccaacccagggaggtccagtgggatgcagggaagacccagccttgggacaatccagagcagggagtggtggctcgtctcagatgggcttggcctggcctattggcaacagataggaggtgggcataccacacactgggaggaaacgtgcagtgtgcaggaggaatgtggagtctggatacagctgcatcatcaaggctcagtagatccaaccgctgctgctcttcctggccatgtgactcccttgtgcctcagtttactcatgggtaaaatggggattgtaataaaaacgcccaccttagtggtgttgcgagatacaaggcaatacccgtgcagcacctgaaatggtgcctggcacagattaaataaatggtaactgcaactgttaggataatttgttcagctctgggagaaacaggcctctctggaacagaggttggtctatgcccaagcagatgtcacagagacagggagaggaaggagggagtggccccatcctcccacagggttggccaaagctcagagaaagggtaaaatgcagagggaatggtggggtcaaaggcctggcagtgtgatttgcactggtgtattctggtaaaagcaggtggtgtgatgtttctggatagaggaaggaagggggagacagggccaagcagatggctgggggagcaggggagactgcctgtggacctggaggagaacattctggagctgaaatcccaactgggccactagctaactgtgatcctgtaccagttactcaacaccttccctcagctggatttcagtttccccatctgcaacagaatcacagcagtacctccttctgagagcaggtcgaagctgaaatgaggcgatggaagtcacccactgtgcttggggcccagcacgacaagagcctgatagtggttagtggccctggaaggccagcggcacagcatccatggcttacagatggggagactgagtcccagatgagggcaggactgattaaggtggtagacctggggtttgagtccagtttctgcactgctgagccccactgtggacttgagcagtgggtattccacctgtctctgcctcctccctggaatccatccagtagatgtgccagattatgtgtcctttgcacccatgcagggcaggtcagtgcgagcattcctctacctcatgcacactctgatctccaagagcacctccgccacactctgccttcatagtactttacaatgtaggggcttgagaggccagatgggtacctcatgtactcacccccagcagccatattctacctggggttctacttgcagaaattttcaccatcgtgggcttctggatggattccctcattcagccagaattcactgagcacctgtggacacatccaggcctagaggcaaggtgttgagtgtgagggacagaaccgcaacctcacagagatcagagcctgcaggggacacatccaggcctagacgcaaggcgttgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgttgagtgtgagggacagaactgcaaccccacagagatcagagcctgcaggggtgcatgtgctcagggtcctgacaaggacagaccctccctctctctctgtctccagatcagttccacatcagggtttctcctcttgactcttgagccaaaattgggagccttgaaagatggcgagtttggtgggaggaggagaaatcagaacccatggtgtagttttggatggtgtgggaggacagccctgcaccctttgtcatccaagacaccaaatgagaaacttccccttggaactggggccagatgttaggaacgggccacatctccccttacaaagtgtgaccggggccctcggcagagtaggggaggcttggtgtggtaggaggagtgacagtgtggttcggactgtttcaggatgggatccaggagccgagcccacagaggcaagctgcaagcagagtgacctgggagagtcagagccatcaaatgtcactgagaccctcatgggaggtgtttcccttggacccgcctttgtcaaggcatgtgaacctgagggcagctcagagaggtctggactatcaggggagatctggacaaagtctgtcacccaacagatccacttcaagaaaacttcagggccttacaaggatgtccccacagaccagcgtggccgtgaatctggtgcctcgaggaacagttctagtgcgtggccaaacctcacctcccaagagaagcctccttcagaagacaaatttgatctggtggatgcttatgggacagagcctccatacacctactcagggaagaggtcctccaagtgtcgcgagtgtaggaagatgttccagagtgcttcggcgctcgaggcacaccagaagacccattctcggaagaccccatatgcctgcagcgagtgtgggaaagccttcagccggagcactcacctcgcccagcaccaggttgtccacacaggggcgaagccccatgagtgtaaggaatgtgggaaggccttcagccgagtcacccacctgactcagcaccaaaggattcatactggagagaaaccctacaaatgtggggaatgtggtaaaaccttcagccgcagcactcacctcacccagcaccagcgggtgcacacgggggagcggccctacgagtgtgacgcgtgtgggaaagccttcagccagagcacgcacctgactcaacaccagcgcatccacaccggggagaagccctacaagtgtgacgcgtgtggccgagccttcagcgactgctcagccctgatccgacatctgagaatccactctggagagaagccatatcagtgtaaggtttgtccgaaggcctttgcacagagctcctccctcattgagcaccagaggatccacacgggagagaagccttataagtgcagcgactgtgggaaggccttcagtcgtagctcagccctgatggttcacttgcggatccacatcacggtgctgcaatgaccggaagtcgcccctgggggcgtagcacagcgtcttctcggaggctcgaggtctaagagaaacgctgagttcctgaagagccacagacagggtgggtgattgatgagttgtcaaaatgataggtgcctgagggcagactcgggctgtctaggaaccactctgcatttgaggaaccctgatgagcacaaggtgattcaggccagctggagaagcttccagaagggccctgcactgctaccctctatttcccactcagggctgtcccagagagaaggcagccgaactgaggatttagactggttctgagggccagggcaaatgaaggcgcatgtctctcagaactcagcgtcccaagacgctctgggcgggccaactgtagcttgttctcatgtggttcttcttgcctgcttttctgctgcttagcccagaacggacacctgccatgcccacctctgtgccttggcacctactatttccactccagactattttgtgcctaactgcaaggctgacttttgagactgcctcttccacgatgccttttctacactctgcctctctcatggtttcctgtcgtaatcagtggtgctgcttgacacctgcccagcatgttcctgtctctccttttccttccacatcccaccagtcaccagcgctattgttttaacctaaagcttatctgtaattcacctccttttccaccactgctaccttatgtgagccctcattgcctcttgcctggattatagccggggtctccttcctgaccacttcctgcctttattctctgcccctgtatcactctccaggggactcttgatattacttagatctgactgtgtcactccaaggtggaaagctctccaacccatcttctacagcacagcttcctgaacagggtataagtatgctgagatgcaggctgctctgggccccgagcaacctctccagttatcctcatatgcatgtatgaatactgtcatttttctgtgcgtgcagtgaaaatggcctcatctcataccatggctccaccttccatacaccagccacacggaactactgtggtccctgaaggagccatacattttcccacttatgtgcctttgtacctgtgcctggaaccctcctcttctttttctttttcttttcttttctttttttttttttgagatggagtctcgctctgtcgcccaggctggagtgcagtggcgcgatctcggctcactgcaagctctgcctcccgggttcatgccattctcctgcctcagcctcccaagtagctgggactacaggcgcctgccaccacgcccagctagtttttttttttttttgtatttttagtagagatggagtttcaccatgttagccaggatggtctcgatctcctgacctcgtgatccacccgcctcggcctcccaaagtgctgggattacaggcgtgagccaccgcacctggccctcctttttcatctaaggtgtttcaaatgttgcccaaagaaacctccctgctctccgggagcagacttcagcttgccctctctgcttccagagcacctcctagatacctctcttacaactcctgccaccttgttttacttatttgctccttgtagagctgccttttccaaggataccataaactcctgagagcaggggccatgtcttactctcagtatctacaacacacaagactcagtaggccctgactgatgtctcttacatgaatgtgactggtgcccccaggaggcagtcaccgtgctgtctctgccccacattgtccttatgtatgtttacatggatgtctccccagcagcttgaaccctggagagcaagaataatctgattttcctgggggccagcacccaaataagcctggcatgcagtggcctcaataaaatgtgactgtattgagtcattttctagggccccagatcccctggtgtcatggacttagtctttgccagcattctgtccatgtgttctctggtcttctctcacaatgctgcatccctgtcccatttttagggtccctgtctatcactggatgctgcagcttctgttcattactgttagtgtatcattcttcatgcctctgtttctgtgatggtctcatcatatgtgaaccatttgacctggcgtattgtgtactagtcaccgtcaccatctctccatatgtatctccctgtatttcgggcccattccctctatgtcaagagtaaatagaggcacagagactgatgagaaacgttcataacatgaaggtaagactcagggagacagagactttgtggaagtatctctgagggagtcccagacacaggcagagagggccacatatcgtgtgccagaggctgagagactgagagggatgacaggcttaggggaaaactcagagaggagagatgcacattcctagtgaaattgcacaggcttccagcatgctggagggaacagaaaaggcatgggcctgaattcaggctgcagagcctgactcctccctgtggctacttttgggacctaagataagtgactttcctgaacctccatgacctcctcatatgtaaaccagggacaggacccaccttgtgtagtgcctgacccaaagcctggccctgcacactgtctctgactcacagcaatcatcagcacctctctttgcctcctacttgctcagtctctgtcacaagaactggatctccatccccttgatgctctgagcatcttcacccatttggtcgttgagacatatctgtccatgtctgtctaaaaggggaggagatgagggagaaaaaagggaatctactcagagcctgtgtgtgctgcccagtctaccaaataatttatatacatctcagtcctcacacaaccatccctgttttatagaggaggaagtggcttagagaatgtaactgaccaaagtcacactgccaggaactggaagcactaggatttgacagcatatccaaatatgtcagcaatttcaataaacatgactgtactcaacaaaccaagtgtaaagacaaattctaacagactgaatttctttttggaccagccatatgttctttagaaaagatacacctaaaacaaggatatgggaagttgagggcaaagggatagaaaaggatatacaaggtaggcatgaaactgaagaaagctgatggagctgcattagtcgcgcaaaacagacattaaggtataaaagcattttaagaatcatggggtcactatgtttttataaaagaaacaatctattaggaagatgtaatagttcaaaaccaggcacataatatgagtcttgtagaacagaatcacagtgagaaactgacgaaaccttaagtgtacttggaagtgctaacacgttctttatgatagaaaacatttgaagaggccgggtgcggtggctcccacctgtaatcccagcactttgggaggccaagacaggcggatcacgaggtcaggagtgcgaggcaagcctgggcaacatagtgaaactgtctacaaaaaatacgaaaattagccagcctgggccgggcacagtggatcacacgtaattccagcactttgggaggccaagacaggcaggtcacgaggtcaggagattgagatcatcctggctaatatggtgtgtaaccccttctctactaaaaatacaaaaaattggccaggcacggtggctcacgcctgtaatcccagcactttgggaggccaaggcaggcggatcacgaggtcaggagttcgagaccagcctgaccagcgtggtgacaccccgtctctactaaaaatacaaaaaattagctggatgtggtggtgtgtacctgtaatcccagctactaaggaggctgaggcaggagaatcgcttgaacccaggaggcggaggttgcggtgagccaagatcacaccattgcgctccagcctgggcaacagagcgagactctgtctcaaaaaaaaaaaaaaaaaaaagccaggcatggcggcacacgcctgtagatccagctaatcaggaggctgaggcaggagaattgcttgaacctgggaggcagaggttgcagtgagccgagattgggtgacttcactccagcctcgacaacagagtgagactctgtctcaaaaaaaaaaaaaaaaaggctgggcacagtggctcacacctgtaatcccagcactttgggacgccgaggtgggtggatcacctgagttcacgagtttgcgaccagcctggccaacatggtgaaaccccgtgtctacaaaaaattagccgggcgtggtggcgggtgcctgtaatcccagctactcaggaggctgaggcaggagaattacttgaacctaggaggcagaggttgcagtgagccgagattgcaccattgcactccagtctgggcaataagagcaaaactccatttcaaaaacaaacaaaaaaaagactcaacccagaattctttttttttttttttttgagatggagtctcgctctgttgcccaggctggagtgcagtggtgtgatctcagctcactgcaagctccgcctcccgtcaacccagaattctatatccagtgcaaacacacttaaagaacgaaggcaaaatacagacatcctcaaatgaaacaaacctaagatatatatttcttgccagcagacttgcctgaaaagaaatgccaaaggaaactcttggtagaagggaaatgataccagagggaaagcgggaactttgggaattaaatgatagtaatagagattgcacaattattttatctttaaaatatggctggaggcggctgggcgcggtggctcacgtctgtaatcccagcactttgggaggctgaggtgggcggatcccaagggcaggagatggagaccatcctggctaacatgttgaaaccccatctctactaaaaatacaaaaaaattagctgggcgtggtggtgggctcctgtaatcccagctacttgggagactgaggcaggagaatggcatgaacctgggaggcagagcttgcagtgagccgagatcacgccactgcactccagcctgggcgacagagcaagactctgtctcaaaaaaaaaaaaaaaaaaagaaaaaaaatgtggctggaggccaggtgcagtgtaatcctagcactttgggaggctgaggtggacagaccacttgagctcaggagtttgagaccaacatggcgaaatactgtctctactaaagatacaaaaaatgaccgggtgcggtggctcacgccagtactttgggaggctgaggcggttgggatcacaaggtcaggagtttgagaccagcctggacagcatggtgaaaccccatctctactaaaaatacaaaaaactagccgggcatgctggtgggtgcctgtagtaccagctactccggaggctgaggcaggagaattgcttgaacctggcaggcggaggttgcagtgagccgagatcacaccactgcactccagcctgggcaacagagtgagattcgggaaaaaaaaaaaaaaagcaaaagcaaacaaacaaaactcaatagtaagaaaacaaacaggccaggcacggtggctcatgcctgtagtcccaacactttggaaggctgaggcaggtggatcacttgaggtcaggagttgaagaccagtgtggccaacatggtgaaaccccctctccactaaatatacaaaaatcagccagtgtggtggcacatgcctgtaatcccagctacacaggaggctgagggagttgaatcgcttgaacctgggcggcggaagttgcagtgagctgaaatcatgccactgcaccccagcctgggcaacagagcatgactctctcaaaaagaaagaaaagagaagaaaaaagaaaagagaagaaaaaagaaaacaacccaatattttaaagtgtgcaaaatatataaacagacatttcatcaaagatgctatatagatggcaactaagcacttggggaaaaaatgcttaacatcatcagacattaaggaaacgcaaggaaaaccactattagatatgtctacatacctattagaatggctaaaataaactttttaaaaaactaagctggggctgggcgtggtggctcacccctgtaatcccagcactttgggaggctgaggcgggtggatcacttgagctcaggagttggagaccagcctggccacccaacaaggtgaaaccccatctctactaaaaacataaaaattagctgggtgtggtggtgggtgcctgtcagcccagctactcaggaggctgaggcacgagaatcacttgaacccaggaggtagaggttgctgtgagccaagatcacgccattgcactccagcctgggcaacaagagcaaaattctgtctcaaaaacaaataaacaagaaaaggttttaaaaattgataaaccactagcaagaaagagagagaggacacatcaggcttgagagaagtgacatcatcatagactgtgcagacattaaaaggcataggcatattaggaactagatattactaaggcagtaaaccagatcactagcaaattcgttgaaaaacacaattcatcaactattggttgataatactgatacgcatcttctgtgtgccagggccttgaggccctgctccaggcagaaactcggcagtggttgggaaggcatcagatgtcagatggcacaagaggactcagagctgagggataatgggaaagaacacagaggaatccagccatttccacagcgtccagctctgctgtgggaggctgggaacagcccagcactaccaccctggactgggaggacaagaccacaaaatgcagcttccctgaacctcctcttggtgatggggttgatgtggtcgaggtagaggtgagtatgtctggagcctcaagcaactgcccatacctgctgggaccaggccgaggtgcccagggagtaagaggcagcatcctggaagagcacagatgaaagaggccctgagaagtgttggttggccaggtgctgtggctcacacctgtaatcccaacactttgggaggctgaggcgggaggatcacttgagcccaagagttcaagaccagcctgggcaacatagtgagactcatctctacaaaaaataaataatagaaagaaaaatgtgagttggccaggcatggtggctcatgcctgtagtcccagctactcaggaggctgaggtgggaggatcacttaaggccaggagttcaagacaagcttgggcaacacagtgagaccctgtctacaaaaaataataattagccagacgtggcgatgcatgcccaggctcccagctacttgggaggctgaggcaggaggatcgcttgagcctgggaggtcaaaactgcagtgagccggactgcaacactgcactccagcctgggtgacagtgtgagaccctgtctcaaaaaagaaaaaagaaaagaaaactgtgctcttaagagccagttctccactcctctacctcaggagccaccccagaacccatccactttgaggacacgagatcccagcccactcagccctgggagtccaaagacattttaaacagagcctctcttcacatttattaattcctgggaggaatgagggaggcttctccagccccccagagaccccggccttgtgctgcaacaggaggggagggagccagtccagaatccccggcacttctgaggacaccaacagcaccctgggcccgcggctgcatcagctttctagacaacgggagaaaagagaaatggtggaggaggggaaatcctatgccctcctcctcgcggaaatcaaggccgacctccctgacgcccccccggaaggaagcgcgtggtcggctgccagccgagacccccatctgcgcctccagctgcagggcctttgctgggcggttcctcgcccgcaattcccccacgagccctggggagacccagcgctaaccaggggtgcccaagggaggagccgggagaggccctcctggaggtgggcacagcccaggcaaacatcagcagacggaaccagcacccgggacccagggaaacgtcacctgccaccaggagctccacagggtcgctgagctccgattcgaaggtgtggggcacccaggagcggtagcggcacctgtagttgccggcgtgctggggccccacgaagatcagctcgaggttcgccgcggccccgggggtgcggaccgtcttcacggccttcgtctcgccctcgcgcagcagctcgaaggtgacgtcggggatgggtccctcgcagcgcaggacggcatctcggcccgccaggaccgccccactccacgtcgcccggagctgaggcctgggagggggtcctgggcggagcgggcgggtggtcgggccaggccacgccccaggccacgccccaggccacaccccaggccacaccccaggccgcgcccgcgcctgcgcctcagccccggcttcatcttccctgtcttgttcctgggcgcagagggctcctccggcgccgccgagctgcgcccgctgccttcacaccccggacatccgcgccacacgtgagtgtccccgcacccctcccccaggaccgtggaagtcccagattcgggcctgctctggggcttctggggtccccagcctcggtcactctgacgggtgaagggaagaagaaatgatggagaaaacggtgctccttcatggagggaccaaaaaaggacatacaatctatgtcaatagatgagggttttccctccataagtttaactttaaaagtgtatttaaggtgccgggcgcagtggctcacacctgtaatctcagcactttgagaggccgaggcaggcggattgcctgagctcaggagttccagaccagcctgggtaacacggtgaaaccccgtctctactaaaatacaaaaaattagccgggcgtggcagcgtgcgcctgtaatcccagctactcgggaggtggaggcaggaaaattgcttgaacctgggaggcagaggtttcagtgagccaagattgcgccactgcactccagcccgggtgacagagtgacactccgtctcaaaaacaaacaaacaaaacaaaactgtaaggaatcaaatgttacaaaatcctggaagattttggtaatgctgttgataatttcagggaaattaatgaagtacatgtaagtgcttgatttaaatgtgtattttattcaatagtttgagtatcttgccatggaagatactagcccagcctagcagaaaagtgcaatatgtataatatactttcgcattttaaaagttatattccctatccattttgaaatgctagccaaactacatgaagttatttgcaattaattgtaagctaatcaggaattttgaaagcttgattggattaacaaactataatgttgaaatttggtaaaatcataatgttaatttttactgtgaaacgttttcttgtaagatagatatacacatcctagtttaattttgtgtcttagtgtggatttacaaatttactacagttattctgagcccaggaacccaatcagatttcaggccagtttgatactggctgttcttaattctaacaggagagtaggacatcatactaaatgttatgtcagtgggactgtgttgtctttggagcttagtaaattaatcattttcttcagactttaaggagagtgataaataaaatttggagtcataggatatagatgtacaatttaaagattaaacattttttttttttttgagatggagttttgctcttgttgcccaggctggaatgcagtggcatgacctggactcactgcaaactccacctcccgggttaaagcaattctcctgcctcagcctcccaagtggctgggattacaggcatgtgccaccacagctggctaattttgtatttttagtagagacagggtttctccatgttggccaggctgctcttgaactcctgattttgtgatccacccgccttggcctcccaaagtgctgtgattacaggcgtgagccaccttgcctggccaagattaaacatttttcatcaattgtggatggtggcttataacactgcaagaataggctgggcatggtgactcacaagtgtaatcccagcactttgggaggcagaggcgggcagatcacaaggtcaggaggtcaagaccagcccagccaacatagcaaaacccggtctctactaaaaatacgaaaattaggtgggcatggtggcatgcgcctctaataccagctactcaggaggctgaggcaggagaactgcctgaacccagaaggcgaaagttgcagtgagctgagactgcaccactgcactccggcctgcaagaataaaagtaagttatccaaaaaaaaaacaaaaaggagaagaaaagggaggaatgaaggagagagatggggttggggggcagagatgagagagagagaaagaagaaaaaagaagaaagaaaagagagaaagaaggaaggaagaaagaaagaaggaaagagaaagaaagaaagaggaaggaaggcaggaaagaaaagaaagaaagtgaaagaaaagagaaaacggtgctcccagcaaagggtacgacctcaagatctggaggtcagacctgtgccctcacgctctgctgggctctgagtcctggagacgtcgatgaggaaatcagagggacaaacagagctggggacggcggggatggggagaaggacacatcagccgtgcgcctgcgggaccggggccggggcggggggtccagtatgacgactgacatggccagtaataaaacaaggcagccacagagctgcagggatctgaacaagaaaacctggggccagcctccctgctgccgaccaccacgctacacgtgacctacgggcttgcgtccgtgggaaataagccgaaattccaggcgtccccagaccctcgaccaccgatcgcctgctccccgccggggtaggcgatgggggctgaaccaaggcccagagcgccgccgtcggacgcccaaggaaagaggggaaagacaggaggccccgaggggcactgaacccgcgcccgccctcgctggtgccccgccagctcaccgtccacgtgcagctccaagcgctcgctgggcgcggagcccccgaaaggcggcttcaggtccacgtagacgcagctgtagttggcggagtcagccacggaaatgttgtgcagctcgaagagcgcctcggtcccagcggggctctggaaacggtgcacgcggcgcccgcccctgtcctcgcgcaccagggcgaagcgcgcgccctccaggggcgccaggcaccgcagccgcaaggccctgccggactccggctccggggagaactccggcgcgggcagcgtctctgcggagcagcacacgggctgacccgggcgcccagcggctggctcggccctaacgcgtggtctggcctcgcgctctttgccttggctgagtcttctgcccgcaatgacctggccagcttcctccctcgcctcctccgggcccgccccacctttgcatcccagtccttggatatctcacacgcaccctttcactgtttcttagtaatttgtttgtctacagacacagacgggaagcggggacggggacatgttttgtgcatggcttgatgcctggtgcacgatgccgctcagtagtggatttgctccacgagcgtcttctgagcaccgccccaatgcccgccccacggaggggcccctgtggtccgctgggcatggggttcgctgtccggtgctcagagtttgctaaataccatcaggtccaaggcaagcgagcggaggagctgcctcagcagaggccctcagtgctcacctagacctggcagctgggatgggacctgccaggtggtgccccctgtggcctgggccagacctgttcacccagttattccctgtggggcctgaaggttgtcacgctcatcatcatatttgcagtttaggaccctgaatcggcgggtgggcggataaagttggtattggaccctggcccagagcactgcacttccccagactctacacctggtactgctcctgctccccagggacccagccgcgtccctgtccctgctggccccggctcaccatcgctcagaatcagctcgaccggcgcgctgtccccggaccagccgttttggttgtcatgcagccggtagcggcaggtgtagtgacctccatcccccagggccaccgcgttcaggtgaaagaagatgcgatctgggctggtgctgctcctgggtaccagcagctctttctccccgcgccgtagctggaagtccactccactcaggggagccacgcaggtgagggtcaccttgttgccagggtgcaggacctgggaggactctccatggtgcatcagcacaggcggtggtggtgcagctgcaatgcaggcagcattactaggctgccccatccctggagctgccctctgcccagtccccagacctctgccctccgggtggcaatcccaggaacacccttccattcttttttttttttttttttgaaacggagtttcgctcttgttgcccaggctggagtgcagtggcgccactcagctcactgcaagctctgcctcccaggttcaagggattctcctgcctcagcctcctgagtagctggtactacaggcacctgccaccacacctggctaatttttgtatttttagtagagacggggtttcgtcatgttgggtagactggtctcgatctcttgacctcatgatccgctggcctcagcctcccaaagtgctgggattataggcgtgagccaccgcacccggcctcacccttccattctttgggcatcctctgcccaaactcctttgcaaccatcagacccaggcaaccgtgtggccagcttcctggacctggtcctgggcaaggacattcagcatggaggtcaggatgaatgtggtcatgccccctgtatcctcctcccccagcagcccccagagatggttcccacagtcaccgagctcctcaatggtcacagtagcgctgggctcagagagggcgccttccccatcggtccggtagctgcagctgtagttgccaggctgatggactggaaaggtggcctccacatcctcctgggcctcaggcacctccagaaactcatggtcgccctcccgcctcagcagaaaagtcacaccccgcagcacacctcggcacactgctgttgttttcaggccgggggtgatccaggacactggcgccatcgagagccagggagcaggcaaggactctgtgggtggggtggagttgaagagtgcttctgcataacaggagacgtgggaagcccagcagaacctgggccccacactcataagactgtgaaggagacagggatggagggcattgctgggaaaaggcaggcaggcaccagtggaaacaaggcatacggcaagagaaaaagagtgtgtgggagctgtacggcatgccgggcctgctggggacacaaccatgtattccttacaacacagacatcatccccatttgacagatgggaagattggggcttggggctcagagacatcgggtgacttggaggaagggagaccccccagtcaacaacctacccactgcctcctggcccccaattcatgccccggctcacttggccctgtcagctccaggagcttgctcagctgggtccatcctgtggacaagcccgagcggcagcggtagcggccctgggtgtcacccgtcagcaggaactggtgcttgatggcaggtgagtcaaggtgcacaggctcctgggccaccccattcttgaacagctggaagtctggagtctccaggtgggcctggcacgtcagcgtcacattggccaagggtttcagcagtgattcggactctgcccacaggctgggctgcgtctcataaactgcaaggggtggctgggatcagctcagtgccacagagacagggctcccccccggcctgggcccaccattcccagacctcacccctgcactcacatatggctgcttctgtcactgggccccaggtgacacctgcggagacagcccccgtaaggctcctgttcccgccccctcccgccccagggacccagaccccaggaggcctcaccccacagcaagagaaagaccacgagcatggacatgatggtcgcgctcactccggtgcagtgagtgtctggggtgagcgtctgcagcaatgaggccccaagggagggcggtggggtggctcgggcactgacctcttcccgtgtttgtccttcccggaaggcgggggcagggcccccatggggtcagggcaaagggtgaacttctgaggcctcaggatgcccagcaacaattataatcaataatcatgtatgattaataaactaaatcaagagtgataaaatgatgttaaaaccacctcatcctcatttcagtgatggatcctagaacctgttctagaaggagacgctgagttctccccactctacctggagctgctgaggtcaagtggagagtgccggggctgaagcccagcgagcccctccctgtcacaccacactgcacatgtgacaccaaaggtggggttcacctcttttcagactttctgcggttgccctcacatgggctgtctggaggtgcaccctcactcttcctgaggactgtggttccttctccatcactggttcattctgcatggtgtgacccaccacggctctggagtcggatttccacccaggtcattcagctgagacctgcgcttcccaggcctacccgtgacatgtgctcagttacctgagctgctggtggtcactcatgtggctatagcctgctgcctggaggccaggcctcccgcttcccctgcctccccctctcctcaccacagcctgttgggatggaacaggacaggggtgagaccgtggtgctttcacactcagcctccatggacatcctgtcattcccacccggggaggtctggtccccaccctgggtgtcccagcctagctccgctacgagtgtgagggcccagggcaaccgcctagccctcatctgccccctgcactgcatcctccccactcattcattccacaggcatttattgagcatctactgtgtgccagatgcaaagaagacagtgggataactgggcaaggagcattccaggcagagggaacagccagtgcaaacatgggagatgcgggtgcagtgagaaggagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccagctctgagattctgcaacatccacttttgctctctgagccttgcaaaacctgcacaatcagtccctaacttatatcccctctgtttgaaatacctagtgtggtttctatttcctgacttgactctgactggtgtggtacttggtataaagaaggttccctggccaggtgcggtggctcacgcctataatcccaacgctttgggaggctgaggcaggaggatcacttgagcccaggagttttgagacccgcctaggcaacatggtgagacactgtccttacaaaaaattttaaaattagccaggtgtagtgacgcaagtctgtcatcccagctgcttgggaggctgaggtgggaggatcacctgagcctaagaagtcgcggctgcaataaacagtgattgcaccactgcactccagcctgggtgacagagtgaaaccctgccccctcccccaaaaaagaaaagtcccatgaaacagacctacacaggtgagattctgagattgatctggttctgacctcggtcaggaatgcagtgctgagcttcttgccaacagaatatgagacactagaaagccatagcatgcggtttcatcatgtttaactgtcacctgtggttgcctgagatgaagtgctgactgaagcgagcaccttaggagacacagtggccactgcactgagcagctggtagcagcagtggtgaccatgtggactggggggtgggttggctgcttttgacagtgccagagaactcaaagaaatagccacacctgtcggagaccccagttcttgcccacctctgcatggacgaacctctcgccgaagtggagcctgccgccctccctggggtaagagcccatcctacatgtccccagacaggcctgggtggccggtggactatcgtcaaagggactgtgcagccagggttctccacacccaaggccgcccctgcactcccagcaggagggcgcccgcaccggcggcccgaaaaagtctgggccagcagacagcgcactcacgcccgagaccccgcaatgccgtgtgtccgcgacctcccgctcagggcgtcctcgggtcagggcgcagcgcggcccccgtgccgcttctggtgctcgttgaggttgcaacggtggctgaaaggcttcccgcactcgccgcaagcgtagggcctctcgcccgtgtgcgtgcgccggtggcttaagagctccgacttgcgcacgaaggccttgctgcagtgggcgcagacgaacggcctctcgccagagtgcaggcgctggtgctggcgcagctcggagctgccgcggaaggccttgccgcattctgcgcaggcgaagggtcgctctcccgtgtgcgaaagccggtggtgcgccaggccggaactgccgcggaaggccttgccgcagtcggcgcaggcgaagggcttggcgcccgagtgcgtgcgccggtggctcagtaggttggagcgctggctgaaggccttgccgcactgggcgcacgcatgaggcttctcgcccgtgtgcacgcgccggtgctccgccaggtaggagcccatgacgaaagcctggccgcactcggcgcactcgaagggccgctcaccagtgtgcgtgcgctggtgctgcaggagctgcgagctctcgcggaaagcctttccgcactcggcgcaggggaagggcttctcgctgctgtgcgtgcgccggtgctgccgcagccccgccacacgcacgaaggccttgccgcagtcgggacaggcgtgtggccgtgcgcccgcgtggatcttcaggtgctcggccaggttggagctctggctgaaggccttgccacagtcccggcaggcgtgcggccgcgcgcccgtgtgcacgcgccggtgctccaggaaattggagttccagctgaaggccttgccgcactccgggcactcgtagggcttctcgcccgtgtgcgtgcgtcggtgctgcaccagcgtggtgcttcggccgaaggacttgccgcagtccgggcagcggaagggcttcaggccgctgtgtgtctcctggtggtggatgagctgcgagtgcgcgcggaaggccttgccgcactccctgcaagcgtagggcttctcgccgctgtggatgcgctggtgctggctgaggttggagctccaggcgaaggccttgccgcactcggggcacgtgtacggcttctcgcctgtgtgcacgcgccgatgctgcagcaagtaagagccctggctgaacgccttgccgcactccccgcaccggcagcccggctcctctgggagaggcgaagggcgcaacgcccggtctgcaggctcgctcctgggcccagccccgtcccgcccaccgtctgcggggcccagctccctgccggggcctccctgttcgtccgccgcccccagtgtggcttgctgccgctggccgtcccctgcctccctcggaacctccgtggagttttcccaggccccccagcctccagacacagccccctcagagaggcccctcgtggcagtcttcacattgcagaggacctggccttcctctggggccacctgcagggtccaccctcttggggactccatctcgcgcctgtgacctaaaacaggagagaaaaggcaagtaccttagagaatacaaagaacaccagacagagggcctgagggggacacgacggtgggtgggctgtcatcccccactcttctcctccaggtccctggatgcccaatgccctctggagcctggagcaggaaggccagcaggcgggctagacactcgggggatgggccagcactctgggcctgcctgacagggccacgtgcacatccccacacccggcccggcccagcaggaggggagggggcgccagcatcgcagaaggactcaaagttgcccacgcacctgcactggccctactgtggcaccactctcctctccttgcttcacagggtggggccccaagtgtcaagaaggtggagactccagtttgtgaggaacacgatggacccgtctccattcctgaaggctggaggacaccgcctgacccaaacacagctatgtctgcctcacccactccaccctggccggatccctgggtagtcccctccacacagtatgggcagcatgtccaggctggaggatctcagtggctgttacccaggcaatgtccacaccaggcctctgtgcaggtcagaccaggtggtccaaggcatggggtggctgtgcagcccagatccctgagagagagagaggccaagggtgggagggcctccttggtcctaaggccatgcctgcctgtccagccgatccttcccacagcgaagtctctacagcgagcaaaacccatcctcatttgccctgagcaccttatcatccttgtgtagtctccagccccgctgccaaggcagggcagggacaagtgtgtagatggtgccatacctggaggtggggcctggaaggggcccaggggagcctcttgctcctctccctcctctgtcctggggaccagctcctcttggggcctgggggctggcacctggggacaggaaggcagcagggcagggtgaggtgttcagcctagcagatctgagaaaacaaggggcatgcggtggcatgacccacccttctctgcaccttcagttctcaggacacaatgcggagcacacaggtgtggactggagatctctgactctgccgtccaagccaagaccaccaaactcccacctgtcaccatcactttcccacagcccccaggccctctcagccaccaacccacgactggccccagtgctggctcagctggggtcgtgagcaggggaagcacacccagcccccagaccagcccccactcatctggagtcctggcccagctgactcctgctgtagccgctctgccagggcagtggcctcctcagggctgcctagccactgctcctgcgtgtaggcctggatctctgggagcagtgtgcccaataactgctccagcaccaagagctccagcatctgctccttggagcaggcctcaggcatcagccactggcaacacagctcacgcagctgagccagggcccctcggggccctgctgccttctcatagcagaacccccagaagcactggccagggctcttggagctgggctcacccaccatcagttccagtggactcgggaagacctggggggccagggctgatgcctcactcatctgggcagccatcctgcccctttcctgggaggggagtgcagctgcatggcccagggtactttctctgcagctggaaacacaaaggtgagcctgtgagcacagcaaggccacgaaggtcccctccttgggaccacctgagactgagtaaaaatggaagaatgggggtatcggcgtttctggcccccagtgtcagcatctttgcccacctgtgtgtccaggtgcctgagggacacactgaggtgccatggctgcttgtaccatcccttccccccgcctccccgcttttcttgagggtccctgccctgccctgtctccttggcacccttcatcccacacacagaacaactaagacagagactgtgaacaggacacccagagtcagaccagcagatgggtcctgtttgtcccctccaggaagtgttttaaaaatttaagttaggccaagtgcggtggctgacggctgtagtcctagcactttgggaggccgaggtgggtggatcacgaggtcagcaattccaagaccagcctggccaacatggtgaaaccccgtctctactaaaaatacaaaaattagccaggcgtggtggcaggcgcctgtaatcccagctactcgggaggctgaggcagagaactgcttgaacccgggaggtggaggttgcagtgagccgagatcgcgccactgcactccagcctgggtgacaaagtgagactctgtctcaaaaaaaaaaaaaagagaataaatactgatacatactacaagatggatgaatcttgaaaatattatgctaagtgtaaatgaaaaaattcagacacaaaagacttcatattatgttattccatttatgtgaaatgtccagaacagataagtctgtaagagacagaaagtagatcagcggttgccaggatctgcagggaagagagaaatgggagatacagccgtgggagtgatgaaaatattctggaattagtggtgatgactgtgcaacactgaatataccaaaaaccactgaattacacactttaaaaggatgaattgtatggtatttatgttttttaaaaaagttaccacccaatcccaaaagcttaaaaactgtatgactccatttctttttctttttctttttttttttcttttgacagggtctggctctgtcatccaggctagggtgcagtggtgcaatctcatctcccaggctcaagccatcttcccacctcagcctccgaaggagctgggacatcaagtgcgtgccaccatacccagctaatttttttattttttatttttctatttttgagacggagtttcgctctttcacccaggctggaatgaagtggcgcaatctcggctcactgcaacctctgcccccaggattcaagcgattctcctgcctcagcctccccagtagctgggattacagatgcctgccatcaggcctggcttattttattttattttattttattttttagtagagatggggtttcaccatgttggccaggctggtcccgaactctttttttttttttttttttttttttttttttttgagaagagtcttgctctgtcgcccaggctggagtccagtggcgctatcctggctcactgcaagctctgcctcccgggttcataccattctcctgcctcagcctcccaagtagctgggactacaggcgcctgccaccatgcccggctaatttttttatatttttggtagagccggggtttcaccgtgttagccaggatggtctcgatctcctgacctcgtgatccgcccgcctcagcctcccaaagtgctgggattacaggcgtgagccacggcacccggccggtgggccggtcctgaactcttgacctcagatggtccacccgcctcggcctcccaaagtgctagtattacaggcgcgagacacctcgcccagcctatgcaacattcgtaaaatgacaaaatggtagaaatgagaacagattactagttgacaaaaagaggttaacggggagcagaggtaggagggaagggtatgcggctctgtaagggcaacacggggatccttcgtgatggaaatattctgcatctcagttgtgatattgtactctagtttttctttctcttctctttttttgagacagagtctcgctctgttgcccaggttggagtgcagtggcgtgatgtgggctcaccgcgacctccgcctcctgggtacaagcgattctcctgcctgagactcccgagtagctgggattacaggcaccagcctccacacccgcctaatttttgtgttttcagtacagatggggtttcaccatgttgctcaggctggtctttaactcctgagctcaagggatccacccgccttggcctcccaaagtgctgggattacagacatgagccaccgcacctggcctctagtttttcaagatgccacctttaggggaattgggtaaagcgtacatagggtatgcattacttgttactgcatgtgaatttataattacctcaaatcaaaagttaaattttaaaaaaacgacatctgatttcaataaaaatccatatttgtgtattgaagtatcagaaatccgggtcccccaagggcccatgtttcttaaggcggagccaggcaccgctgcccctccatcctgtggtgtgcgaccccgacccgccagcccccagccgcatctatcagggctgccgtcctgagtccgtcctcgtcgtgggatagcatgtgagccccgtaaggtccttcctgtcggcctcactgctccagcctccccgacgtcctcacgtccacgctgcgtgccctttctgagcctcaacgcctcctcctcacctcgacatgatcagagccacctcccgcgtcagtcccagcgcccacgcccccaacaacgggcacttgtccgaccagtcacgggtacttgtgtctcccccacaacccccaaggcctaggctggacaaacaaatacggagtggataaaggggaggaagctgcggccaggtggcgcgaggcctgtgcgggcagctccggaggctgggaggcgagcccagcctggtgagctccgaaactacccggggctggggactgatgaacgaataaatgaatgtgggaagaaatgatggcgcggcagggcatgagtgaatgagtgaaagaataaacgagcaggaggaacgatgccacagaactgatcgccataaggctcgcgttcaccgagagaacagcaaacgggagccatttccgtcccgaccacggtcgcctctggcccgtgcagggccacttccgggccgctctggacggcgcggaggcctatctctcggtggtcccagagggcccagctcagggccgaggcccgtcctgccccgcgcggcgggagtggttggagccggagggcggatctgtgcctggccgagggtgtccgtcggcgtcactcaccgtcctcggcccgcctctgcgtccactaggagcggcctgaaagaggcccgcacgcgggctcgagccgcgtggaatggtaggagggcgggcaccgggtctcctgggggcgcggttgcattcggcagagcggcccaaggcgtcgcgtttctccccactgcgcctgcgtaactatgccgcggctgcgggcgcgcgccttctggttcccatggggacggcgccacagccaagctactcgggcgtcctgcgttgccatggatgcgctccgccccttcctgcacccggccagcctctgcggcacacacccaacagctacacaggcgcctggggctgcccgggtcgcggacgcaagtcgggccaacgtagcttctccctggcggtcctcctccggccccaggccgtctttaccacccctggaaccttgctgagttgacgccactgagctgcgtctcacacccacgcgctgtggaacacccaccaagctggaatccacgcggtttttaaaatagagtcgggggccgggcgcggtgactcacgcctgtaatcccagcactttgggaggtcgaggcgggcggatcacgaggtcaggagatcgagaccatcctggctaacacggagaaaccccgtctctactaaaaatacaaaaaattagccgggcgtggtggcgggcgcctgtagtcccagctactcgggaggctgaggcaggagaatcgcttgaacctgggaggcggagcttgcagtgagccgagatcgcgacactgcactccagcctggggcgacagaacgagactccgtctcaaaaaaaaaaaaaaaaaattgagtcgggatctcagaagctaagcagggtcgggcctggttagtacttgggagaccgtctgggaacaccgagtgctgttggctaaaataaataaataaaccgggcgcggtggctcacgcctgtaatcccagaactttgggaggccgaggcgggcagatcacgaggtcaggagttcgagaccagcctgaccaacatggtgaaaccccgtctctactgaaaatacaaaaattaggcttgttggcgtgtgcctataatcccagctactcgggaggctgaggcaggagaatcgcttgaaccggggaggcagaagttacagtgagctgaggtcgtgccactgcacactccagcctgggtgacagagcaagactccgtctcaaaaaacaacatagaccagatgctgtaagctaaaataaatgaatagctagagacggggtctcgctatatggcccaggctggtcttgaacttctgggctcaagtgatcctcccaccttggcctcccaaagtgctaggattacagacccgagccactgcacccggcctccacgagctctttttgtaccaatttttcccaatttgtactagggagctctcacctcagcccaggtggtttgggcaggtgtgggtacatggcccaggtccacagcacagggcagtccatccctctggccctggcagtggtcactttggacctgtgagcatcgtgggacttctctctgaactgttagggcctctatctgctttgaacctgaggctgtgagcatctgtcagctggggcagctgcagccttcttgccccgctgaaggatgaatctgttaagagaatggagtccatacagaaaagcagaactgagggatggtgtgttagtttcctgtggttatgcagcaaattaccacaaatttggtggcttaaaacagcagaaatatattcccgcccagttctggggaccagaagtctaacatcgatatgactgagctgaaacaagatgttgacagggctgagctccctctggaagctctaacgtagaacctttccttgcctttttcagcacctagagctgcattccatgtattccttggcttttcgtcctttcctccatcatcaagtaactggtaacatcttactatttctctcattaagttaaaatatttaacatatgttcattttatcttatttgcatgagagtcaattttagctttaaaaaaatttttattggccgggtggggtggctcaggcctgtaatcccagcaatttgggaggtggaggtgggcggatcacctgaggtcaggagttcgagaccagcctgaccaacatggtgaaaccccgtctttactaaaaatacaaaaattagccgtgtgtggtacatacctgtaatcccagctacttgggagactgaggcaggagaatcgcatgaacctgggaggcagaggttgcagtgagctgagatcatgccactgcactccaacctgggcaacagagcgagactccgtctcaagaaaaaaaaaagggggggaggcctgggcgcagtggctcacgcctgtaatcccaacacttgggaggctgaggcggggggatcacgaggtcaagagatcgagaccatcctagccaacatggtgaaaccctgtctctaccaaaaatacaaaaattagccaggcgtggtggtgtgcgcctgtagtcttggatcacccatgctggaagaattcagctgcccggacatgaggaaactcaggtctgcagtcctgtggagaggcagtggagcagtgcatactccaagcccagtggggccttcagatgattgcagtcttggctgccatgttgacttcaacctcgtgagaggccttgagccagaaccacaggccaagctggtcacgaattccccacccccagaaaatgtttgcgatgataaatgtttatttatttatttatttatttttgagaaagtcttgctctctcacctaggctggagtgcagcggcgcgatctcagctcattgcaacctctgcctcccaggttcaagggattcttgtgcctcagcctcccaagtagctgggattacaggcacatgccaccatgcccggctaatttttgtatttttagtagaaacggggttttgccatgttgcccaggctgttctggaactcctgagctcaagccatccgcccaactcagcctcccaaagcactgggattacaggcctgagccaccacgcttggcctggagcatgcccttgatgtgcaaactaaccaatccagagcctcacccctctacctggtccacacaccgcaggagacagtattcctctgtcttaatcatccccggaacaggagccaagcagctggggaacactcccacagctgaaagcccacaggaattactccagctagccagtcctgtgctgtaggctctgctctgccttgcttttcccttggaaaccccagtaaaggctctggcttagagctcccccttggtcctgcccctgctgcctctgacagatgctggtgcttttctcatgtgtccttccttgtgggccgtgcctcctgtttccaggatctgtgagcatgatgaactttgttttcctgagcttgtcctgtgtctcctcttctggccacacctgactgagcagaacataaaagcgacagaacaccaggagggctgctgcttggggaaattgtgtgagaagagtcctgggggactaggggcagggcaagcactgctctccctctcctggaggctggggagagcatcaaggagactaccaggtaggaggaaccatgggcagggcctccctcatcaggatgctttccccacaacagagggatttaagcccctggtgggtgagtcctggattaaccaagacctgagccttttggggggtgcagaggacagaggacactgtgaggtgagtttctcctgggtggattccccaggggcctctgaggctggtttcaggccctgccctttggctgccccactggaagctctgagcatctacccttcagggacgctttccctggtctgaccttggcaagggcaaataagaggtactccatggagggtcaccaaggtctggggcgtaaacggtgcccatctgcacagtagcatgagggccacagagtgtggtaaatgtcagtgaccatcacatgcggtccccagtgtggctgcaggggccacttaggattcttctgttcggggtcccaggccacacttggggaaccctattggaagcaacaaggtctaggccctgagggcccagggctctgccctctccagggctctagctgagccacgtgcaagcatcctcccggccctcccagctggtgtgaggaggaaaccacagccaaagggcaaggtgctccacacagatatgtccctagtcagcctgccccattcggcctctggagtgggagccttgggtctgtctggaaccagtgtggatgaaatgcagggagaaactggaatcatagccatggacagccactcacatagctgggaagaggcatgctgtggtagatcccggtggactctcacctctgcggtgctggggacgttgtgccgacacctcaggcacccacttccactcacaccgcggaggcttggggagatgcggttcagtctggagtccagcggggggcgacaataaaggcgaccccgctcgtcagtcagaccagggcaagcttgccagggcttcacacttcaccaaagggaaccctttctgccgcgactaccgagctgccagggccgggacaggcagaagcctgccccgaggtctcacctctggagggttacgagctgtgccaggccggctacggtagagggtgtgcaaataccccgcggtcccaaggctcctgaagctgcctaagggatatgagagaccctaggttcgaatcctgcctccatcgtcttatgttcgtgcctcaggagagtcactttgccccgtttcctcgcataccagagagcccagtaacacgctccgcggctctgcggagaaaaagaccctagagatcgtggacacagcgtctgggccgtatcagcgcccactcgagattattactgcttatgcctgcaaccggatgctgtgcgcccggttagaaaaggtcaaataaaactcgagttaggggaagcctgtggacgccatgtgtacaaagtgaagtttaatcaaagttacaaacgttggtgggttttccgggacaaaggcccctcctcgacgcagggttcgcttgggcgacgcgtcgactctcggctccctgcagtcaaggcgcggcgcggcccccgtgccgcttccggtgctcgttgaggttggagcgttggctgaaggcgcggccgcaatctccgcacgcgtagggccgctcgcccgtgtgcgtgcgcaggtggcgcaccaggctgcagttgcgcacgaaggccttgccgcagtcgcggcagatgtagggcttctcgcccgagtgcaggcgctcgtgctggcgcagctcggagcagccgcggaaggtctttccgcactcggagcagccatagggccgctcgccggtgtgcgcgcgctggtgttgcaccaggcccgagcggcccttgaaggccttttcgcacagtgggcacgcgtagggcttggcgctgctgtgagtgcgctggtgccggctcaggttcgagcgctggttgaaggccttgccgcactcggggcacgcgtagggcttctcgccggtgtgcacgcgccggtgctccacgaggtgcgagaacagcccgaaggccttggcgcagtcggcgcactcgtacggcttctccccggctcccgacccccgtcggggactccgctcgctgtagtccccgcagggcgggcaccccagccggaaggcgcgccgcgccaggacggggccacgccggtggcgctcggccgagtgcgtcttctggtggcggtacaggccggagcagcgcacgaaggccttgccgcactcggcgcactcgtagggccgctcgcccgtgtggatgcgctggtgctgcagcaggctggaggtgcgcgtgaaggccttgccgcactcgtcgcaagcgtacagtcgctgggccggggggtcggggacaatagggcgaggtcgcgaggtttggccgcactcaggacacactgggggactcttgcccgcctgctgctgctggttggggcggaagcgcttcccgcaccgggcacacggacggggctcctccgtcgcctgcagcctctcctgggggatccgcagggccctccacgcaaaggcctcgccgcacgcgcaagcccggggctgctccaccaaggggttcctcccgcgggaggtcggctttggggtcctcgggcaggtcggagcgccagtccctggttggcacggccaacagtccgtgtggacctcacacagttgagtccgggggtggttctggatccgctccggacaggggtcacacacgggtggcgtctccccagcgggcgccccgcgatgccacgccaggcaggagttcctgctgcagtccccgccacgcgctgggctcctacaggggccctcccgggcttgcagcccctcggggataaccagctcagggttctgagaagaggtggggccgcacggctcccgcacgaggggtctggtcccggcgctgtgccgggtccccgggccggggctcaccccgaggctgcagccccgggagcccccgcctgggggagtcgtcctaccgcccgccgctccacgcaggtcccccttttgagtggggcggctcccagctcggtcctcttcgaggggcctcggctcctcgggcctcttctcccgggccccggaggcaccctgggcatcggccttggggagtcctccctgcccagccttctgggctggagcctccatcctggggcgcagagttctggttgtaggatctggaagagcagagaagaaatggaggttggcggttcccaggaggagagaagtggagaactgggccaacgagcgaccaccccacagctggcacctactgggcggcccccagctctctgcagatgcgaaagggtaaatggagtgacataggcagcccgtcctgcccctcttcaaattgtcaccacccagaccccagagaacagcttcccaggctctgcctgcccgccatcaccgttcctccccaacactagctcctaaaacactgtgcccctggctaaggccctccctggtcccccttccccaagcaacagggactcccccgttgctcagctgccagctccccaaaatctcacttactcctgccctccgtttctcagtggcaagccgacactccgggtcctcctggctccattcactgccattgtccatgtcttctgagaggtgtgaggtgagactcacctgacagctgagagcctggccgggagatccacgctgcagaggccaatgctggacttcccctcccctcttcaaccaggtaacggtggtgctctcaaggctggcagcctcatctacaaaatgggtatgataacggtaagtataaccagctgagtagggagacaggcagcccagatcattcaagcaagtgtgaacattagcaacgcctggcgcctgctattactattttaaaattacactgtggctgtattagttatctattgttaaagctgctttaacaaactgccaccccatagtggcttgagacagtgcaaacttgttatctcagagttctggaggtcgtaagtcctaagtgaaggtttcagtagtgtgggttccttccagaagctcttggggaggacgtttgctgaccatttccagcttctaggtgccacctacttttctttcttccatcttcaagccagcagtaagacatgttcatctctctctttctgggtttgttgtcaaatctccttatactccttataggattctgacccttctgcctcttgtgatcacactaggccaaccacacataatccaggaatctccccatctcaagatccaaaacttcatcacactcagttcttttgccttgtgaagtaacatagtcagaggttctaggaaacaggacgtgcagatctttcagggggccattattctgcttacaacagtggactttgctgagatacacacacgtgcatatataaatattcatctcctaagcaagcaattgaatagcaagtgaaaacaaaggacggccgggcacggtagctcacgcctgtaatcccagcactttgggaggccgaggcagatggatcacctgaggtcaggagtttgagaccagcctgaccaacatagagaaaccccgtctctactaaaaatacaaaattagccaggcatggtggtgcgtgcctgtaatcccagctactcaggaggctaaagcaagagaatcacttgaacccgggagatggaggttgcagttagccgagatcgcaccattgcactccagcctgggcaacaaaagtgaaactctttcaaaaaaagaaaaggaaaaaaagaaaagagagagagagggagggaggggtgaaggccggggggggggagccgggcgcggtggctcacgcctgtaatcccagcactttgggaggcctaggtgggcagatcacgaggtcaggagatcgataccatcctggctaacacggtgaaaccccgtctctactaaaaatacaaaaaattagctgggcgtggtggcgggcgcctgtagtcccagctactcgggaggctgcggcaggagactggtgtgaacccgggaggcggagcttgcagtgagccgagatcacgccactgcactccagcctgggcgacagaacgagactctgtctcaaaaaaaaaaaaaaaaaaattgccgggcatggtgatgcatgcctgtagtcccagctactcaggaggctaaggcaggagaatcacttgaacctgtgaggtggaggatgcagtaagctgggattgggccactgccctccagcctgggcgacagagcgagactccgtctcaaaaataaataaataaataaatattttcctcattgtgatgtgatgtgaggtttctcagcctcacacgtgataagtgcacaatcctcctgtcccctccctagatctcattgtttccagaacaaagatggatctgtccagcacagcctttagactctgaatcccggatggctaacatcatatgcagagcgtgagatggacacacttgtggcaccctcgtaaatcactgcttcactcggcacaggagctcagattcttctccttttgtcctgtgttccctattctgtgcaaggcagatatcctcttattttattttatttattttggtgttttttgagacagaggctctctctgtcacccaggctgcagtgcagtggcgccatctcagctcactgcaacctccgcctgctgggttcaagcaattctcctgcctcagcctcctgagtagctgggattacaggtgcctgccaccatgtctggctaattttttgtatttttagtagagatggggtttcaccatgctggccaggctggtcttgaactcctgaccttgtgatctgcccacctcggcctcccaaagcgctgggattacaggcgtgagccaccgtacctggccagatatccctttatttatttgtttgtttgtttgtttatttttatttatttagagacagggtttcactcttgttgcccaggctggaatgaagtggcacaatctcagctcaccgcaacctccgcctcctgggttcaagcaattctcctgcctaagcctcctgagtagctgggattataggcattcaccaccaagcccggctaattttgtatttttttcttagtagagccggggtttcaccatgttcacggggctggtcttgaactcctgacttcaggtgatccacccgtctcggcctccccaagtgctgggattataggcgtgagtcaccgcacccagccgatatccatttattaaatgtctcagagggccgggtgtggtggctcatgcctgtaatcccaacacttggggagtccggggggggcggatcacgaggtcaagagatcgagaccatccttgccaacatggtgagacgtccttgacctgatgtcactttttctgtctgttttgcagatttctaacaggcagttgccctgggccacctggtggcctgaaataacttgaccgggaactaaaaggactcacgaagcatttaaccaagactctacatgttgacttttcagccaaggacacttcagagcgactggctgcagttctccaaaggaagctgctgccagttgcccctggggggttatttccttcttggacatcatgaccacaatggcagaaatgcattgatggccagcactctggggatgaatgtttttgagtggaaatgaaacataccaaactggttaaagacaaaaatgcagagttggacaagttctgcaggtcacgaaaggcctttgaagcagccaggcccggttcctgctctgctgtatgggaggctgctggcctgagctggagagcagaaaggcccagtgccaagggttcagcaagtaccagtcccaggccaggcatttgctaataagccagggtgacagtaaggacaaggggactctggtgtgatgtgaggtttctcagcctcacttgtcacacgtgataactgcacaaccctcctgtcccctccaggcctgtgtgagacaggaaaggtgaggctgcctctccctctgcaccttaaagccactcggggtctgggttttcctgagacttcccggagccagatgcagactcccaaaggcgccgatccttcctcgatctccctccctcaagagtggcactaatcaggtctaatttagagaaaatccatcacctccccccactgtgggctctgccacttcatgccttggtctctccacctatcagccagctggagcctgggactcaaggaggcatgcttggaagtaaggaacttctctgagtacgaggacatctgggtggtgctgaacaccagcatgctttgccccgtggcctggactgtgcacagggcacctagagtgacctgtcacctcccacgcaggtggaagggtgtgagagagaatgggcactcagttacaaacatccccttcccaaacacttgtggatctgagtctgaggctactccttccaggtgaggggttggctgctgttgtagcttgttactctctttctgtcccttctgccctcaggtcttgaccatgcagcttcccaagaacaggatggggaatgatatgggcacatggggaggcaagcagccacaggcctcacctgctcatgggcactgaccgtcccaacagcaggtggacatgaatctaacccacagacaccagagtagagggagctgggctccctgagtctggatggggttctcacaggcccccacagggagacaagggaagctttctccagaatgtggagtacggactcactgtgtgaataaagtaaatgagctggagggggcgggacaagatttcaaaaagcaccactcatacacccaggactggcaaagctgctggcagtaagctctatcatggggctcccccactgcaggtgagctgattggcctcagctggcaccatccatgctcagtgtttgccctgaggacaagaagacatggcaaaaaagaggaaagtacagaacacactcccacctggctggtggggatatagatagtgcagctgctgtggaaaccttcagctccacagaaaggtaaagatggagctaccacaccccgagtaattccacccctaggtatccacccaagagaaatgaactcaggcattcaagcaaacactggctcacagatgttcagagcagcgctgttcacagtagccaaaatggagaaacaagccaagtatataaaatgacaaatgcataaataagatgtggtatatccatagaatgggatattattcagccataaaaatggatgagtactaacacatactgcaacatggactttagaaaacatggaaagtaaaagcagtgagtcacaaaagaccacatattgcataattccatttatacgatatatccagaataggcaaatccacagagacagaaagtagactggtggtcgccaggggctgaggggaaagagtggggagtaattgctttacgggtatcaagttttggggtaattaaaatgttctggaaattatagtggtgatggttgcacaacatagtgaatatattaaaacctaaaaaatatactaaaacctggccaggcggtggttcacacttgtaatccccgcactttgggaggcgaaggtgggaagattacttgaggccagttcgagaccagcctggccaaaatgtcgaaaccccatctctgctaaaaatacaaaaattagccgggtgtggtggcacattcctgtagtcccagctacttgggagactgaggcagagaatcactggaacctgggaggtggaggctgcagtgagccgagatcgcaccactgcactccagcctgggcgactgagcaagactccatctcaaaaaaaaaaaattatatatatatatacacacacacaaaaacatggccgggcacagtggctcacgcctgtaatcccaacactttaggaggctgaggcaggtggatcacttgaggtcaggagttcgagaccaccctggccaacatggtgaaaccctgtctatactaaaaatatgaaaattagccaggtgtggtggcaggcgcctgtagtcccagctacttgagaggctgaggcagaattgcttgaacctgggaggaggaggttgcaatgagccgagatcacaacactgtactccagcctgggcaacagagcgagaatctgtctcaaaaaaaaaaaaaagtatatatatatatatatatatatatatatatatatatatataaaattacatatatacttaagagtatatatttatatagaatgtaaatatatattagagatatatatatactaaaacccaacctgaattgtaaaatggttcatttgttacatgatttatatatttttgttttgttttgttttgttttgtttttttgagacggagtctccctctgtcacccaagctggagtgcagtggtgtgatctcagctcactgcaacctctgcctcccgcgttcaagcaagtctcctgcctcagcctcctgagtagctgggattacaggcatgtgccaccaagaacggctaatttttgtatttttagtggagatgggatttcaccatgttggtcaggctggtctcgaactcctgacctcatgatccgcctgcctcggcctcccaaagtgctgggattacaggtgtgagccacctcgcccagctgatttatatctttttttttttttttaaagcagaatgcacccatgccacagtgctccttcctgcagcctgtcaggcgtcggcccaccctgcaacatccaggatgtcatttgagccctggtcacacgaaagcactgcatgggatgaaggtggtttatttatttatttttattttattatttatttatttttttgacacagagtctcgttctgttgcccaggctggagtgcagtgacacaatctcggctcactgcaacctctgcctcccaggttcaagcaattctcctgcctcagcctggcgagtagctgggattacaggtgcctgcccccacgcccagctaatttttgtattttcagtagagatgaggtttcaccctgttggcctggctggtctcaaactcctggcctcaagtgatccccctgcctcagcttcccaaaggtgctgggatcacaggcacaagccactgcgcccggccgaaggtggtttcttttaagcaatacatttgtattgagaaaaacaagttcttggccgggcgcggtggctcacgcctgtaattccagcactttgggaggccgaggcgggcggatcacgaggtcaagagatcgagaccatcctggctaacacggtgaaaccccatctctactaaaaaaaatacaaaaaattagccgggtgtggtggcaggcgcctgtagtcccagctactccggaggctgaggcaggagaatggcttgaacccgggaggcagagcttgccataagtcaaaatcaggccactacactccagcctgggtgacagagcaagactctgtctcaaaaaaaaaaaaaaaaaaaaaaaaaaaaaaaaaaaaagaaagaaaagaaaaaaggaaaaaaaaagagaaaaacaagttcttttaaatctctaggtaaaaataaaataatttctcacacacagccaagtcaactgcataccagagtaccaagcatagtttccacatcagaggcttaagctctggggtaaaagcattttctttaaccaggtgtctgttaattcactcatatcaaagagaaaacttggctgggtgtagtggcttatgcctataatcccagcactttgtgaagccaaggtgggtggatggcttgagcccaggagttagagaccagcctgggcagtatggtgaaaccctgtctctattaaaaaaaaaaaaaaaaatggccggacgtggtgactcatgcctgtaatcccaacactttgggaggccaaggtgggtggatcacgaggtcaggagattgagaccagcctggctaacatggtgaaaccccatctctactaaaaatacaaaaaattagccaggcgaggtggcgcgcacctgtaatcccagatactcgggaggctgagacaggagaatcactggaatccgggaggcggaggttgcagtgagccaagatcgtgccactgcactccagcctgggcgacagagcgagactccgtcaaaaaaaaaaaaaaaaggctgggcgcagtggctcacaccagtaatcccagcactttgggaggtgggcagatcacgaggtcaggagattgagaccatcctggctaacatggtgaaatcccgtctctactaaaaaatagaaaaaattagccaggtgtggtggtgggcgcctgcaggagaatggtgtgaacccgggaggcggagcttgtagtgagccgagatcttgccactgcactccagcctgggtgacagaacgagactccatctcaaaaaaaaaactatccaggtgtggtggtgcaagcctgtagccccagctgtcaggaagctaaggtgggatgatcgcttgagcctgggagattgaggctgcagtgagctacaattgcaccactgcacgccagcctgggcaacacagtgagaccacatctcaaaaaaagaaagcaaagaaaactcttcattagaaactgaacatgctcgctgggaatgatattcagggcacagggcaattccttacaggggcacacacccaagggcactgctgccaccacatgggaagttgtgacgggagggaggagactgagggcaggacacaagacatggagacacacattctggtctgtctgaccatggagctctgtccacacccaggctgcctgctggctcccaaccaccacacacagtatctggcgtttctcacaggtgtcggcttctctctctcgagtccatctgctggccgtggacctggctattcggggcaggcccatcctgcccacctccccacactctctcaagcctctgtctctgagcactgcaggttttgtagtgttccctcgtctacctctgagaggccaggctgactgaagagctcctgagaaagccaccaggacccactgctaaaggggttggtccagggtcattgccaggctgggatctgaggtccccacacatagggcagggaactccccagccatagactctgatgggggtaccagtgtggactccagccctttacacggaggagggagcatgccactatggatgctgagcagcaggaggtcaggggccccgctttcacaatgtgccatcccagaagccccacagccaggatctggacctctctgacacaactccaggtcacagagacccagatgtcagggatggagggacttgggcacctgccttgctattagctccaaggctgctggcttcatgtcacagtctgtacaacagctggtggcatgagcagggctaggaccagcactcagcatgacttcctagaactctagggacttaggggctgaggacttcccagggtgaaagaccatacctgggacagcctggccaaacagggacaattgatcaccatggaatcagtggacaggcccaagaatggatgggcacatgaggtcacccaggatcaggcaggttccactgaaggaggctgcaaaagatatatccaatgtcctaaccccggaactctcagaatgtgaccttattaggtctttgcagacataattaaggatcttgtgatgagatcaccctgaataacctgggtgtgccctaattccaatgacaggtgtccttatgaaggaggcaaagggagttctgacacggagaagagtggtccatgtgaagatggaggctgatattggagtgatgcagccacactccaaggaacacccggagccgccagaagccggaagaggcaaggaaagacccccacccagagccgtcagagagcacagtactgctgacaccttgatttcagacttctggcttccaggactgtgagagtaaatttctgttgttttaaactgcccagtttgtggtagtgtgttatagcagccacagaaactaatagagactggtctagcaccctcgacagaatgtgtgtgttgtaaggggctctcctgatccctagtgatggggagtcagaggactgcttagtgtctgaacagagggttggggaagctgggttgtcctgaagaaccagcagtccccacttggcagaaagggaccctgaacttgtgggaggtgggggctgaggggcacctgctagccatgtgctaacagcatcttcggattggtccccagatgccctgctcccaggggtggctcctctgctgcaacaagaacctgcctcccagcaccagacacagcaggtgggagctgtggaccatggccgagtctcttcgtctccttgatctgctcccaggatgcactgtccaactatcccacctgtaggtgggtggcattccagccatggacccatgatctgaggctgagcacagcaaacacaatcgaggctctgggtcccaggtcccaggagcccgtccttgatggtgcattacagctctcccaggctgttcttacagtgacctcccacctgccccaggtgagcatgcttgcacctgggtgctcgcccagcctttctagttgtccttagggcttctggtgttgggaacaggatgcagagttaccaatttagggggactgagaggttaacgtggccaaggctgagccctgcagaactgcagagcaacagcacacacaggaaagctagtgaggttcaacatcctcatggaggttgcacacggcacaatgaggtcttatttgcccaagagaatgtgcagggaagtcgccaggcacggtggtgcatgcctgtaatcccagctactcgggaggctgaggctggagaatcgcttgaacccgggaggcggaggttgcagtgagccgagatcgcgccactgcactccagcctgggcaacaagagcgaaactccgtctcaaaacaacaacaacaacaacaacaacaaaaacagaatgtgcagggaagtcaacgttggtggctctgaggtgtggaggacacaggctagtgcccagctcagcgtggctccacctctctgagccacagaccaacctcacccacactgacagtcccaggggacacagactctagcccctatgtccaattctacactgtgcacgcaatgggaagaacagtgcatcatgcactgtacagcagaagaaatgtcctctgagtgcaggcacagctcccttctgtgtctgtcctcccgacagtgcctccaccctcaaggattagcaagcttcaaccctcgcaggacatccactgtgtcagggccaaacggtgctgcatcctgctctaatagtgagtgaaggaggggaccgcagacaagaagaaatgaacaagagaccgtttaagagagaaaaagacgtgaagaacatcagacagggagcagcgcgagggcgccagggagggaggcagcggattcttcgggcctctgtgaagagggggcatgaaaccggtctgcagacaaggaaagagcaaagtgcaaaggccaggatgcgggggcagagacggtagggaggccggcgtcggcctcggctagcaggtgggcttgactccgagagccgcaggccgccaggatgggtcccgggcctggagcctcccctcgcgggcttcaatgacacccagcacggaaacgcgggggccagaactacagaagcccgtcccgcccggaactcaaggtcgcgagtgctgtgtggccggtccggacccggagcgcgaggaccggaagtgcgcggcgtcacgcctctgccccggaccccgcgcgcggaggtggagaggggactggggtggtggccgcgctatgcgccgggaggtccccgcctcgcaggccgaggttgcgggtccgcgcagaatgccacttactctctggaggcggcccgcacgggtccctggtccccgccccgcatgcagcgcggagccgtcctcccgccacctccgggccgccgcggcactgagggacccgggccacagcaagcgcaggcgggaacccgcgcggggactgctgggaaacgtagtcccgtcatgtcccgctttgacgctgcggagaaagcggtgtagggagaggcttgggcttcggttatcatagaaacagaggccggctacacctaaaaggcggggcgtggacctaagtcgtcgccaaagaaacggcgttctggacggggacgtagggtcccgcccattccttctcgtgaaagcgggtgactggtcatgattatgattgatagcctcctctcccaatctgatttctaagaggtcccaacccggaaccgacttgcggttcgcaggctcccctcgggtgggagagttgggctgggaagcacctggggagctctgaagtgtcttggtgagcgcgttgcgagtcagaccgataacatcagaatctgggactgggcccgagcatatgcgcgtcaaaactcctcagttaagtctatttttttgtattttttttggtttgcttttttgagacggggtctcgctctgtcgcccaggctaatgcagtgacaccatcacggttcactgcagcctcgacctcctgagctcaagcgatcctcctacttcagcctccagagtagctgttaacaggggcgcgcgccaccacgcccggctaattttctttcttctctccctccccctccttctccccctcccttcctcctcccactatgtcgcccaggctggtctcgaactcctgtactgaagcgaccctcccacctcaccctcccgaatagctgggactataggtgggagccaccatgcctggatagtttttttatttttatttatttatttattttagagatagggtctccatatgttgcccagactggtctggaactcctgggctcaagcgatcctcgtgtctcagccttccagagtgctgggagtacaggcttgagccactgcgccaggcccctagtccggctcctagttgattctaacacgtgcggccccattggggaaccacagcctccccagcccctttgggtgttgctgactctacgggccctcccaggtaggatgaactggtcacgcctcctacccatttgtaacccccagctcttgcccccatctattgtgtggctcctgccctcaatagggacatctaattttgttggccagtccagcacatatattgcatgtaacgacccagtttgccccacctttctgcctccactgcatctgcttcagggatgctgggactgttccactccctttctccatcctttgggtgtctgcacatcgaaagccttgtcaggaggtctatctccctgcccaagtacaaaactcagggcttaccaagctaattgagggcgagcaggaggctgaagggcacttggagggctgcccgccttgtgggtcccttggtggctgaagagagttgcacaggaaggccttgacaattgtcacagagaaaggagtgcagctgctggctctgtgtgggtgtgcagatgtctgacaggttcagccactggccccaattgggacacaagtgggatttctttttttttttcttttttgagacagtcttgctctgttgcccaggctggagtgcagtggccgcgatctcagctcactgcaacttccgcctcccaggttcaagcagttctctgcctcagcctcccgagtagctgggattataggtgcccacgacctcgcccggctaatttttgtatttttagtagagatggggtttcaccatcttggccaggctggtcttgaattcctgacctcatgatccacccgcctcggcctcacaaagtgctgggattcaggcatgagccactgcacccggcctgacacaagtaggatttctcacacctgtggatgcactgctactggaggagtcttgagcctatgtggaagaacttcccactcccaggcacagaaagggcctccctctggagtgaagattctggtggtaccacaggcctggccaccacacaaaggccttgtccctgcagggctggcatggggtgactggcagccctggagtggagtttgaagcaccaatgaaaggcctaaccacttggcaggcacaggtgcgggggacttgtctggaggggaccggctatgggggctgtgacagtctgtaggctttcttcacttctacacaagcctgttgtctaagtggaccctgcagggttcatgcaggggcagcaccagagaagcatcttgtgacaatggttacacaggagcgatttcaggaatgagactgaatcaggcaaggacctggagaggaagctccagtggggctcccacccaaggggtccaactttaccaatcccacaggtccccagtctggggctcattctatgtctgtaggcctgggaccctgcacccaggagagttgtcctgctaccggccatccctccgcagaggtccccctctggctctatgctgtcttcagcaaagggcctctgctccatttcacacctctcctgagggcctggggtagcttactgcgaagcagcctcagggaatagaggcttcagcagggcatcttggcccccaacacagaatcctggttgtaggatctggaagaacagaggagaaatggaagttggcagttcccaggaggggagaaggtgctggtgagccacgaaagcaaaccccagtggctgaagcatcctggatgactcggccacatttccttaagaatctttgtgtgtgtgtgtgtgtgagacggagtcccattctgtcacccaggctggagtgaagtggtgcgatcttggctcactgcaacctccaccgcccaggttcaagtgattctcttgcttcagcctcccgagtagctgagactacaagcgcccgccaccacgcctggctaatttttttgtatttttagtagagatggggtttcactgtgttagccaagatggtctcgatctcctgacctcgtgatgtgcccgcctcggcctcccaaagtgctgggattacaggcatgagccaccatgcccggccctcttctgtctcttataaggacacttgtcattggatttagggtccaccctactaatcctagatgctctcatcttgggatccttgactaaattacatctgcaaagatttttttccaataggtcacattcgctgggtctgggtattagggcatgaacttacctttttgggggccaccattcaatccattacaggtgggcatcccatagaagcagacagtggctaggccaaagtagcccatgaagtatcagccatgggcacaagatcaagtttgggatgcggcagggccaggcttggctctgccaggcaactgggtggactgaatccagcacactccaaacgagttgataatcaggctggggacttcaacagacaaccaaggtgccagtaaaggcattaaggagctatcacggccaggtgcggtggctcacacctgtaatcccagcactttgggaggccgaggcaggcggatcacgaggttaggagatcgagaccatcctggctaacagtgaaaccccatctctactaaaaatacaaaaaaaatagccgggcgtggtggcgggcgcctgtagtcccagctactcgggaggctgaggcaggagaatggcatgaacccaggaggcggagcttgcagtgagccaagattgcgccactgcactccagcctgggcaacagagtgagactccgtcacaaaaaaaaaaaaggagccatcacaaggatgtaagatcagctaacagtaagactgtggctggtagggtggacaggcaaagtgactgcctggagagtgggcaggtggcccagcagggcccagagggtgccttcccagaagtgaggagtccagtctggggccggccactcaggatggacacaatgtaccagaagtgaggtagatctctgcagagtctctggggtcctcatccagtctgaagaacacagcaccagcagccctagatctatgaggtcagactctgcatcttatcgtagcaccttggggacctggggaggctggaccaccctggacctggtggcgggggtggggggtgcatgagtctcggctctgcagtattcaccacgccacacttgagggcacctgccctctgcagcacgatgagtcattctcatgaggtctgtaaagatgtccattatcaaatgaccatggtagccaggccacagggttcacattgacgttgcctcattgcattctcatttccacactgaaggggaaaacaggttcagaggggtgggctcactgtcctgatgagtgctgcctgttttctcccaccctccctacaaccagcacccccatgcccctcactcaagaccagggagaagcccacctagcccctcctgcaaccacacagaccccagtgggagccccaaggctgctactctgcacaggatggagggcaggggtaaaggccattaggcggtggcagtaggccgtgcccctcaccagaggctgaggtctgaccccttgaccagcccagcttcagggcatgtgtcctttcatgagctgtgactgaccacagtccaagggcccactgtggggagtcctcagcatatttggacagaaacgccccagaattggggtaagaagagcctttacagtcaggcagtgaagaaacacagctgctgggcacctgctatgtgcacgcctcagggatgggagtagggggcaggcccagccctgggacctgggtcaggtggctgggcccttcggatcccgagttggagggataaccccttggaggcagagatgggcatcagagacagggcggccccaggtggtcctggagtcgcctcgtaaaggttatgtctatgcctgctgcaggcagagacacagtcaaagtagttgctacctctggaaagtcccagttctgctcatgagcctagatctaagaggctgggacaggcagaggggtatgaaggggtcatgggcaggcagactgtccacactggctgccagggtggccaagtgagtagagtgagctggggcactcactaccgtgccaaccccacgcacggatgaggaccccgggtcgaaggcccacatcctcaatcccacgcaatagttcaggccctgtgagagggttcgctgtctgctcccagccagggctgagctgttcagaggccctacctgttcagaggcagctgggggaagggacagaagttggggggcaggggattgtgtgctggcgggaataatctccttcatctcatggctaaatcttccatccctcctttcaacctttggccagaaacctacgtttctgacccttggagaggtcggccagttcaagaggcacccctgagagccacgtctgcagacacgagggcctcgtgacgtgagccctgagggcagggggctgcaacccctcgcgcgggctccccggccgtggaggacacaaggacaaacacgaagggtccccgacctgccgaccccctcctcccggacaccgcgcgtagcctgtaggctacctccgcgctccacccagagacgggtcgcgctgctcccgccgccgcaaccccgggccctcgtgccggcggtctcccctcttccacgggcgagattactgcatagcagaggtgaagggcgcggaggctgtgggggaacccagcgtggtatggcaggaaaggtcgagcagggaaacaggcccagccagaggctcgggatccggggctcgcgagcgtggtgctcctgggccgggcggtgggggaggggccgcgtgtggcaggcacatgcgcacggcaacctggacctgcggagggcggcggtgaccactgggcctcactccgctaacccaggtccgcatcaggcgcgtgccggtgaggcggctgtggccgcggcgaggagtcagagggaactgaactggctactcccgcggcaggtgggatttaaggtcagcagctgaacaaagaagcgagcgctggccagacttttttctttattagacatggctgcgttggtctcacggaaatctctgcgcttttgcaggcgcccacaagacagggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttggcccgcggcgcgcggcctcttcctgtctgtaccagggcggcgcgtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttcttagggacacgatgccctcttttgctctgtgtaactttccccccgtaatagcagcccctagagccttcatactgtcggtcaagaatcgaaacctttgggttgattgtgccacacggtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggcggacattattccaggaaggcacacatcaaacttgttgctgtgccattaagtcaagaatagagatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttgtagtaaaatacataacatccagtgtcattcttttgcatgtgaatatccagttatccagtaccatctcctaaagagatgttttttttccctcaattgaatggccttggccacttgtcataaatcagctggccgtagttttttttttttttttttttttttgagacggagtctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttcattacagactttcagttatattccactggtctatatgtctgtctctatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaatcattaaagttttatctttgagataagatcactctctgtcacccaggctggagtgcagtggtgtgatcacagttcactgcagcctcaatacacctgggctcaggggatcttcctgtcttagactccaactagctgggaccaaagatgcatgccaccaaacctgctaccttttgttttataaagaatgaaaacttttttgttgtctgtaaagatgtcaggggacttaggcactatgcctaatggataattcagccttgtttttcactctgaatatcttgtagatcttggcttttctttccttcaggggtttatttcggggggtccaaaaacattttaaatattattattattttttgtttgtttatttatttatttatttttttgaaacggagtttcgctcttattgcccaggctggagtgcaatggcacgatcttagctcaccacaacctccgcctcccgggttcaagcaatgctcccgcctcagcctcccaagtagctgagattacaggcgcacaccaccacgcctggctaatttttgtatttttagtagagacggggtttcaccatgttggttaggctggtctcgaactcctgacctcatgatctgcccggccacattttaattatttatttattttttgagacagagtttcgttcttgtcgcccagtctggagtgcaatggtgcgatcttggctcactgcaacctctgcctcctgggttcaagcgattctcctgtctcagcctcccaagtagcggggattacaggcacatgccaccgcacccagctaatttttttatttttagttgagacagggtttcatcatattggtcaggctggtctcttaactcctgacttcaggtgatcagcctgcctcagcctcccaaagtgctgggattacaggcatgagccaccacgcctggcgttatttatttatttgtgagacagagtctctctctgcctcccaggctggagtgcagtggtgcgatctcggctcactgcaacctctgcctccccagggtcatgcgactttcctgcctcagcctcccgaagtgctggggttataggcatgagccactgcgcccagcccacaaacattttcattataggcccagataatgttttagactttgtgggccacactggccactgttactttttttttttttttttttttttttttttgagatggagtcgctctgtcacccaggctggagtgcagtggcacgatctcggctcactgcaacctccacctcctaggttcaggtgattttcctgcctcagcctccctagtagctggaactacaggtgcatgccaccacacctggctaatttttgtctttttagtagagacagggtttcaccatgttggccaggctggccttgaactccttgatctattaaacgtttgttaagtgcctgttccactagggaaataaacatcaatgggagttcactgtattttaaacacctgtgcagggctccactgttgggccaaacccttcctggggaatttggtgtttgcaattttttgctgcatagtgaaagccctgcgtgaatgcccttcacgagactgtgagttttttttttcttgcagccagactatgaaatagtactgagagtttcagtgtcctgtgttcttttcccatcattccttgtatttgtagaaacaggtattttgtgtatattctcagaggcaagtgatagaatggccttgggtacattttgtaatggaactatcaacagcagtctccttcgaatgcacatagctcctttcttcccctttacatactcaaggttaactttttggcatttttctagatttttgtgtggggatggctatgtaagtataagaagacttgttaaatgattgttttaaaactgtggttctgggccgggcgccgtaatcccagcactttgggagactgaggcgggcagatcatctgaggtcaggggtttgagaccagcctggccaacatggtgaagccccgtctctactaaaaatacaaaaattagccttgcatggtggcgtgcacctgttgtcccagctacttaggaggctgatgcaggagaatcgcttgaacctgggaggtggaggttgggatgagctgaaatcatgccattgcactccagcctggccaacaagagcgaaactccatctcaaaaaaaaaaaaaaaaaaaactgggctgagcatggtgacgcatgtctgtaatcccagcaacttgggaggctgaggcaggagaattgcttcaacccaggaggtggaggttgcagtgagccaagattgcaacgttgcactccagcctgggtgacagagtgagactccatctcaaaaacaaacaaacaaaaaacccaaaaacaaaaaagttctcagccaggtgcagtggcttatgcctgtaatcccatcactttgggaggctgaggcggacggatcacctgaggtcaagagttcaagaccagcctggccaacatgtccaaaccccagctctactaaaaatacaaaaattagcctggcatggtggcatgcacctgtagtcccagctactcaggaagctgaggcaggagaattgcttgaacctgggaggcggaggtttcagtgagccaagattgcaccactgccctccagcctggaaggcagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcatgcctgtaatcccaacactttgggaggccaagacaggcggatcacaaggccaggagttcaagaccagcctggccaacatagtgaaacctgtctctactaaaaatacaaaaaaactagctaggcttggtggcaggcccctataatcctagctactcgggaggttgaggcaggagaaccatttgaacctcggagtcgtaggttgcagtgagctaagatggcaccactgcacaccagcctgggtgacagtgagagactcaaaaaaaaaaaaactgaaggggttgccagtggcataccagatggctgttaaacatcctatagtgtgcaggacagccccccagacaattatctggtccaaaatctagtctccttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaagcaaatatattgccttgttttttagaaataattgagatggaatctcagggtgttcttgaattcctggtctcaaatgatcctgtcccctcagcctcccaaagtgctaggattacaggcatgagccaccacacctggccgccttttttgttgtcgtcggtttttttgtttgtagaggtggggtttcaccaagttgctcaggctggtctcaaactccctgccaaagtgttcctcctgcctcagcatcccgaagtgttacaggcgcaagccaccgtgcccggccgtctagcagtttgctgttgaggcaggtctcaatctcctgtcactggggacgcaacttcagcctgtgtgtgtgtgtgtctggacacttgctcttgtgaccctctatctgattgcaaatcaggcatgatgccaccacctcttgtctcagtgggcctatgggtgacaacgtggctggcagcatcagttgggagtggccccagggtgctggaggaccgcagtctgtccttctagcctgacccctgctgtcttcctaggccatctggctgctgtgcacaggcgctcgtgaggctgccttccggaacattaagaccattgctgagtgcctggcagatgagctcatcaatgctgccaaggtgggtgagggcactccggttggggggtcttaagttgggcatttgtgggggtccttcagaattcagagctgtgtgtctccttgcagggctcctcgaactcctatgccattaagaagaaggacgagctggagcgtgtggccaagtccaaccgctgattttcccagctgctgcccaataaacctgtctgccctttggggcagtcccagccacctgtgctgttgtctgtcttcggtggggggatgtgggtggcatagccctggtggccttgggagctgctcaccttcctgacctgttggcctgtggggacctggaagtattgctgactcagaaccatggcaccccagggctagcaggtggggcactggatgcaggccaggctgcctggagtgtcccagcaggtactggaaatgagatggggttatccataacttctgagggcgtggcacatgagatgttgctgtggtctgggtggatgggtggcttgggtgcctgtgaggtctgggtagtcacaagaccatcctgagaggcttgtcaccttgaagtagcactggggagaggaggaaagctcagctgtttagggcacacgatttcagacccctagcttcacccccctcttggagtgtggggtggtttcacactggcgaggttgtgctcctggttacctccccggctacactggttgtggctgcaccctgggcctgcacacccagtttctgtgggctgtacgggttcccttctgccagtgtccatgcagtgtcatcaggctgctggggacaggttgggacccacccagggccacaggctggtgactctggtagaagactcatcaggttctgaagggtggggtgggcccaagcccacccaccgtgtgccatcacccttccaccgcccccaacatctggccaagacaggcttggtgttcatcctggtggggctggcccagggggcggggcaggcagtcaaacgggtccagcgggtacctgggacctggaggggtggtgccggttgagcaccctccccctgggagggtacttttgagcccagctgctggcaggccaggaacagacagggacacgccactggccagagggaggaggcttccacaggtaggaaggcgcccacaggctggctgcggtctgtcattactctgtggggggtgcctatctctgctcctctgtgggtcaggtcctttccatccctgtctggggtcctccccatctccgtgttcaactgcggtctgtctctccgtttccaattcaggaactggtaccccgtgggtccattcctatccccagtctccgcctcgggcctccccatctcccctgctcctcgacgctagctacacccttctcgggatggggtgctctgtactgggggatcctctctaaagtacagtccccagtcttccctggattccctgctggtctcagaacccgctccaggctccaccgcctccttccctgcctgacctcctctcctcccaggtccatccggatgccctgccctcggccgttctggctccgccattcccgggccccccagggctcgggtcccagctccccaggctcgctctctgcgccccgctccccaagcagaggggaagaccaggaggaggaggaggaggaggaaggggacggcagcccaggctccggccctatcctgccccccgcctccccggtggagtgcctcatctgcgtgtcgtccttcgacggcgtgttcaagctgcccaagcgcctggactgcggccacgtcttctgtctcgagtgcctggcgcgcctatcgttggccacggcgggcggcggcaacgcggtggcctgtccggtgtgccgcgcgcccacgcgcctggccccccgccgcggactccccgcgttgcccacgcagtccggtctcctgccccgcgacgcgcgcgcaccgccctctcgccagggctccgtgcgcttcgaccggcgccgcggccttctctacctgcggccgccgccgcccccgcccgggccgcgcaaggcccgcgccccgccgcccccgccgcctctgcgcctgggccgcccgctgtcgcgccgcttgtcgctggccagcccggcctgggtcttcaacgctgccgtggcgctggcggtgctggtggccgcgggcctcgtggtctcgggcgtctacatcttcttcctcatcccgcacgccacctcctccggccccccgcggccccagctcgtggcgctcgctccagcgcctggcttctcttggtttccgccgaggcccccgccggggtcgccctgggcccccgcctggacgccgcgccccacgggccctgacctggacacggccctgccaggaactgcagaagatgcgctggagcccgaggcgggccccgaggacccggcggaggccgagaggacgctggacaggcgatcggatggcacgtggggcacagaggctggccccggctgggccccgtggccacggggcgcgaggaggctgtggggctcacaataagtgcgccagtactgcagtcctgcctccaggcctggcacctccgtgttatctggggcccttagtagggcgcgcagcacttacctgtttctccagattggggcttagggcaagcatccttggcattgtcaccatggggctggaccctctcaaggagcaggcaccgcagtcgtcccacaaggatcctctgggaacacccctgacccccattcttgtggctgtccagcggagggtgccctgaccgtgacctctataagggtcctgctggggcttgctcctgctccgcaacccctactccgtgggggtgcagttggaagcatccctgatcctcatcccttgtaggagtccagctgtggacgcccccgactgacatccatgcaggtgcccagccaggggcagccccacacggatccttgaacgggtcttgctgggagtgcccccagtcatcctcaccacagattcctgggggagcgtccttgccagcactggaggccaaagcactcatccttcggattggccataggttgcaggggcccgcctatctttggagggcagagctgctgctgctattcttccttggtcacctcctccccaactggctcattgcaggggacgtcccaccactccacccatctgtggagtttgttttctactgcctgcaggctgggcctgggtgggctccagctgtctacatgctggtcccgggtgtagagttgccatcctgtacacctggttggggctggggctcaggcttgaagtaacagggtgtcctggccagggctggggaggaacttgagccttaaagactggctcccgccccaatcctaagtcccaaactgctctgggagcctccacttccccctgggtcgtggcttctaggatcctcccaatatgctgtggtgcagctgtgcttatcatggctcagaggccaacatcaccccaggggtcagacagaggcagacaatggtgggggtgggagtcctggacctccttggttagccagagggatcctagtccctttccctggccaccagagtccccatcacccccgattaatatcttgatgccagttactgcacttcttcctccagggctccatctgtcctgcccagcctcctttcttgtacctcgaggtgaaccctgagccttcccaatagacagcagcctccagggaaggtggcatatgggctcctgtcctcttcctcccagaagtcttcctgggttagttatgggggtagatggcagctattctctgtgcagactgaacctggggcttctgtttcctcccaggccctgcacaccacccccccaatcctgcctcacctcactctgggatggagtgctgtgttttgggaatgggcacccagcatgttccaaagcgaaacgtgacttctatgtggctggaggctcctgtttgatttgttaacgtgtgtcctcagcaccagcatacagtaggtgccaaacaagggagtgacagaattgcaggtgacccaggcagcctgggaatgcaccctgggcccaggactgtctagagctagctctggtgtgagctgctgcttccaggtgggagccagaggaggaacactagggagtccacagtgtgtcttcccagaccagttcttgcccacacccacatgccgatgtcacccacaggggctgggaccagtgtactgggtcactgggcagccacagcccagcctcatagggaagaaacctggtcagacagccgcagagttggtggtctattcattttctgtggctgctgtgacaaaatacccccaacttaattatttagaacacgcgtttattttttttaatttatttttgaaacagagtctcactctgtcgcccgagctggagtggagtggtatgatctcggcttactgcaacctccgcttcccgggttcaagcgattctcctgccttaggctcccaagtagctgggattacaggcgcccgccaccatgcctggctaatttttgtatttttagtagagacggggtttcaccatgttggccaggctgatctcaaactcccggcctcgtgatttgcctgccttgccctcccaaagtgctgggattacaggcctgagccaccgcagccggccttatttcatttatttatttatttttttgagacagagtctcgctctgtagcccaggctagagtgcagtggcgcaacctcggttcactgcaacctctgcctcctaggttcaaatcattctcctgcctcagtctcccaagtagctgatattacaggcgcccgccaccacacccggctttttgtatttgtaatagagacggggtttcaccatgttggccaggctggtcttgaactcttggtctcaagtaatctacccacctcagcctcccaaagtgctgggattacaggcatgggccaccatgcctggctaaacacacacttcttatcttgcagttctgcagtccagaagtcaacgatcagtttcactgggctaaagttgagttgcccatagggctagttctttctagaggctctaagagagaattcatttcattagtttttccagcttctagggctgcattccttggctcctggctccttcaaagccagcagtgcagcatcttcagatctctctgaccctcctacctccctctttcacttataaggacactacaagtacatagcgcccacccgaataatccaagatagtctccccatctcatgatcattaatttaatcacacctgcaaagtccattttgtggtgtcaggtaaaagattcacaagttccagggattcagaccgggatatctttggaggccattattctgcctaccatagggtctcagagatcctcctcattgcttccctctcccacccaacctaggggagtgggggtgtgcaatggtatttctgacccagacaggccaagcaggggagtcagaaaggggcccttgcctggtgttgcacagaagagggagaggatgttctgtgcctgagggtagaccaggaaggctgcctggaggagggagctgtatcctaaaggatgctcaggagctggcattgaggccagtggcatagcctgcacaaatacaggaggacctggggaggccaggggtggggctgggggtattgggtggggctggccgcattctccgtcttaaccagctcgctcctaggtgcttttgtggcttctgcactctaccagcttggagccaggggcctcattctctcttgcagtaaaatgaggctgatgactgagcctaggagttgctgggcatctggtctgctgattaccaccttggtgcccaatgtctgcctgcctatccactgctttcaaacaaagaggctgcctgacaccacccagggggacgcctcccacccttgcccagcctcagccaatctcctctttctcttcttcagagctggagttgtgccctcctatcctctctctgcccaccccatcactgctgtacaccctgccccttggcacttcggccccggacttgctcctcctggcaggcctgggtgcttgtgaagccgggtgccagagggcccagcacggcacggcctttgattctgttttctgtaaatcgacgacaataaattctctttttccttcatccacaagtgtttactgagcgccttctgtgtaccaggccgcaccagggtgcggagcaaagaccaacctcagggagcagatgaggtccaggcggctgaaccaaccgaaccatggttctggtagcactgcctcccccgccaccctcagggggccctgctccccaagcccttcccaaatcctgccgtccagctctcctccccaccttgcaggagggacgccagggcccggttttcgggttccgccattctttcctcaatgagggtcggagaggtccctgcccacgccagacccgtccccggccgtcgcggcaccctcttgtgatcaggcggagggaccaagggccaagagcggggcttcgccggacgctgggagcgtcactgtccagactgacagatggggaaactgaggctgaccagctgggcagggcgtgcatacgaatctgggtcctggaagcgttctgcaagatcccttctcacctcaaccgcacgtgctggcatccttgggtttccctccttccccagatcacagccgcacttctctcctccgccctcatagtcacggccctgccttctccctcctcttgccccgggcgggccccgcccagaatgcggagaggccttcgaggaagcgcggaccaatcggaggccctatgtagggctgaagaggcgggactctggtcgccataacaactcatcacgcctgtgctgcgcgcgcgcgtcgccttagtgccgcagccctattacgtgaggtagggaaggcgcgccagactcgacggccaatcagggacccgagggcgatgttgccatgacgaccacgttgcgctggagattgcgacgggggctgaaaccgcggggaactcggggagcgagtggtgagaacagtgagcaccagcactccgatggcgctggcgagaggaaaggctgcggcgcgcagagcgaggctgcgggaccccaggatgggggacaggaggctgcggggcctcaggtgagcagcaagcgagagaccagtcccttcgagcgccctcacgcgttttgtccccacgccacgccggggacgagtctgtggcacagactcgtccccggccccgcgggcttaagttgtctgggggctgtcgctttgagtacagatcatatagttatgaatacattttaacgcagatccaaacacatagtataacgtgaggatcctatataaagtgagactcctcaaaaaaaaaaaaaaaaaaagatttttttttttttttagccggacgtggtggcgggcgcctgtagtcccaaccactcgggaggctgaggcaggagaatcgcttgaagccgggaggcggaggcttcagtgagccgaaatcgcgccactgcactccagcccgggcgacagagcgagagactccgtttgggggggtaaagtgtttttttaaatgcagtcaaattcgaacgtaggttgataggatcacatagttgatccactctaaccccacacccacttgcagacctggttagtgctgaggtcctctcatcccagggagtaggctagagttcgcactggctcccctggggcccggcttggcgtggcaaagctgggagtctcgccctaggttggggtttcctctgctctgtaagcctctgcagaaggagcagagggtggtgggagaagaagtgcccaagaggggccacaagctacctgtgatctgtgtccccccaccagggggatgggtgctttcatttttatcgttgtggaaaatttcacattaagtacttctccaaagaatctcccagacatctacttgttctttcaaaacataacagatttttttaaaaaacaatttacataccatataatttgcccattttgagtgtacaattcaaggctgggcgcggtggctcacgcctgtaatcccaccactttgggaggctgaggtgggcggatcacctgaggtcaggagttcgagaccagcctgaccaacatggagaaaccccatctgtactaaaaatacaaaattagctgggcgtggtggcacatgcctgttatcccagctcctcgggaggctgacaggcaggagaatcgcttgaactcgggaggcggaggttgcggcgagccgagattgcaccattgcactccagcctgggcaacaagagcgaaactgcgtctcaaaaaaaaaaaaaaaaaaaaaaaaaggccgtaggtctgaatagacccctcacctaagaaaaatagatacatagctggcaaataggcacatgaaaatatgctccacatcatatgccattagggaactgcaaattgaaacaataatgagatactactatacatctattagaatggctacaatgcaaaacactgatagcaccatatgctagcaaggttgtgaggcaatgggaactctcgtttactgctgatagaaaggcaaaatggtatagccactttggaagacagtttggcagtttcttacagaaagttaaatatagtcttaccatatgatacagcaatcacactcctgggtatttgcacaaatgagttgagaacttatgtccatgcgaaaaccacacaaattattatagcagctttattcataattgctcaaaacttgaatcaacccagatgtccttcaatagataaatggctaatctgtgttacatccacacaatggaatatcattcagcaataaaattaactgtgctaccaagttatgaaaggcatggaggagtctgaaatgcacattggtaagtgacagaagccagactgaaaaagctacatactgtatgattacaagtttatgacattctggaaaaggtaaagctatagagacagtaaagcagtgactgccagggactcagtgggagggagggagggagggagggaggaatgaatagtagcacaagtaatttttgggggcagtaaaagtattttgtactatattgtaatggtggatacatgaatttatgcatttgtgaaaacccatataatgtacattaataataatgtactaatattcattttacaatgttaacaaatgggccgggtgcggtagctcatgcctgtaatcccagcattttgggaggctgagcggggcggatcacgaggtcaggagatggagaccatcctggccaaaatggtgaaaccccaactctactaaaaatacaaaaattagccgggtgtggtggcacgcgcttgtcgtcccagctattcgtgaggctgagacagaattgcttgaacccgggaggcggaggttactgtgagatcgtggcactgcactccagcctgggtgtcagagcaactccgtctcaaaaaaaaaaaaaaaaaagaagaaactaaaatgaggtccaatgaagtagtgccaggaaaaacataaatgaactaactattaagcccaggaaaggtaagtggttaagagagaactttggtctgagacttcctggaatcaaactgtagcactgcctcccactggctttatgactcagggcaaatacttagcctatgggagactcaggccctggaccctctactcctctgctccacccgtgggagagatcaggcccatctcacagaggaacagattttttttttttcttttttttttattgatcattcttgggtgtttctcgtagagggggatttggcagggtcacaggacaataggggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccatctttcccccctttctattccacaaaaccgccattgtcatcatggcccgttctcaacgagctgttgggtacacctcccagatggggtggtggccgggcagaggggctcctcatttcccagtaggggcggccgggcagaggcgcccctcacctcccggacagggcggctcgccaggcggggggctgacccccccccccacctccctcctggacggggcggctggccaggcagaggggctcctcacttcccagtaggggcggccgggcagaggcgcccctcacctcccggacggggtggctggccaggcggggggctgacccccccacctccctcccggacagggcggctggcagggcggggggctgacccccccacctccctcccagatggggcggctggccgggcagaggggctcctcacttcccagtaggggcggccgggcagaggcgccccgcacctcccggacggggcggctggccgggcagggggctgacccccccacctccctcccggacgggtcggctggccgcgcggggggctgacccccccacctcccttccggacagggcggctggccgggcggggggctgacccccccacctccctcccggacggagcggctggccgggcagaagggctcctcacttcccagtaggggcggccgggcagaggcgcccctcatctcccggacagggcggctggccgggtgggggactgatccccccacctccctcccggacggggcggctggccgggcggggggctgacccccccacctccctcccggacgaggtggctgctgggcggagaggctcctcacttctcagacggggcggctgccgggcggagatgctcctcacttcccagacggggtggctgctgggcggaggggctcctcacttctcagacggggcggctgccgggcggaggggctcctcacttctcagacggggcagttgccaggcagagggtctcctcacttctcagacggggcggccgggcagagacgctcctcacatcccggacggggcggcagggcagagatgctccccacatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagatgatgggcggccaggcggagacgctcctcacttcccagacggggtggccgccgggcagaggctgcaatctcggcactttgggaggccaaggcgggttgctgggaggtggaggttgtagcgagccgagatcacgccactgcactccagcctggacaccattgagcactgaatgaacgagactccgtctgcaatcccggcacctcgggaggccgaggctggcggatcactcgtggttaggagctggagaccagcccggccaacacagcgaaaccccgtctccaccaaaaaaaatacgaaaaccagtcaggcgtggcggcacgcgcctgcaatcgcaggcactcggcaggctgaggcaagagaatcaggcagggaggttgcagtgagccgagatggcagcagtaccgtccagcttcggctcggcatcagagggagaccgtggaaagagcggggggggggggagggggagggggaggagggaagaggaacagattttcaagaacgatttgaggatatgtattagcccaggacatgttatgggatgaccagtgtcttcaaactaggcagaaagaggggacagggtacaggagtcaggggaagtaggcgaaaaggtggactgtttagtaggggatcaggaacatagaaaagtggcaaggctagtgaccttggtacccagacaccaggggtataactcaggtaccaggtgtgagaacagctcaattccagggatacttccatccccagcttgcaatctccatggctgagcctctttgataacttttgtgctattcctggtttcaagtctacctggtccatcaatcagtgctcttgtctgcactccagttgggggaactcatgaactgtaaagggcaatcctgtgggggaatgaacaggttggtcagtccagcctagggcagactgacccaccatgacagtccaggggtactgatgacaggcatgtaccatgagcttgggggtgtcccacctgtgtctccactggagagaatacacaggtgtcactgaggaacagggttgcaaggactgaggatatggggtcagctgaggacatgttaaggagaggcaaacattgcacagctaggcactaaggagagagaaagggacacagcggggcatggccagaaaactggaattgagctgagtggaggcaccaagacctgcgagggcacaggctgggcaccaggtgtgagaacagcccactcctgggggcattcaccaggggtagatctcttcagggtccctctgccacaactagttttgagttcatatggtccacctgctggtgggaatgtagaagccttcagacctatgaaggatgatgagtttttgagagtccaggccaggagaggccaaaacaccatgaccccagcaagcgagaataatccttactccaagacaaacacagacctgcaaaaaatgaacattcagggaaggctcccaggcaggacccagtgggcccacacgcacccatgtcagtgcatgcagtgcctggaatcttacaggaagtgaccgagctgaacgtgaccagctgtgaagattcagagacttctgagccccgatcttggccactcacggcccttgggtagaatgtgtggggtgtccactcagccacttgttagaggaggtggcatgatctgggcctcagtgccacgaccaacagcgacttccaaggggaacatggaaagaacagaggaaaaaaaccagagttgaggctggggagagttatggtgccagtggtctcacccagcactgagtgcaaagttctccagcaccacttcaggtagaagctcctctggaccttgcctaagaactccgttcgtccgggaggacgcaggcccacctgctctaacatgaacgcgtctgaattcagcggaggacacccaggagcccggttattctcctgccagcgtcctcccctgatgtgtccctgaccccgtgctctgacgtactcagccatgtactcactctcctctcccaggcccccatacctgagatcaccatggcctgatatggggtagactacaagcctaccgtgcctcagccatgtgcagggcgacctgtccctggcatccacacctgtggcccatacgtcgcccgcattgtggggcgccgaaaacccaacacaactgaaacacaactgctgaccttccccctaagccgcctctaaacgaggtccctcggcccctggtcccagccgctctttgaagacttgcctgatgacaggcatgtaccatgtttttggctgggacatttttctgagccttgctccgggctccgtaaagcggacacggtgccagggagagaatttcggggcggttgcgggcacaggcgggcttctgcggaggccctggcgaacgcccccgcgcggcgcggtccgatggccccatggggccgcccctccactgtgaggtcaccggggttcagcaacattcactgcggctaggacgcgtacaggtcactgaggcagaacttcccgattctcgcgccttcgttcgtttctgcggaccagcggagactcctccacaccgcccaccgcccaatgatcccactgccgcaaaccgccccaaagccagcgccgaaagccgacgccggaagccccgccccacgcagggcccgcccgaacgttcccgttcctgggccgccattggccaagtctgaacggccccacgtcgaggctccttatgggaaatgtagttcacgtcccgcttcaggagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggtgagcagaggatgcctccgaggaatgagggggcccaccaggtggggggcggcgtgtgccagggcagagttggaggagggcaggagatctgcgtatgattccagggggaggtctttgatgcacggctggggcatgcccttggcagtgggagccattggagatgtgccgcaggactgggacaggatggggtcgtagttgctgtgccaggccctctggagacgcatgtgcagaacggcgtgtggaaggccaggcaattgcctatagggtaaactggggacgttgtgctgggggtgtacagttttaggcattctgttgtccagttttgtgcctgttgagcaggaggcaaactggaccctgggaccaggtacttgagacctaagggagaaggatgagcataggtttggttgcgtctgagaggtatgatctctgggactggaattggcaggcaggagatagagtggagcctgtgcccttggccctgcacatagatggcatcagtctggtcaccaacctgatgtcgctttgggctggacacagtttccagtagtaacaccagaagcatcaataacaccagcagctctgatattcctctgggataggagaaggaaggtataagggtatgtgtagggagtaaggtggggaagagtttagagctcatagggaaagataatgtcagggggagatgtgataggaccctgagatacaggtcaagggcctgaatgtgtccatctgtccatattttggttgtttttttctgcccatcattgaccccaaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggtaagtctcttacactgtcccccagcacactgactaccccctcattttccccatgcgaagttctgtccataacgaagccagaccatgggggctctttccttcccagattccctgttgtaggtattgtgggtggtgggactcggtggtgggactcggcggtgtgctctttccctgcctttctctgagcaatgctgttggcagcctcaacacctcttgccccaggagctagtggagcaggttttgggggtcagatgtttcatagtttgcccaccaaatcccaccaagctctgccttttcctggccatgtgactctcttgaagacatggcttctctgtgctctgggttttgcctccctacaaaagaaattttacagggacctccctgggccaggcttgagccatgaattttaatcagaacggtttgggaaatatatatatatatatatatatatatatatatatatatatgtgtatatatatatgtatatatatgtatatatatgtatatatatgtatatatatgtgtatatatgtgtatatatgtgtatatatatgtgtatatatgtgtatatatgtatatatgtgtatatatatgtatatatgtatatatatatgtatatatgtgtatatatatatgtatatatatatatgtgtgtatatatatatatatatgtatatatatatataatttttttttttttttttttttttttttttttgagacagagcctcactctgttgcccaggctggagtgcagtggcgcaatctcggctcaccacaacctctgcctccagggttcaagcgattctcctgcctcagtctcccgagtagctgggactacaggctcgcgccaccatgcctggctaatttttgtatttttagtagagacagggtttcactttgttggccaggctggtcttgaactccggacctcatgatctgcctgccttggcctctcaaagtgctgggattacaggcgtgagccactgcgcctggccacaaaggtacttctttcgttaaatttattcctaagtactttattcttcactgttaagtatggtgttagctgttggttttttgcagatgcccatttcaggtgaggaagttcccttctctttctagttcatttaatgtgtttattaagaaaagtcatggccaggtgcagtggctcatgcctgtaatttcagcattttgggagggcgaggcaggtggattacctgaggtcaggagttcaagaccagcgtggtcaacatggtgaaaccccatctctactaaaaatagaaaactagccaggtgtggtggcacatgcctgtaatcccagctactagggaagctgaggcaggagaatcgcttgaacctgggaggtggaggttgcagtgagctgagatcgcaccattgcactccagcctgggcaacaagagtgaaactacgtctcaaaaaaaaaaaagaaaagaaaggtcactagattttgtcaaatgcttttccaatgtctaatgaaatgatcatgtgatttttgtcctctcttctgttaatgtagtatattagaataattgattgccttttctttttttgagacggagtcttgttctgtcgccaggctggagtgcagtggcgcgatctcggctcactgcaacctccacctcccgggttcaagtgattttcctgcctcagcctcccaagtagctgggactataggcgtgcaccaccacgcccagctaatttttgtatttttcgtagagatggggtttcaccatgtttgcaaggatggtcttgatctcttgacctcgtgatctgcccccgtcggcctcccaacactaattgttgattttcatatgttcaaccttgcattactgggataaattccctgtcatggcttataatacttgtttttttttttttttttttttttagacagagtcttactctgtcgcccaggctggagttcagtggcatgatctcggctcattgcaacctccacctcttgggttcaagtgattctcctgcccccgcctcctgagtagctgggttacaggcatgcaccactatgcctggctaatttttttatttttagtagagacaggggtttcaccatgttggccagggtggtctttttttttttttttttttttgagacggagtctcgctctgtcgcccaggccggactgcggactgcagtggcgcaatctcgactcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccactcgcctcggcctcccaaagtgctgggattacaggcgtgagccaccacgcccggcctggccagggtggtcttgaactcccgacctcaggtgatccacccatctcggcctccaaagtgctgagattacaggtgtgagccaccacacccagccagtggtgtagttttcttataatgtctctgtattgagtatgagggtaattttggcctcaatggatgagttgggaatgtttccttctcttctgttttctggaagagtttcttaagtattggtgttaattcttatttcagtattgttagtattcacctttgaagccatcagggcttggggttgtgtgtgttttggggggaatgttttttaataacaacaagaaaaccctctttgttacatttgtatttagattttctgtttcttcttgactcagttttgatagtttgtgtctacttgggaatttgtccatttcatctaagttatccaatttgttggcatacatttgtacatagtatttcattattttttaatttttataaggttactagtgatgtcctttttccattcctgttcaaagtagtattgagtcttctctctgttttttgtcactctaggtaaacatttgccaattttgttgattttttcaaagaaccaaattttggtttgtcggttctctttttctaatctgtttcattcgtttctgctctaatttttattatttccctccttttgctatctttgggtttgtttttctttttcttgttccttgaggtataaagttaggttattggtttgagatcttttaaaatatgggtatttatagccataatgttcctgctaagctctgcattttctgcatcccataattttttgtttgttgtggtatttttttctttttctttttctttttttttaatttttctttttgagatggagtcctgttgcccacgctggaatgcaatggtgcgatctcggctcaatgcaatctccacctcctgggttcaagcaattctgctgcctcagcctcccaagtcgctgggattacaggcatgtgccaccatgcctggctaatttttttttttttttgaggtggagtctgatgcctcccaggctggagtgcagtggtgcgatcttggctcactgcaacctccgccccccaagttcaagcgattctcctgcctcagcctcccgagtggcatggtccaccacacctggctaatttttgtattttttttttttggtagagacagggtttcgccatgttggccaggctggtcttgaactccagaccacaggtgatccacccacctcagcctaccaaagtgctgggattacaggcgtgagccaccacccggcctgttgtatttttcttttcttttctttttttctttttttgagatggagtcttgctctgtcacccaggctggagtgcagtggcactatctcggctcactgcaagctccgcctcctggattcatgccattctcctgcctcagcctcccgagtatctgggattacaggcgcccaccaccacgcctggctaatttttttttgtatttttagtagagacggggcttcactgtgttcggcaggatggtctcaaactcctgaccttgtgatccacctgcctcggcctcccaaagtgctgggattacacttgagccaccacacccagccctgtgtttttattttcattcctcccaaagtacttgtaattgtcatgtgatttattttttctttgactctggatttttaggaatgttttgtttaaattccttaaatttgtgagtttcctaaatttctttctgttgttgatttctgttttaattcatttgtggacagagaacatacttgacattatttcaatcctttgaaatctactgaggcttgctttatttatttatttatttattttgagacagagtcttgctctgtcgcccaggctggagtgcagtggcgcgatctcagctcactgcaagctctgcctcctgggttcacgccattctcctgcctcagcctcctgagtagctgggactacaggcgcctgccaccatgcccgggtaattttttttttgtatttttagtagagatggggtttcactgtgttagccaggatggtcttgatctcctgacctcatgatctgcccgtctcggcctcccaaagtgctgggattacaggcatgagccaccgcgcccagccgaggcttattttatatcctagcaaatggtatgttctgaagaccgttccatgtgcacgtgacaatgtatatcctgctgttgttaggtggcaagctctatagatgtctgttaggactagttggttttcattgttgttcaagtctgctgttgttattgatggtgggaaattacaatcgttattattgctgaacagtctgtttcttcagttatgtcagttttgcttcatagaaaggcttttttttttctttttgtttgtttgtttgtgtttttgagacagagtctcgcactgtcgcccaggctggagtgcagtggtgtgatctcagctcactgcaagctctgcctcccaggttcatgccattctcctgcctaagcctcccgagtagctgggactacaggtgcccgtcaccacatccgcctgatttttttgtatttttagtagaaggggggtttcaccgtgttagccaggatagtcttgatctcctgacctcgtgatccgcccaccttggcctcccaaagtgctgggattacaggcgtgagccactgcgcccggcctgtttgtttgtttttgagacagggtctcactctgttgcccaggctagagtccaatggtgtgatcgtgactcactgacgctttgacctcctaggctcaagtgatcctctcactatggcctccctagtaactgggactacaggtggtgcatgccatcatgcctggctaattaaaataatatattttttgtagagttggggtcttactgtgttgcccaggctggttgcgaacgtctgggtttaagtgatctcctacctcactttccaaagtgctgggattacaggcatcagccaccatgcccagcctgtttcttttactacctgtcacccgcaggacttgcaccttcgagatcccctgtgtttacccagctggaggatgatgaacagtcgtgggtgcccagctgggtggatgtgactccagtcagcagagcagaagccaggagaggttttggtcttggtaagtggagtggaggggaataccttggtttcagcagtgggctcacagaatgctgagtacctgcatacaccgataccttggtgttgagggcagtgaccataccttatttccttccacctttcctgtcttatgtggacactgtgcagtctgccatctctaccatgattttcaggccccgcatgttcctgcctctctggcctgcgtctcctcattgcccttctctgtatctgtgcagagctgtctactgttggcgactcagtgcgtgtcttgaaatgtgcacatatccttaaacaggtatttgaacttcagccaatccttaattaatacttaaacaccagctactattttggaatcacattttgctgggactagacacatgcctcctcatagtgcttggctgtcaccagcagccaaggccctgctgaaaccctttgcagaggagtgacttggagaccccacctctcttccctgcaccatatcctatcttgtgccctcatctcagttgaggttttccttagtctgtagtctggtggagccatattcagttgtgccaggctttcccaacccagacctttcctagcaacctctcagcaattcttttttttttaagatggagttttgctcttattgcccaggctggagtgcagtggcgcaatctcagctcactgcaacctctgcctcctgggttcatgccattctcctgcctcagcctcttgagtagctgggactacaggcgcctgccaccatgcctggctaatttttttttttttttttgagtcggagttttgctcttactgcccaggctggagtgcagtggcgcgatctcagctcactgcagcctctgcctctggattcaagtgatcctcctgcctcagcctcccgagtagctgggattacaggcatgcatcaccacacccggctaattttgtatttttagaagagatggggtttcgtcgtgttggtcaggctggtctcgaactcctgacctcacgtgatctgcccgccttggcctcccaaagcactgggattacaggcgtgagccaccacgcctggccctttcagcagttctatggagtccttctgggtgtgtctgacatgcactggtgattaaggtacctcctccctctagttcaactcttagtaatgattcatctctgctttcagatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctcttttaatattgaggttctgatccctgtgtgtggagagattgagaatagaatccggcactatcaccgtaagttgagggaatggcttttgtggaggtggtctcttgagttttttctgcctcagtggggatggcaggatgacagaaaatacctctagtcaaggttggcctaatttgtattggcccctgagtcctccagggaaagacttgtagcctggatgtcaggcttttttgtgggtccagagctcaccttgcggaagggaatagttggtgagagatcttctatatgtttatggacataaaaagttgggttccttgttcccagggaatgttccagaacttccagcattggtcagaaggagctgtttccagattcagctcaaaagtcatattctccaaaatctggaacatggaggtaagttatagactgactctaagacctataggggcctgttgggtagagtaatttgagtagagtaagtgggcatagaaatattgagtgaagtagtatggagtgaagtgtctgataaacaagaggatttcagccagttctaaagaggcatccacaaatgttccagcaactgaggtttcctggggtgagggcaccagaacttctcagcaattgcagacctgttatttgtgtcaaggtcactgtcagcaaataatctacagactttctggattctcatatcctctctgggctgttcacctctcatggccattatcctgagactgaaagattctatagtcctgggatgtgccttttgtgacccagccagtactcctggtgtctggatgctgtggcctttgcagttgtcaagtttttgctgtcatggtgtcagggctttccctctggggctcaagagagacacgtagggtaaccaaagtatggatccagatcttgcggtttatgggaccttttcagagtcttgctgtgtcacgcagcctggagtgtagtggtatgatcacggctcactgcacccttgactccagggattcaagtgatccttctacctcagcctcctgagtagcagcgactacagttacacaccaccacactcagctaattaaagaaaaaatcgttttaggctgggcgtggtggtcgatgcatgtaatcctagcactttgggaggccaaggtgggcagatcactttaggtcaggagtttgaaaccagcctggccaacatggtgaaactccacctctactaaaaatacaaaaaaattggctgggtgcagtggctcacgcctgtaatcccagcactttgggaggccgaggcaggtggatcatgaggtcaggagatcgagaccattctggctaacatggtgaaaccccgtctctactaaaaatacaaaaaaattagcccggcatggtgacgggcgcctgtagtcccagctacttgggaggctgaggcaggagaattgcttgaactggggaggcagaggttgcagtgagccaagatctcaccactattctccagcctgggtgacaaagcaagactctgtctcaaaaaaaaaaaaaaatttgggagtagggggtcaggattggcggctcatgcctgtaatgccagcactctgggatactgaggtgggaggatcgcttgagccgagaagttcatagaccagcctgggcaacatggcaagaccccatctctttaaattttttttttttttaagagacaaggttttgccatgtgcccaggctgatcttgaactcttgggctcaagtgatcttccagcctcagactcccaatgtgctggggttggtgtgacactgttcctggcttatacccacttttattttattttattttttttgagatggagtcactctgttgtccaggctggagtgcagtggtgtgatctcagcacactgcaacctccgcctcccagggtcaagtgattctcatacctcagtctcccgagtagctgggattataggcatcggccagcatgcccggctaatttgtatttttagtagagacggggtttcaccatgctggccaggctggtctcgaactcctgaccttgtgatctgcccacctcagcctttcaaagtgctgggattaccggcgtgagccaccgcacccagcctatatacccacttttaaagacatacgagatgctaaatgttattcagaatgggctagaaaatgggtggtaacttccagctgttgccatgctaaggggcagtaacttccgagtgttgccaaggcagtggcaaactgccatggcaatggcgggcctgtcttacggggaagtgctttcagcgccttttcctgatttcagcgtcttcaacctgctctggagtagagtcccatctgcctcctacctcagcttcacaaaaatcccttgaaggaggaattatcttcattttccattgctcccccacttccccagactggctgctggataggatattgatcaccttgctgcctatagaaatctcagtgctgcttttttagggggaacggaagccaatccacattgtaatttttttttcttttgagacggagtctccccgtcacccaggctggagtgcagtggtgcagtcttggctcccaggttcaagtgattctcctgcctcagcctcctgagtagctgggattaacaggttcgccgcaccatgcccggctaatttttgtatttttagtagagacagcgtttcaccatgttggtcgggctggtctcgaacccctgacctcgtgatccgcccacctcggcctcccaaagtgctgtgattacaggcgtgagccaccgtgcccagccatgtaattttaaaaatgtaatttataagagcataaaattatgaaatacttagaaataaatttgacaaaattatgcaagacttgtacactgaaaactacaaaatgttgctgagagactgattgaagaatacctaagtaaatgaggacatttaccatgttcatgaactggaagtctcaatattagtatgttaatcctcccaaagttgatttgcagattcaatgcagtcccaataaaaatgtcactaggttttgttgttgttgtttttgactcgctctgtaacccaggctggagtgcagtggtgcaatcttttctcactgcaacctccgcgtcccgggttcaagcgattcgcctgcctcagccccccaagtagctgggactacaggtgtgtgccaccacgcctggctaatttttgtatttttagtagagacagggtttgctatgttggctaggctggtctcaaactcctaacctcaagtaatctgcccctcttaccctcctaacatgctgggattacaggcatgagcagttgatcaaattcaacatcccgtcatggcagaaactctcaactaggcgtagaaggaacatacctcaacataataatggccatatatgacagacccacagctaacatcttactgaatggggaaaggctgaaagctttttctctcagaactggaacaagacaaagatgcccactttcaccactcctattcaacatagtactagatgtcctagccaggcaagagaaaagaaaaggtatccaaattggaggagactaagtaagttgttcctgtttgcagatgacatgatcttatatttagaaaaacctagaccccaccaaaaaaactcttaggtctgataaagagattcagcaaggtttcaggatacaatcaatgtacaaaaatcagtagtgtttctatacaccagtaatgatctagctgaaaaagaaatcaagaaggcaatcccatttatgatagttaccaaaatatacctgggaataaatttaaccaaggaggtgaaacacctctacaaggaaaattacagaacattgataatagaattgaagagacctttggattcatcctcacattcttcctcttctgcccacaaataacccccttccaaaaaaaaaatgatacaaacaaatggaaaaacatatgctcatggattaggagaattaatatattttgttttgtttttgtttgttttgagacagagtctcgctctgttgcccaggctggagtgcaatggcacgatctgggctcactacaagctccgcctcccgggttcacaccattcttctgcctcggccttcccagcagctgggactacaggtgcacgccactatgctcagctaattttttgtatttttagtagagacagggtttcaccgtgttagccaggatggtctcgatctcctgaccttgtgatctgcctgcctcggcctcccaaagtgctgggattacaagcgtgaaccaccacacccggctgttttttttgagacggagtcttgctctgtcgcccaggctggagtgcagtggcgcgatctcggctcactgcaagctctgcctcccggggttctcgccattctcctgcctcagcctccagagtagctgggactgttggcatgtgccaccacgcctggctaattttttgtatctttagtagagacaggttttcaccatgttggccaggctggtctcaaactcctgacctcgtgatctgcccagcttggcctcccaaagtgctgggattgcaggcatgagccactgcgcctggcagaagaattaatattgttaaaatgaccatactgcccaaagcaagctacagattcaatgcaatccctatgaagatatcaaatgcattttttccccacagaattagaaaaagttctcagagctttgtagaatcaaaaaagagcccaagtagccaaagcaatcctgagcacaaagagcaaagctggaagcatcacactacctgacttgaaaatatattacaaggctatagtgaccaaaagagtgtggtattggtataatagtcacatagaccacggaaacataatggagacccagaaataaatccagatatttacagccaactgattttcaacaaagatgccaataacatacattgggaaaggataccctcttcaataaatccaaaaactagatatccatatgaatgaaactagacccccatctctcaccgtatacaaaaacaactctaaataaagacttaaacatatgactcaaaactgtaaaactactagaaaaacaagggggtcggggcagtggctcacacctgtaatcccagcactttgggaggccgaggcggacggatcaccagaggtcaggagttcgagaccagcttgactcacatggtgaaaccccatctctactaaaaatacaaaaaaaaaaaaaattagccaggtgtggtggcgcatggctgtaatctcagctacttgggaggctaaggcaggagaatagcttgaacccaggaggcggaggttgcagtgagctgagatcgcaccattgcactccagcctgggcaacaagagtgaaactcagtctcaaaagaacaaaataaaacaaacaacaacaacaacaacaaaggaaaaggaaaagcacgtgttgggagaaaatatttgctaaatatattcgacatcttttatctcaaatatataaataacacttataactcgattataagttaataatcatccaaagtttaaaatgggcaaaagatctgaacaaatatgctttgaaagaagatatatggttatcaaatacacacttgaaaagttgttcaacgtcactagtcattcaggaaatgcaaatttaaactatgatgagatacaactactacacatttattagaatcgttaaaatgaaaaagacaaacatacaaatatatggcaagaatgtggagcaactagaactctcagtgagttctaatataagtgtgataaatttttttgaaaacagtttgacagttcttaaaatgttaaacataaaagccgggtatggtggagtgcacctgtagtcccagctacattgggcaggaggatcttttgagcccaagagtccaagtccagcctgggcaacatagccagaccctgtctcaaaataaaaacaaaaacaaaacaaaacaattaaacatacacctaccatatacccccaaaattccacttctaagtatctacccaagagaattcaaaggatatattaacacaaggacttgtacacaaatgtttatagcagcttcatttgagatagtcaaaagttagaaacaatttggccaggcactgtggctcatggctgtaatcccaccactttgggaggccgaggcgggtggatcatgaggtcaggagtttgaaaccagcattgccaacgtaatgaaacctgtctctactaaaaatacaaaaaaaatcagccaggcgtggcggtgcacacctgtagtcccagctactcaggaggctgaggcaggggaattgcttgaacccaggaggtggagcttgccgtgagccgaaattgcgccactgcactccagcctgggcgacagagccagactccatctcaaaaaaaaaaaaaagatggggtcttgctctattgcccaggctggtcttaaactccccggctcaagtgatcctcctgccttggcctaccaaagtgctgggattacaggcgtgagccatcacgcccgactgaacctcttttccttataaactatctagacttagatttttccttccttccttccttcctgtcttccttcttccttccttccttctttccttttttttttttttttagacagaattctgctcttgtggcccaggctggagtgcaatgccgtgatcttggctcattgcaacctctgcctgccgggttcaagcaactctcctacctcagcctcccgagtaactgggattacagccgccaccaccacgcctggctaattttttgtatttttaatagaaacgccgtttcaccatgttggccaggctggtctcaaactcccaacctcaggtgatctgcctgcctgggcctcccaaagtgctgggattacaggcatgagccaccatgcccagcctgagatatttctttatagtaacacaaaaacagcctaacaaaaaggtcacatagtaggtaggatttagtaagaaagagagctgagatttcaaggcaggtgaactgggtctaatgtttccactgctttactcacctctccctacctctagatttccaccctcccatgttgaaatctcttggttataaattttcacttgtgcttctttcttagatcaccttcttgaatcacagtggtgtctattttcatatccattgagggtatagtgattccttgagggttacaaggtctgcagatcgatgagttcttggcattttggagaggccagagactggtagctctgagtcattagttgtcaggccatgcctccccatcaaacaatcgaagcttggctgacttctctgagtgccagaagaaggctggggctgggggtagaggatctgggtttcacaagaggcgagtctggaaatgtcaaaattggggtccaaggtgagaggatggcgtggtaggacaacattgtctgccatccgtgtataatggctgaagctctggttagtgggtgtggcctaaggagaatgtagtgattcccactgtcggtgtaaagggcttcatattgatggagagttttctgtgttgtcagaagttctggtggacactgtgagacagatttcatggatttatagatgagacagctgaagcttgggagtctgtgccccagatcgcacaatttattagcagtaggagtccaagttgagccaagccagagaaggttactgagtgttttggcacccttggccttaatctgctgctcttcagatttcacagcccccatgttccagatagttcactcaaagcttgggagttggagatgagggaatcaacagatgctgacactagcatgaaggagaggtatagctgatctggaggtatgattgggagaggttgagaagcctttcaagggtgtccctgatgtgggagggcacaagcaaaggcccaggggcaaggaactgcccagtagattccagaagagaactaccattgcatacagcagagtgtacaataacagggtagtcagtacactgcatcaaggggctgaaggcaactgccttttggtttgagcatagtctgaaagcagtggagccactgaatcccacaaaagctggtaacctggacagctcaaaagtcacagccatcaggactttgcctggaatattctggcattattggcaaacatctatcttcccctaacaggttggctgctgtatactgagacccagtcggagatcagaaggcaggttcagtagaaacacgtaggactctactcatgtattaggaatcttttttttttccttttttatttttattttttattatttttttgagacggagtttcactcttgttgcccaggctggagtgcaatggcgtgatctcagctcactgcaacctctgcctcccaggctcaagcaattctcctgcctcctgagtagctgggattacacgcatgcgccaccatgcctggcttttttctttctttctttctttctttctttctttctttctttctttctttctttctctttcctttctttctttctttctttctttctttctttctttctttctttctttctttctttccttccttccttccttccttccttccttccttccttcctttcctttcccttccttccttccttccttccttccttccttccttccttcctttctttctttttctttctttctttctttctttcttttcttgtagagatgggatttctccatgttggtcaggctggtctcaaagtcccaacctcaggtgatccgcccgcattggcctcccaaagtgctgggattacatgcgtgagctaccgcgcccagccttttttttttcctgttttagagacaaggtctcattatgttgcccaggctggagtgcagtggtgcaaacatagctcactgcagtcttgaactcctgggatccagtgatcctcctgcctcaagtagctggaaacaggcatgccacaatcatgcccagcaccatcttatgagatctaatcttggccactcacacagaggattgagctctgatgacgtgtctaccctaactttatttgcttagaaggctgagccccatatggctcagctaacctttaattctgatcccacatgtgtcttacatattggagacattagcatcttccatattggagacattacactcaggaaggaaggcctgagtagggtaggtatcccccagacacctcactgtgctggggagtatttgagaagccctgctgtaaactttgctgacggcaaaactgttgtggcttctgctcacaatgtggttatcattgtccatcccctcaggggcttccaggagacgtggcagctgcagtggcctctgatccatcatacagtatggatggacaccacaggccaaagattctcatgtcagaggatttccggtcttttctcccctaggcctcaggaggacccagggaaatatctaaagccaacctatagttttggtgaactgagtttgcattgaaatgtttttggaaatgattttcaacatttataaaatcacatgccacatagaaatctgaatatttggctcttcttggaaaaccaggagatatgggaaatctgtactgactccaccatattgtctccccaccccttaagagggacagacctgcttggtggccaccagaagtggaattatgaaggccacggccatatgattctcaagaaaccctggctactcacataagccactccagaccatgatttctgtcttctctgtcttgaggtgcctacctgtgcagtgatggccatgagatgaacagcccagggagtccacaggaaatccacaaaatatttatttgaatttcagttatgagtgacacataggtctgcatgtcctgagaagttctgtacacccttatctcacttggccatagtcattggaagtttctgatgtgcgtttagaacagacatgtcccctcttgtctaccacagtcttctccacacttagagtttttgtaccaatgatagttcccacatagccctggcaggtctgaaccagttatgcctgcctactgagttttatatttcatgagtcatgagccatgggcaggtactgggggatgtagctggtaaagtgggacatgcattgggaacagaggaccaaacttttgctgtggaggttctcaaagaaactaccccattcttcagagctagctctgggcccacaggtgacccttggtgtccagatcacaagattcagtccaagcctgtcagtctttcataggaggccttagggcaacaagacaaattcaaccaaaactggactgagcactcttcctgcccatgcggctgtttgagacactcagtgcccccttacaaaagctgttctttttatattaggatgaattgtttcaaaccacctcaccaactctgatgcaggtggctaaacattaaggcctttgttatctcagagagagacaggcagatccaggagtgagtgattgagactaaacagatcattcctaagtgtcacatgtagatgcaaacaatgtccatgaagagaaaccttttcttctattttagatggagtctcacactgtcgcccaggctggagtgcagtggcacgatctcggctcactgcacaccctgcctcccaggttcacaccattctcctgcctcagcctcctaagtagctgggactacaggcacccgccaccacacctggctaattttttgtatttttagtagaggtgggttttcaccatgttagccaggatggtctcgatctcctgacctcatgatctgcctgcctcagcttcccaaagtgctgggattataggcatgagccactgtgcccggccaagaaaccttttctggaaagctccagaagacaccagctcagatcttagcaagaattgtcataccaaaatctaaagccatcagtgggaaagaaaatgaaggtactcaaagcctatgtaattctctctagagaatggaaaagggagtatagtctgctttcccttagcacagtgagggagactgatacatatcatgagatcttgccaggtggcagagatgagacagtatggcaggcagctttggacatggcttccaatgatctctgccctctggtattcatgctcttgtgtaatgctctccccttgactgtgggctggaccaagtgacttgcttctaactaaatttagcaaagatgatgggatctcacttctgttattaggttacaaatgactgacttgttggtattctccactgcatgatcagcttgcaagctttgattgacaagctgccattttggagaggcccatgtggcagagaactggaggaggtctcagaccaacagacgggtcctcagtccagcagcccacaaaaaactgaatgctgccaattacatgagtttgcttggaagcagagccttccctagtcaagccttcagatgatacacccccagctgacatcttgatgttagccttgtgagaaaccctaaagaggagtcagctagctgcaccaaagttcctgacctatagagactgtgaaatagtgactattgttttaagccactaggttttgagtaatttgttacacagcaataggtaactaatacagatggcttctgcaatagcagtaatacagtgccgcctaagattctgggagctgtggctttcccacatttgttgcccataactctcttgtgaattctctggtgatttttcttaaaagggggtgtctatagctgaaggctttcccattttcactgcatttgtaatgcctttttcccataggtactttatatagctttctcacataggagaggtgactgaagaccatcccacattccttagatgcaggggttttctctactgtgaattttttggttatagataagaatcgatttcttcttgagggtctttcttcataccaagtatttaaagatctctcttcagtgtgggttcttaggtggttgaagagggcaaaagtcttcatgtcttcccatagccactgctcttgaagggcttctccctatcatggcctgcccggtgttatctgatgttagagctgtgtggcagcatcttctcactcagctcttcttcatggcttccctgtgccatgagtactctggtgatggagaaaggaaggcctttccacattctcttttgagcttctcattattctggtactccagtgctggaagggggtagttaccctggaaagccttcacaaatgcctggcccttgagtcctctcacttatgaattttgctgtgcatgaactgaaaagtgctcttactgtgagccatgtcacatctgaaaaggtggtcttcaccataaatggtctactgttggtgaaggtttgatccactcccttgtgtggggtttctacctggagtacactgcctaacgttcagccaggagtacaatctttggcagggcaagggtgccatggtcagggtgaggaacgaccagtcatggagtactggtcctgtcacatatcccactactgagcctgttaggtgacattcacataggcagggagaacagagagggatctaggacagatgtggaagcagcagtggctactgaaactgctgttcagtgatgtgagcccaggccacccttcttttctagagatggggccttgctatgttgccctggatggactcaacctcctgggctcaagagatcctcctgcctcagcctctcaagcagctaggactataggtgtgcaccactgcacctggccaggcctctcctttatggggactcctgttcacatcccagccaatgctctcatgagtacttccttgtatgggggaggtcaaagaaacagcagcagctcacatgtgatgatgctgaaattacatggtaaataagctttttaaaataggtgccggccaggtgcggtggctcatgcatgtaatcccagcactttgggagtccaaggcaggcagatcaggaggtcaggagatcgagaccatcctggctaacatggtgaaaacccgtctctactaaaaatacaaaaaaattagctgggtgtggtggcgggcaactgtagttccagctactcgggaggctgaggcaggagaatggcgtgagccatttaggaggtggagcttgccgtgagccaaaatcgcgccactgcactccagcttgggcgacagagcaagactccatatcaaaaaaaaaaggtgccaaacaccatattctacaaggttctggatctctagctccttctaaaataccagctctgtcaactgtgttaaatgcccccatctgcctgtgcccactctgttggccagcaagactgtgaaggcatgaagtgtgtgttagtgaccagaaaccctggccagactgcaaaaaccactttcctggacgtcaggctatcacttctctcagctcccagttcctacctggggagtgatgggtgccaagatacagtttgagagaggtgaagtgaatgtacatgacattgcatttatctgctttaactgtggcaaaaactttaacatggcaaatacaaaggtctgtagctctggagttgttctgcacaccctcaccctgcacagtcccagttgatggggaactatggctattcctttgtccatgatggcatgtgccctagttcaccagtctacccaaatccctggttattacctcacatccagtgtttctctatgcacatagagtcctccatggacccctctaggtctttgccttggtgaccctgtgactattttagtgttgtagatgagtttatttttcctctgggtaagctctgggccctacggtaactgaaacaggccactatgttcaatccagagcctttcagtctttcccagtctttcacacagcaatgcaaagtaggctacaacaggacagagcaactacccgctcttctactgtgcccttaggcagattttgtgcccccaaaaggcactccccaatctatccattcattttctcaacctaccccaacagaacccctaagattaaaggtgacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtgacaaataaggctggattttcggctaaagaatttcccacattcactgcatttataaggcttttctccagtatgaactttctgatgcttaatgagaatggagttttggctaaagaatttcccacattcattgcactcataaggcctttcttttgtgtgaactctccagtgttcaatgagagtggagctgtgagcaaaggctttcccacactcactacactcgtaaggcttttctccagtgtgaattctccagtgctgaatcaggctggagctgcggctgaaggatttcctacattcgctgcactcataaggcctttgcccagtatgtactttctggtgctggatgagggtggagctattactgaaggctttaccacaatcacagcattcaaaaggccgttctccagtgtgaactttctgatgtcgaaggagatgggagctttggctgaagtctcttccacattcactgcactcaaaaggccgttctccggtgtgaactttctggtgctgagcaaggttggagttattgttaaaagctcttccacattcactgcattcatacggtctttctccagtgtgaactctccagtgctgaatgagagcagagcttcggctgaaggatttaccacattgactgcactcataaggtcttacctgtgtgtgaactttctgatgccgaaggaaattggagctttggctgaaggctcttccacatttcaggcactcaaaaggcctttctccagtgtgaactttctcatgccgaatgaggtgtgatctgttactgaaggctttcccacattcatcacactcataaggtctttctcctgagtgaattctctgatgatgaacaaatgtgagtttgtggttgaaggttttcccacatgcaatgcactcataatattttacttcagtgtgaaatttctggtgcttcctcagcttagatgagtgactaaaggccttcccacactccttacacacatggggtatttccccagtgtgaaactttttattaccaaggattgatttctcctctaagaaatttccacctgttgggcatgtaaatggtatctcttcagagtgagttctcagatggttggggagagtggagctcttcaggaaggcttttccacagttgctgcactcgaagagtttctgtgtggtacagacttctggaagctgcccaagattggaatatggcttctgcccactgtcaacagcttgaagctggaggaggtcacagctgcccaggatgaccttcccaccttccctgcaagtgaaggggttctctgacaggtggactttagagctcttcataagtgcgtccctgtccttgtaccatctaaagggcttccctccactgtgctccttctggtgctggtgaaggtttgcattcaaccaaaagtctctcccacatgctccacatgtgtagggtttctcctcagactgtgttccctgatgctcagccaggtgcaaaatgtctttcaagaatggcccacacatgtcacaggagttagctttcttggtggaaggatctgcattagggatcctgacctgtaacacttctacagaaacattctgcttgggatgggccccctcaccctctactccatgccaagaacctgaaagtagagaaatgccagttaactaagaattccacttggtgggaatggttgacttcattagaaatgttacccaggaattcacacccaagaagaggtcccagggattgctgacaggccaacagggccatcatcagggtgaagaagggcccattactattggcaggatagggaccagccaagcaacagaataagggagacctcaccaggggtaaggacacagaaatgggtcaaaggacttaaatagacatttctctaaaagaagatatatacacaaatggccaataagcatatgaaaagaagttcagcatccttaaacatgaggagtatgaaaaccaaaaccataatgagataccacttcacatccactagcatagctataataaaaaaaaataaatgacaacaaatgaagtagaaaaactggagcacttatacactgcagacagggatgtaaaatggtgcagccaatttggaaaacagtttggcaagtctgcttctacagagctacacaagagaactaaaaacatccacacaaaaatgtgtacaggactgttcatagcagaatttttttaaaatttgagatggggtcttgctatgttgcccaggttggtctcaaactcctgggctcaagtgatcctcctgcctcagcctcctgagtagacggattataggcaccttgcccagcttctatagcagcatttttttctaacacctaaaaaatggaaacaagccaaatgctcatccactggtaaatggataaacaaactgtagtctttctatacactggaatatttggctataaaaaagaatgaaatattgatacatgctacaacattgatgaacttcaaaaacatgctaagagaaagccagtcacagaaaaatacatagtattctataaaatgtctaggaaacgtaaatctatatagtcagaaagtagattagtggttgcctaggaccggggggaaagggataagggaacatggggagtgacagctaatgggactgctaataggacctacagtttctctttaggtgatgaaaacatgctaaaattacattatagcaatgattataccatgtgaaaacatatagaaatcactagactgtgtactttaaaaggtgaattgtatggtttatcttaataaagctgtttttaaaaaatatctcactgggggctgggcgtggtggctcacgcctgtaatcccagcactttgggaggctgaggtgggtggatcacgaggtcaggagattgagaccatcctggctaacatggtgaaaccccctctctactgaaaatacaaaaaaaattagctgggtgtggtggcaggcacctgtagtcccagctacttgggaggctgaggcaggagaatggcgtgaacctgggaggcagagcttgcagtaagctgagatcacgccactgcactccagcctgggggacagagcaagactccatctcaaaaaaaaaaaaaaaaaaaaaaaaaggaaaaaaaaatctcattgggaaagagacagaatctgggcatgacctcatactgggtaacccgaccagggattggtgaatctcagtgggatctgttaggcagactggaggtgtctgatccccaacctttgcctccacaaggctcctgggcaacagctattaggaaagctcatgaggctgctcagagagagacaggggaagtacacacagcagaacctcagcaccccagcacctacaacaggaaacccgagaaggaagcagtacccatgatctggctttgggatgaacagagctttctatggggaaaagacacaaggcataaggtagtcatcaccatgctgagacagggcattaccaagtgaggtcacaagctcaaggttttccagcatcacactgtggtacaggtgcctctgggctgcatcaaggagctcccactcctcttgggagaagtatacagccacatcttcaaaggttaccatgctcttcaatgtggggacagctgagccacagggccaagaagtatgctgacaaagaaacaaacaattggtcaaatggaaatatgcaggaccttgctgtgtgactcagaatcctgatacatctaccactaatatctctttttcttatgatcctctcagtccacccactactcacccatccacagcttatcttcttcctcagggcccccacctaacatgccctggaattaatggtgcccctctctcctagtagtcccactggtcactgtatccaggccaacccaacctagaggaacaataggcaggtgggcagatggatgcttcctcctccctcctgctggccaattttccttgtgtcttctggctcatacctcccaaacataagaaaatttgggcttccctttcttaagcctcttgtaccagggccatgggcccaatggttcacattctctcacctttacatgtcactcctcagaccatacagttcttatatttccaacccctccctgttcacactgtaggcattctccctagcatctcaccatgcacatggcatacctgacagatgcaaccgggatccattcctggtccaagccagctacagagctccaaaaaccccactgcaagaggcagtcatagcccctcaagtcaatgcctcccctgccagccctgttccttcaaccatcagctgcccagaaccataagcagatctcaaatatctcttccctctgatatctttgcctttgtatgtgttgtctcctccccagtcatagctgtccttgctcttcctaacactcaaatccaagatccactggcccccaccttggcttggggactcagcttaggctgaccctttctgatcttgccactccaccagcctgacaaaaaccccaggaccctatttaagaagagataacatgccctgaccacaagaaggatggccgcaacaatgtagtgagctgtagagaagcaaatcaacctaaaccaaagcccaactctcatcctacttttgccgctatgcttcactgttgtcctagacctactctctgctcaggaggctcagccactatcttgaacccaacccacaactgcatgcagtgtccacacacaagcatccatcccttggatgtttccagcctaaacccgacataatttcataatcacatgtttagtggtctacttggcacctcaatttggtagtgtctgggacatctcaaatacaacatggccaaaatccaactctttatcttccccctgaaatctactcctcacaccaacttccacatctgaaagatctaaggtcaatttttttttttttttttttgagacagagtctcgctctgtcacccaggttggagtgcagtggcgcgatcttggctcactgcaagctccgcctcccgggttcaagccattctcctgcctcagcctcccgagtagctgggactacaggcacccaccaccacgcctgactaattttttgtatttttagtagagatggggtttcaccgtgttagccaggatggtctcaatctcctgacctagtgatccacctgcctcggcctcccaaagtgctgggattacaggcgtgagccaccacgcccggcaatttttttttttttttaagacagagtctcgctctgtcactcaggctggagcgcagtggcacgatctcagctcaatgcaacctccatctcccagattcaaacagttcttctgcctcagtttcccaagttgctgggattacaggtgcacactaccatgtcctggctaatttttctgtatttttagtagaggtggggtttcgccacgttggccaggctggtcttgaactcctgacctcaagtgatctggccgccttggcctcccaaagtgctgggattacaagtgtgagccactgcactcagccttaggtcaatcttaacatttcactttctttcactgtcccacatcaggtaatccatggcccagtttgggcagattcagaagccaaccatctgtcctacctccacgggcacccctctgtccagctacccaaagcacacatctggaccacatctgtcagctcctcactggccttcctgctccaccatcaccatccctccagtctgctgcccactaggcatccatagggcgtctgttaagactggagtcagagcacctacttcctctactccaaaccttccatggctcccaccaccatcagaatagaggtccagctcctcaggctgccattccaggcctaactattggtttcccttccctgtttccaccagactaaatggagaccggcagtccccagaatgcttccatttcatcaccactaaacaaggtacacatgctggtcactgtccctgggacagccttccagatctcattccacaggattccagaaatgggaatccctcgatataaccccttgcctggattcaggatggtaagggtaagtgactcccagggcagggcccaggacccacgtgtgaggacaggacacgatcaagagtcccaggacaccaacatcccctctatctgggcttcaggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagccggcccagtgggaccctcaggttgcaccgcgcggaggtgtccgcggctctcgggagtcgtcgcccttggcgttatgttggctttagggagcgcgaggccgaggccaagaaaagctacgcattgggaggtcttgacccagtgtgcgcccggctgtaggcatggaacgtgcgccaaaggtctcctggcacccactccgctggactcagcaccattgtcctaagtctccgattgagaagtatctgccccaggtcctctgcgggccccactgaacagtgtggagcgttcacaggttgggggtcaccatttcagaatccagtttgttgagacgtggagggtacaggaggagggatctgcatatgcgaagacttggacttgaccctgacctgagcgttcaggcaggctctcatgcccccttggcagcgagtggagagcgtaagaggagtcctgcctctcctggcacaccgagggcgcctgggagccatgaaaggtgttgaacagaaaagggatggacatgacctgagttagaatttggaaagtatttcagtggttgctgaatgaacacactactggagaaggtggttgtagtggggctggaagcagggagactgtgggggaggttattgcagtattgttccagacagttatgatagtggcctgtccagaacggaagcaagaaggatgggagaagtgatcagattcccagtggatcttcaagatagagctaatggaattttttgctaccttagataagtggaataagcatgagtaggggtgaaggaccatcccaagtagttaggaagaattaggatgcctcctgtggagaatagaggttggcagttggcaggaggaggatgtttcatggaagattagcgatggattttgtaggtatagagtctgaattgtctggagacctgtgagtggaggtgtcaaatgggcctctggatatatagaattctggtgtggcttcaggacgtccagactgcattatgttggtggcctggcccagtgaacggcctgaggataggatttgggaaggagggttttaggttggaggaccagtggctagggctcacgctcagtgcttagatcacatctgtctgcccattggcttggtgttgcagggcttaatgacctttgaggacagggtcagtacatcttccaagaatgtggggctccttagtgaggtccaagggggcttctacagtgacatgatactacagagctttgtactccagtgcccactaggtaaggctactgtgtctcctctttcccctacacatgaaatctaggttttcctccgcctttccattgttccctctgggaggtgctgctggccctggcactggccagtgtcctgctgtgtccggaattgtttccttcctctgggttcttggtctcgctgacttcaagaataaagccgcggaccctcgtgttgagtgttacagttcttttttttttttttttttgagacggagtctcgctctgtcgcccaggccggactgcggactgcagtggcgcaatctcggctcactgcaagctccgcttcccgggttcacgccattctcctgcctcagcctcccgagcagctgggactacaggcgcccgccaccgcacccggctaattttttttttttgtatttttagtagagacggggtttcaccttgttagccaggatggtctcgatctcctgacctcatgatccacccgcctcggcctcccaaagtgctgggattacaggcgtgagccaccgcgcccggccctgttacagttcttaaagatggtgtgtccggagtttgttccttcagatgttcagatgtgtctggagttttttccttctggtgggttcgtggtcttgctgacttcaggagtgaagctgcagaccttcgcagtgagtgttacagctcttaaaggtggcacatccagagttgttcattcctcctggtgggttcgtggtctcgctgacctcaggagtgaagctgcagacctttgcaatgagtgttacagctcgtaaaggtggcgtgtccaatgttgtttgttcctcccagtgggtttgtggtctcgctggcttcaggagtgaagctgcagacctttgtggtgagtgttatagctcataaaggtagtgtggacccaaagagtgagcagcagcaagatttattgcgaagagcaaaagaataaagcttctacagcatggaagaggacccgcgggttgccgctgctggcttgggtggccagcttttattctatttggccctgcccacatcctgctgattggtccattatacagagcactgattggtccattttacagagcactgattggtccattttacagagcactgattggtccatttttacagagtgctgattggtgagtttacaaacctatagctagacacagagtgctgattggtgcatttacaatcctttagctagacagaaaagttttccaagtccccagccaattagctagacacagagcgctgattggtgcgtttactaacctttagggagacacagagcgctgattggtgcatttttacagagtgctgattggtgcgtttacaaacctttagctagacacagagcgctgattggtgtgttggcagtcctttagccggacagaaaagttccccaagtccccactggacccagaagcccagccggcttcacttttcactgctacttatccctggctgctgcataaacaacccccacaccttccctgggatcttgacaaccttgtgaagccacagtgatggtccctgcacccactcccacgcccttgtccagctctagaggcctcctgtagcccaacccacaagccacaaaatgaggaccatcatggcggtgccggaaatctcacccctcaatgcccacctggaatcggaagtctcaaaacctgtgtagcatatcacatgcagctgggtcgtttcctggctaggttaccctgtcaggatctgtgacttttctgtcctttctgccacattccctcactctagtaggagttttctgccagctgtcccttgtgagtcccagtgggcactgacatggtcattgattgtggggtcactgagcattgactttgtgaagttcagttctttccagctatatacctgcataggtgatcttcacctacggtgatttgtcatggggtggatcaccttgacgtgggctgccttctcacaaaccacttgatgagagctgtataggatcactgccaccacccccgccatgtgatcacctaactagaacaaatgaagagacctggctggtggacagggtggcttgaattaggccatggacagagaggccccatggtgcaccagttctgttgagtggaagacagctgtggcagagctgttggcagtgccctggtggctcacctggtacctgagttgtgccctctgttgtcctggcaccaggatgtatagctgtgccttttaaaaaaaattttcctgaccttcttctgacactctatcctactttgccctgactcctgttccctggatggcttcctctctgtcttccaagattcactctttccccttctcccgtcctcccctccagtggccaggtcttctaccattggcctccctttaatgtgtcttgaacggataatgtatctttaaatagttgttatctgcacatggtggctcataactacagtcccaactacttgggatgctgaggcaggaggagcgcttgagaccaggagtttgagtccagcttgggcaacataacgagatcctatctctaaaataaataaataaatacatagatacctaaatagtttttgaaaacctcttcttccgtgagactggcttgttccatttgaggagtatgggcataggtgtcaatggttcaagacctggacttcgctcactgcatggtactgacctgtcaccagacactagggccctgcagctccacattttgcagaacctacagagaactgacactgaagagatagctgataaatacacagcatatggaaaggtgtttgaggggaagcaagccttttctcctaccaaaaaacttcacagtggaaaaaattgcaagtgtattatgagcatgggaaggccttcacttttgtcttcatcctgagaaagcaggagtacatgcacatcttcaaaggcccttacaagtatagtaacatggggaatcctccagccagaactctacctcctttgagcaccaatatgttcaccccagagaaagtccccataagcgcaaggagtgtggtccagccatgagcaaaattttgcaaaactctcctctgtatcaaaatggtcataccctaatgaaggactcctaagttcagggaatgtggggcactgccagctgtcctggtggcttccctggtacctgacttgaggttcatacatgttatattcagagttctgctttcattagcaaaaacaaattaacaccggaaaatggttgtacaaatgcaataactacatgaaagctttcagtgaaatatgaaacctcatcctgcagaattctcatcagagaggcccagtgcatgcagctaatgttggaaagcctattctcaattttaatcctatttagcaccagcaatttacagcattgtgagtgtagcatgtaggagagcaaaaaattgcagctcctgccttgatgtgcacaaagtgattcacactggaaaaaccctctatgagtgcagccagcatgggagagcatcggccacagctcctgccttgcttggcaccagaaacttcaccctggagaaaagccttttgattatagtaaatgtaggaaagtcttcacctcccttatttagtataaaagaattcacactggccaggtgtggtggctcatgcctgtaatcccagcactttgggaggctaaggcagggggatcacctgaggtcaggagtttgagaccaacctggctaacatggcaaaccccctctttacaaaaaatacaaaaatcagctgggcatggtaacgcccatctgtaatcccagctacaccagaggctgaggcaggagaattgcttgacctcagggggcagaggttgcagtgagctgagttagagccactgcaccccagactgggtgacagagcaagaccctgtctccctcaccaaaaacaaacaaacaaacaaacaaaaaacacagctgggtgcagtggctcacgcctgtaatcccagcactttgggaggccgaggcaggcagatcatttgaggtcaggagtttgagaccagcctggccaacatgatgaaaccctgtctctactaaaaacagaaaaattagccgggcatggtggcaggcacctgtaatcccagttactcaggaggctgaggcaggagaatcacttgatcctggaaggcggagattgcagtgagccaagatcatgccactgcactccaacctgggcaacagagtgaaactccatctcaaaaaacaaacaaacaaaacaaaacccagccctacatgagtagccttcagccacagctaaaccttgtgtagaaggattcctccctgaggagacactccatgatggccctgcatgtggagaagctgacagaacccatgttgtaccatgatcgccctgcatgtggagaagctgacagaacccatgttgtactttgcaacccgctgagggaccttggcagagctatcacaccactgggtcctgtggtggaagcccatctctgttttatggtgacttcccagttgctcaatgtaagtcactccctgtttcctgtttatactaccttggagggatggtaggggccttgcacacattggggtggtatcatgctcactcatgatggggtttgacatggacatgaccccattccaagcaaggagcctgattggataatttctttctcttttttttttttttttttttttgagatggagtctttctctgtcaccaggctggagtgcagtggtgcgatctcagctcactgcaacctccgcctcccgggttcaagagattcccctgcctcagcctcccaagtagctggaattacagccacacaccacctcgcccggctaattttttgtattttagtagagacagggtttcaccatgttggccaagatggtctcgatctcctgacctcgtgatccccccacctcggcctcccaaagtgctgggattacaggcatgagccactgcacccgacctctctccttttgtcttttcttttttcttttcttttcttctttcctttcctttcctttgctttcctttccttttctttcttttctcgtcctttcttttcttttctctctttcttttttttgaggcagagtctcactctggtgctcaggctggagtgcagtggcatgatctcagctcactgcaacctctgcctcccggtttcaagcaattcttctgtctcagcctcccaaatagctggacttacaggcgtgtgccaccatgcctggctaatttttgtatttttactagagacggagtttcaccatatattggccaggctggtctcaaactcctgacctcaagtgatctgcctgcctcggcctcccaaagtgctgggattactggcgtgagccaccatgcctggccgacaatgcaggagcttaaccaaaggaccacgttggctagggtcaatcagctgccccaggtgaccacccttagtgctaatcctgtgcagggtaggggtctgagccaaaaagaggaggctcttgtgtgtacagaaggcaatttgttgctatttttatttcatgcccaattcattaagaatgtttcaaacaattagcatttttctaagtattaagtaattaacatttgcctgaagaattacacattagatggataatgtaaaaataaagtgtttaagaagttaaacgtctccaaacattaaacattacttgagattggacatgatgggtcatgactgtaatcctagcagtttgggaggctgaggcaggtggattgcttgagtacaggagttcgagaccaacctgagaaacatggtgaaacctcgtttctacaaaaaaagtaaataaaattagccaggtgatatggtttggctgtgtccccacccaaatctcatcttgaattgtaactctcataattcccacacgttgtgggagggacccagtgggagataagtgagtcatgggggcagtttccccacactgttctcgtggtagtgaataagtctcaagagacctgatggttttataaggggtttcctcttttgcttggctctcatttgctcttacctgccaccatgtaagacagggctttcaccttctgccatgattgtgaggcctcccagccacatggaactgtgagtccattaaacctctttgtcttcataaattacccagtctcaagtatgtccttatcagcaatgtgaaaacagatgaatatagtaaattggtagagtggggtactgctataaagatacccgaaaatgtggaggcaactttggaattgggtaacaggcagaggttggaacagtttggaagcctcagaaggagataggaaaatgtgggaatgtttggaacttcctagagacttgttgaatggctttgaccaaaatgctgataatgatatgggcaatgaactccaggctgaggtagtctcaaatggagatgaagttgttgggaactggagtaaaggtgatgcttgctatgttttagcaaagagactggtggcattttgcccctgctgtagagatttgtggaactttggatttgagggagatgacttaaagtatctggtccgggtgcagtggctcacgcctgtaatcccagcactttgggaggctgaggcaggtggatcatgaggtcaggagatcaagaccatcctggctaacatggtgaaaccccgtctctactaaaaaaatacaaagaaattagcctggcatgatggcgggtgcctgtagtcccagctactcaggaggctgaggcaggagactggcatgaacctaggaggcggagcttgcagtgagccaagattgcaacactgccctgcagcctgggtgacagagcaagactccatctcaaaaaaaataaaaataaaaataaagtatctggtggaagaaatttctaagcagcaaagcattcaagaggtgactttgatattattaaaagcattcagttttaaaagggaaatacagcataaaagttcagaaaatttgcagcctgaccatgcaacagaaaagaaaaacacattttctgtggagaaattcaagaaatttgcataagtaaccaggagtcaaatgttaatcgcccggacaatggggaaaatatctccaggacatgtcagagacctttgtggcagcccttcccatcacaggcccagaggcctaggaggaaaaaatggtttcgtgggctccccctgctgtgtgcagcctacagacttggtgccctgcatcccagctgcttgaactatggctaaaaggagccaaggtacagcttaggctgtggcttcagagggtgcaagcctcaagccttggcagctcccatgtggtgttgagcctgtgggtgcacagaactcaagaactgaggtttgggaacctccacctagatttcagaagatgtatggaaatgcccagatttggagcaggcaaaagtttgctgcaggggcagggccctcatggagaacctctggtagggcagtgctgaagggaaatgtggggttgaagaccccacactgagtccccactggggtactgcctagtggagctgtgagaagggggccaccatcctccagactccagaatggtagatacaaccaacagcttggaccacgcacccggaaaagtcacagacactcaacaccagcccatgaaagcagctgggagggaggctgtaccctgcaaagccacagagctgcagctgcccaagaccatgggaacccactgcttgtatcagtgtgacctggatgtgagacatggagtcagaggagattattttggaactttaagattcgactgtcctgctgcatttcagactttcgtggggcctttagcccctttcttttggccaatttctcccatttggaatgggtgtatttatccaacggctgtaccccaattgtatctaggaagtgactaacttgcttttgattttacaggctcataggaagaagggaattgccttgtctcagatgagattttggactgtggacttttgagctaatgctgaaataagtagactttgggggactgttgggaaggcacgattggttctgaaatgtgagcacgagatttgggaggggcgaggaacagaatgatatggtttggctgtgtccccaaccaaatctcattttgaattgtagctttcataattcccacatgttgtggaaggggccccagttagaggtaactgagtcatggggacagtttcccccatactattcttgtggtagtgagtaagtctcacgagatctgatggtttcataaggggtttcctcttttgcttgactctcatttgctcttgcctgctgccatgtaagacgtgcctttcaccttctgtcatgattgtgaggcctctccagccacgtggaactatgagtccactaaacctctttttctttataaattacccagtctcagatatgtctttatcagcaacgtgaaaacagactaatacaccaggcatcgtggctcctgcctgtagttccagctacttgggaggctgaagttggaggactgtttgagcatgggaggcggaggttgcagtgacccgagtatgcaccactgcactccatcctgggtaagagagtgagaccctgtctcaaaaaaaaaaaaaaaaaagtaaaaaaaaattgcttgaaatgttaataatgcctctaagcatttgattaaatcacaatagtacttaagtgttcttaaattctttcaaagcaggaaaaatttaaataaaaacattcaaaaattgtcgagctatcttacactatagggatctacaagtagaatcaattctgtggacagttatagctgacagtagacagatatttatagatggaggtgggtatagaggaagacaaaatgaattaacgtacttgacatctgagaactgtctaaggatcctaaaaacaagaccctcacagggaagcaacaaagagagaatcgtttattctctgccaacaacatggtcagtctacattgagactgccctgccttttgttgttatgtgtcaaagacacttagattggtccagagaaaaaaggaacaaagcatccatgttgtgatgtgtggggcaaagcaagaactagatggtctaaggacaagcaaggctggggaattaccttctgctcgtccaagttacaaggaaaacaagttttgggcgagcgtccaagaacaatcacagaatcaagacaaatgacaagcgggtagtgtcattacaggctgagaattcttggtgtagaggttgaaaaacggaccttaaacctttacgggacactgacacacagagagatcaaaccctcgcccaggatgcacagtcagtgagatgcaaagctgggaagggaacccggagctccaggcatctgctcctccacctacacctgccctacccggtgcgttttctcctccctgctacctgctggtgttgccttctggaacctccgcagtttctgctttcacacctgcagggtttagtctccagggctgcttaggtgggtgccaggaactgggaatccccaacgcgggacaacctgccgggcgactcaaccagtgccacggagcccttggaaacccgcggcagctgcgctactccatttccaggcgcccagcgcggcggcgcttagccgttgccatggagactggtaatggccccgcctccgcgccgaaaaacaggcaggaaccacataacccagaaggctgtgcgcaagcgtctgcgcgcgtattggggcaatgtgagctctgggggctggacttccggcgttgggactgtcacttggctgctcgcgtcaggccacaccggtggtctgggctgtggcgcgcgggtcggggcccgaggcgggcggccaggaaggtacggaccacgagcagccggccgcgcccccaagcctcggtatcttcgagtatgacgtggtcggcccgggggcggtcgggccccggcgggaaccacgcgttctcccgccccgcggaagcccaggaggcagcgcattgggcattctgcgcccatgactgccgggcaggctgaggcgcggggcagccgcgggaggctgctggcggggatggcggtcccgggtggtccatgcctttcttccctcccagttgcgggttccgctggcggcggtggcgctgacaagcccgcgccgggggggcgggggagtccctgctcacacagactgcgcccccacggagtgaggccgcttcctagacctcgcctagtcgtctttcctctccctgccctgggggggttgcgggggtcagtgcaaactcctgcgtccagggcactggtgagctcccgacttccggcagccagggggctgaggtcccgaaggaggctccgaggggagagtcctgcgtgtgcaaaacctgggaggggagccgaagcccagatgcttctgggactgagcgctctcgatgtggagctggagtagaggggatgtgtgcggctgcagtagcaggcgagggagtgggctttatctcgagggcgtcgggagacatagaagttttgaacagaatcaggacatcctctgagttgggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggtgtcctgggctgaggacagggcctataaactggactgaagaaggcgatgagcagtcaggcgtgcggagttacagcttgagggtaaagaaaaccggctggggtgcctgaggctatcaggggaggagttcggcaggtggctgaataggagagggtggcagcaatgtgggaaagaaattgcgggagcgctgagatcgagaccatcctggctcacacagtgaaacccggtctctactaaaaatccaaaaaaattagccaggtgtggtggcgggaggctgaggcaggagaatggcgtgaacccgggagccggagcttgcagtgagccgagattgccccactgcactccagcctgggtgacggagtgagactccgtctccaaaataaaaataaataaataaataaataaataaataaataaataaataaataaattgaggagggggcgccatgtggagggaggaagggattgagttcccctgtgttcacaggttcttggggctgcacccctatgacgactggtggggatcatccagtccctcaggctggatgagcagcctggaaatgtcaggcaagcgcagcaggggaaggtctcagtgatgggcatgcctggggggtccacagctgggacttacacccttgcttattacaaaagcaagaagggcacatctggggagggtcatgaatggtcatgctgagtcacgagtggatatttggggctgcccttggtgtggcagctaagggcccagccagggcttgctctagcctgcttgtgtaggggtggccagtggggaagtcaagaagccatctggggcctggaccaggagggcagaggggaggggtcccagacaggtgagggaagtgccacctgaagataatctcggggtggaacccaaggaaggagggacactgggggaggtgactgttgggatggggagcttggtcctggctcacagccataccttagaccatgcctacctccacctccctgctgttttaggacctgatgaccttcgaggatgtggccgtgtacttctcccaggaggagtgggggctcctggacacagcgcagagggccctgtaccgccacgtgatgctggaaaacttcacacttgtgacctcacttggtaaggccctgggtgctccatgaaaagtgcacttggtgacaatcaggactgcctcttcacttccctcctggttgatgagcaggatcaaatctggccagggccacgtggaacaagggtctggtcctgtagacacaaagtttggttgggtcagccactccttgccgccctgtccagctgtggcctctctcatgcctgggctcagtcccgttgctttggtgctctgggcacagttgctgctctggggacacatgagctattcctatgagccccttgccctgtgctatctttagattctcccagttgcacagattactgtctatttccatgaagccctgactcctgctctctgttgggaggtgggttgtcttgacctggggctgggctctcacctgctcctcctcacaggactctctacctcccgacctcgtgtggtcattcaacttgagcgtggcgaggagccctgggttcccagtggaaaggacatgaccctggccaggaacacctacgggaggctcaactctggtgagtgggagctcaggtggggtgaactaaggaccaacctgtggccaagcccatgtccctgcttttctgactctggaaacacatcctcctctcctgcctcctacctgactcccttctcttccatcatcagcctctcctggaggctgctgccttagtaggtgcccttgaagggagagctccaagggcacaggagctgggttcacacagaagggcctaccttcagctgggctgtgtggccttgaaccctccacaactagcagccattattgataggtatttatttcgcccatcatttatctttgtattcatcaaatgtttcctgagggcttgtgggcattgtagacacagccttgaccaggacactcatggtcctgcctttgtggggctgatggtgctaggggagacgcagtgagtacgtaggattcaggagtgcagtcttgagcattggttggaggtcattgcaagagcaggtttgggagtgggtgcccaagacggggcaccaggggagaagggagtgagctatggaaagggagggggtggaacagccagtgtggagacgtgggtggcacgcagcagctgctgttttcctcagcttcacatcctgggtgtctgggggctgccgccttgatcatgggagtccccactgcagtcagtgccacacctgtcagggcagatgcttcctccaaaccccagcccctcctgcagagccagcctcacctcttctttttccctaagcttttgtcccggctcctgggctcccccttgcctgtccactcagcctgccctggtcctctcctaaccaggatgccccaggcaaccaccgtttctctgcgtttaggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaaaagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcaggagaggaatgcccatggttctcagcattggaaggacaaacctaggatgatggctttccagtggcactcgttcaggttttcgtccaagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttcaaatagatgtagtttcctttacagccgtgtggacctccacagcacagcctcctgtctctattccagggtatgattcagttgtttgtttgtttttgagacagagtctcaaggcaactcttcttgcccaggctggagtgcaatggcacaatctcggctcaccgcaacctccgtctcccaggttcaagtgattctcctgcctcagtcttctgagtagctgggattacaggcgcccaccaccatgcccggctaattttgtatttttagtagagacagggtttctccatgttggtcaggctggtctcgaactcccaacctcaggtgatctgcccatcttggcctcccagagtgctgggattacaggcgtgagccactgcgtttgtttttcatgaagcgtctcagtctgtcgcccaggctggagtgcagtggagcaacctcggctctgcctcttgggttcaagccattctcctgcctcagcccctccagtagctgggattacaggcttgcaccaccatacctggctaatttttgtatttttagtagagacggggtttcaccatgttggctgggctggtctcaaactcctgacctcaagtgatcggcccatcttggcctcccaaagtggtgagattacaggcgtgagccactgcgcctgcctacataccatgattttaaagttgcagctgtttcctattgcttgtaactcagtcttgtcttttcaatggtaaccaatttctgtttcaaactgaaaggttcatgagggtgagttcttctattagtctgttttgtgtcactataaaggaacacctaaggctgggtaatttataaagaaaagaggattaattggctcatggttctgcaggatgtacagccatggcaccagcatctgcatggcttctggtgggacctcaggaagcttgcaatcatgatggaacatgaaggaagagctggcatatcacatggcaagacaggaagcaaggcgggggggaagtgtcacacatttttttttttttttttgaggagtctcgctctgttgtccaggctggagtgcagtggcacgatctcggctcattgcaacctccgcctcccgggttcacgccattctcctgcctcagcctcccgagtagctgggactacaggtgcccgccaccacgcccagctaatttttaatatttttagtagagacggggtttcaccgtgttagccaggatggtctcgatctcctgaccttgtgatccgcccgccttggcctcacagcagagtggtgggattataggcgtgagccaccgcgcccggcccacttttttttttttttttctgaaatggagttttgctcttgttgcccaggctggggtgcaatggcacgatctcagctcactgcaacctctgcctcctgggttcaagtgattctcctgcctcagcctcctgagtagctgggattacaggtgtgcaccaccatgtcagctaatttttgtataatatttttagcagagacagggttttgccatgttggccaggctagtctcaaattcctggcctcaagtgatccacccgcctcagcttcccaaagtgttgggattacaggtgtcagccaccgcacccagcccatcacacacttttaaacaaccaaatctttcatgaactcagagcaagagctcacttctcaccaagggggatggtggcaagctattcatgaggaatctgcccccatactatagtttggatgtttgtcccctccaaatctcatgttgaaatgtaatcctcaatgttggagatggggcctggtgagaggtgtttgggtcatgggggtggatcgctcttgaatctcttggtgctgtcctcaaggtagtgagttctcacaagatttggttatttaaaagtctgtggcacctccttcctttctctcttgctcctgctctcaccaggtgagatgcctcctccccctttaccttctgccatgattgtaagcttcttgagaacctagcaagaagcagattctgaagccatgctcgtacagccctcagaacagtgatccaattaaacctctcttctttataaattacacagcctcaggtatttctttatagtaatgcaggaatggcctaatatacctcatgatccaacacctcccactaggccccatgtccaacactggagatcacatttcaacatgagatttggaggagacacacatccaaaccatatcagttctcttgtccctgagtgaagaggcacttgctccctctaaacccaattctaggtgactagagatttatgaaggtgtcgggatgtttgttcatgatgcatagtggcctcatagggtctccctacttcttctgcaagaagaacaccttcaggggctttcagctcagccagaagattcacataaaggttgttcatctggtaccttgagcactctgccaacacaggtgatcacagattccaagacacataaaagagtgaatcacaactcactggtgactcattgaggagtgatgctcacaaagcaacacacttcgtctaaatacactgtactaaccttggtcacttttgaaaaggtatttctacaattatttgaaactgctcatgaaaactgagctttcccttaaggagcaacccccccacccttcgaaacctatggagatcctatttccaaaaacttaggtaaatggacccaggtcactcgagatgaccctaaaatgcagtggccaaaacggagatcttttgaaattcctaaagtaatatatttgtgtgcacaataggaaacttaatatgtttgttctaaaaccagacaaattggatgggaggcctactttctgtttgtgcaggctatactctgataagatatttgaaaggttttttaaaaagagctctataggccaggcacagtggctcatgcctgtaattccagcactttgggaggccaaggtgggcggatcacctgaggttgggagttcgagaccagcctgaccaacatggcgaaaccccatctctactgaaaaatacaaaaattagccaggcatggtggtgcgtgcctgtagtcccagctacttgggaggctgaggcaggagaatcacttgaacctgggaggcggaggttgcagtgagctatgaaactatagcaaactccagcctgggcgacagagtgagactccgtcacaaaagtaagtaaataaaatacaatgaattctatggtcagatgtcagcttaattaaaagctgatattcaggctttttttttttttttaagaaaaaatacctttctgctttttctcatttggagcctgtttctgggaattttttttttttctgttgactgaaacccctttttacatatgtttagtccctttgtttgcttcttttcttgttagtatgatgtaaagttttattggccttctgaaaaacttaaaatctccccaaattggcttagagctctcccattttcttctactttttcttcctttagctatctttgataccacataaagaaatctagaggagtcttctaatatctctgagaccctttgaggaacacagtaaagtgtcacatacaccttttatggagtcttctgtcttcctcatggaatcctaagtgtagcaggcagtttatcttaggtctaaagctctgatctcttttacactgagttctctgaccttttggcttggggggtaccaagggttactttgttctatgaaagaacatgatctttgggtgtgcactggctggcaagttactggcaagggctgcagttttggctgatagcagttgttttcagtgagtggttattactgcagggtgtactaattcctttgcatgtttaaataagaaaagtatggtttgaacacttggagacttatagaaacactcatcaccaagggggaagaatcctttgggagatgggctgatcacagatcacagagtgggctaattggtgctgggtgtcccaccagcatcagggaatgtccatgcagtgaggtgcactgtggaaacacagccctgtcctgtggtatttccatcttgtggggtcctcaagattccattttaaagtggaatccttgattttatttatttatttttattttttgagatggagtctcgctctgttgcccaggctggagtgcagtggcgtgatctcagctcactgcaaggtccacctcccgggttcacgccattctcctgcctcagcctcccgagtagctgggactacaggcgcccgccaccacccctggctaatttttttgtatttttagtagagacggggtttcaccatgttagccaggatggtctcgatctcctgacctcgtgatccgcccgcctcggcctcccaaagtgctgggattacaggcgtgagccactgcgcctggcctggaatccttgatttttaaagctctagatgttctgcctttcaactgtgccagttttttacatagatggggtttctctatgttggtcaggctggtctcaaactcctgacctcgtgatccgcctgcctcggcctcccaaagtgctgggataacaggcgtgagccaccgcacctggcctatgttgagttttaggccacaaaaaattgaccaaaaattttttgacaattgcatctttaaccatggacattttaagttttgtcctcagctgggcgcggtggcttatgcctgtaatctcagcactttgagaggccaaagcaggcagatcatttgaggtcgggagtcggagaccagcctgaccaacatggagaaaccccgtctctaataaaaatccaaaatttgctgggtgtggtggcccatgtctgtaatctcagctactcaggaggctgaggcagaagaatcgcttgaacccaggaggcggaggttgcagtgagctgagatcgagccattgcactccagcctgggcaataagagcaaaactccatctcaaaaaaaaaaaaaaaaagttttgtcctcttccttcttgaggagttgctttgaagcttcacagcaaccaaggaatctatttcactgatgaaacaattcaatctactttaacatatggctggttatttagaatgtccattttgcatactactctcagtcttccagactgctggaatgtacaaataaggtaatagaaaatcaatttacaaagcttacagaaacttttaaccttccgtggcctaaggcttttccaatggtcctgaatgaaggaacctacaaaccagctctccttaatgtgagctcctgggagacaaaaatatcaaagatcaagggctccaacctggagattttgtttatgagaaatgccatctaataaaggactccctacaaccatgttgaagagaactccagcctgggcaacatgatgaaaccccatctcaacaaaaagaacaaaaaaagcaaaaattagctggcatgcacctatagtcccagctacttgggaggctgaggtgggaggatggcttgggcccaggaggcagaggttgcagtgaggtgggttgtgccactgtactccagcctgggcaaaagagccagaccctgtctcaaaataaagaagttgagggaggcatatcagatattcttaaccaatccttgtgcaagctaaattcaaaggcattgacttgcagattcacatttttcatttttaaaaaatgcagcccatggccgggcgcagtggctcatgcctgtaatcccagcactttgggaggccgaggcgggtggatcacgaggtcaggagatcaagaccatcctggctaacacggtgaaaccccgtctctactaaaaatacaaaaaattagctgagcgtcgtggcgggagcctgtagtcccagctactcgggaggctgagggaggagaatggcttgaacccgggaggcggagcttgcagtgagccaagatcctgccactgcactccagcctgggcaacagagcgagactccgtctcaaaaaaaaaaaaaaaaaaaacaatcctgcttgagtagacatcttcgatcattccagatctccaactgaggcagtcccattccccaagaaggaagaggacaaaacttaaaatgtcatggttaaagatgtgattgtcaaaaaaaaaaaattggtcattttagtttttgtggccgaaatctcaataatcataattatgactgatagcataccatataccagtcatcttatagctcacacgaggatgagaagtagaaaatttgttagaaaatatcactcaggcggtcgggcgcggtggctcatgcctgtaatcccagcactttgggaggccaaggcaggtggatcacctgaggtcaggagttcaagaccaggctggtcaacatggtgaaaccccgtctctagtaaaaatacaaaaattagtcggttgtggttgcaggcacctgtaatcccagctactcaggaggctgaggcaggagaatcacttgaacctgggaggcagagattgcagtgagcagagatcacgccattacactccagtctgggccacagagcaagactccatctcaaaaaaaaaaaaacacacacacactaaaaaagaaaatatcactcaggccaggtgcagtggctcacacttataatcccagcacttttggaggccaaggcaggcggatcacttgaggtcaggagttcgagaccagcccaacatggcaaaaccttgtctctactaaaaatacaaaaattaggtgggtgtgatggcatgcacctgtaattccaactattcgggaggctgaggcacgagaatctcttgaacccaggaggtagagattgcagtgagccaagattgtttcactgtgctccagcctgggtgacagagtgagatgctgtctcaaataattaaattaaaaattaaaaaatgaaacgtttgaagagttaaaatgcctccaaatattcatacattgcttaaaatggtaataatgcctctaagcatttgatcaaatcacaactttaatactacttttttttttttttgagacagagtcttgctctgtcacccaggctggaatgcagtggtgtgatctcggctcactgcaagctccacctcccaggttcatgccattctcctgccttagcctcctgagtagctgggactacaggcgcccgccaccacacccagctacttttatttttgtattttttagcagagactgggtttcaccgtgttagccaggatggtctcgatctcctgacctcaagatccgcccacctcggcctcccaaagtgctgggattaccggcgtgagccacagcgcccggccacagcttgaatagttctaagtgttggggttttttttcttcagggtttttgaactttaatacttccttttttttttttttttttttttgaaacggagtctcgctctgtcgcccaggccggactgcggactgcagtggcgcaatctcggctcactgcaagctccgcttcccgggttcacgccattctcccgcctcagcctccccagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggccctgaactttaatacttctaagtgttggggttttttttttccccctcagggtttttgtttgttttttcctgagacagggtctctctcttacccaggctggagtgcaggggctccatcatagctcactgcacactccaactcctgaactcaatcctcccacctcagcctcccatgtagctggtattacaggcatgcaagaccatgctcagctaatttttatatttttttataaagatggggtcacattttgttgctcaggctggtctcaaactcctaggctccagtgatcgctcaccttggccacccaaagtgctcagattccaggtgtgagccactgcgcccagtcctgaaatgttcttaaattctttcaaagtagcaaaatttatattaaaacattccaaacatgatgagctcccttgctctacaaggatttacaagtagaatcaattaggtggacagttatagctgacagttgacagagagatagttatagatggaggtaggtatagagggagggaggcaaaaagagttaaggaactggacagctgagaactgtctacaggttccaaaaacaagacaaagaaccttttattatctgccaaacaagacagtctacattgagactgctctgcctttcgtttttatgtgtcaaagacacttaaattggcctgtaatcccagcactttgggagaacgaggtgggcggatcacctgaggtcaggagttcaagaccagcctggccaacatggtgaaactccatctctactaaaaaatacaaaaattagccaggcatggtggcgcacacctgtggtcccagctactacggaggctgaggcggggggatcacttgaacctgaaggcagaggttgcagtgagccgagattgtgccactgcactccagcacgggcaacagaacaaagaccctgttaaaaaaaaaaaaaaaaaacttaaatgagtcccaagaaaaaaggaaaaaagaatgaatattgtgatgtgtggggcaagacaagatctagatggtctaaggacaagcaaatctggggaattaacttctgcccatccaaattacaaggaaaacagatgctttgggcaagtgtcgaggaacagtctcatacttaagacaaatgtaggcttacgggctgagaattcttggtgtaaaggttgaaaacggaccttaaacctttacgggacattgacacagagaggtcaaacccgcgcccaggacgcacagtcagtgagaggcagagctgggaagggaacccggagctccaggcatcggctcctccacctccacctgcgctacccggtgcattttctcctccgtgctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggtactggctgagggcccgcgtcgggcccgccctgcgcacgcgtcgtgatcaagggcgccggccgccggccgcgcccccaagcctctgtttctcagagtgcgtcgtgggcgtccaggggactgtcgggccgcggcgggagccatgcgctctcccaccgtgcggcagcccaggaggctgcgcgctgggcgttccacgtccatgatggccggggagactgaggcgcggggcggccccgggacgctgctggcggggaaaggctgggtggtccacgcctttcttccctcccagctgcgggttccgctggcggcggtggcgctgacaagcccgcgtcggggaagcaggggagtccctgctcacacagaccgcgccctcacggagggaggccgcttcctagacctcgcctagtcgtctttcctctccctgccctgggggggttgcgggggtcagtgcaaactcctgcgtccagggcactggtgagctcccgagttcgggcagccagggggctgaggtcccgaaggaggctccgaggggagagtcctgcgtgtgcaaaacctgggaggggagccgaagcccaggtgcttctgggactgagctctctcgatgtggagctggagtagaggggatgtgtgcggctgcagtatcaggcgagggagtgggctttatctcgagggcgtcgggagacatagaagttttgaacagaatcaggacatcctctgaggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggcgtcctgggctgtggacagggcctatgaattggactgaggaatgggcagggactcagccaggtgtgggcagttatggcttgagggtaaagaagaccagctgggatgcctggggctattgggaagagcctagcacctaactgaggaggggagggtggcaacagagaggggaagaaaggggacaccgggtgaaaggaggaagggattgagttcctctgtgttcacaggttgttgaggctgctcccctgtggcgactggtgagaatcatccagtccctcaggctggatgagcagcctggaaatgtcaggcaagcaggctcagcaggggagggtcccagtgatgggtatgcctgggaagcccctgctgggactcacagtttcttgctacaagagcaggaagggtgcatctggggagggtcatgagtggtcatgctgagtcacgagtggacacctggggctgctcttggtgtggcagctgagggcccagccaggacttgttctagcttgcttgtgtatggcgttgccagtggggaggccaagaaggcatctggggtctggtcagggagggcagaggggaggggtcccagacatgtgagggaagtgccatctgaagatggtgggggcagaacccagggaaggagggtgagtgtctgagggacatcatggaaggtggctgttgggatggggagcttggtcctggctcacagccataccttaaactaagcttgtccaacccactgcccaggatggctttgaatgcagcccaaaacaagttcgtgaactttcttaaaacatgagatgtttatgcaatttttattttttttagctcatcagctgttattagtgttaatgtattttatgtgttgcccaagacaattcttcttccaatgtggcccagggaagccaaaagattggataacccagccttagaccatggctgtctcttcctccctgctcttttaggaccagatggcctttgaggatgtggctgtgtacttctcccaggaggagtgggggctcctggacacagcccagagggccctgtaccgccgcgtgatgctagacaacttcgcacttgtggcctcgctgggtaaggtcctagatactccatgaaatgggcaactgataacaagctgactggccagggctgccccctcacctccctggtggctgacgagcaggcctataccttgcagccaggagccatgtggaataggggtctggtcctatagacatgcagtctggttggctcaaccactccctgtggcgctgtccggctgtggcctctccgagccttggctcagtccccttcctttggtgccctgggcacagttgctgccctggggatgaatgagctattcctgtgagccccttgccctgtgccatctttagattctgcagttgcacagatgacattttctgtttccgtgaagccctgactcctgccctctgtttggaggtgggttatcttgagctggggctggactctaacctgcacctcctcctcacaggactctccacctctcgacctcgtgtggtcatccaactggagcgtggcgaggagccctgggttcccagtggaacggacacaaccctgtccaggaccacctacaggaggcgcaaccctggtgagagggagctcagggtggggtgaattcaggaccaacctgtggtcatgcctctgtccctggttcccagactccccagaagcaccctcctcccctccctcccacccgattcccttcccttccatcatcagcccctcctggaggctgcagccttagctgcccttgaaggtggagctccaagggcacaggagcggggttgacacagaagggcactcaggctatggtgagaccatctcagagtcctgctatcagctgggctggcctcaaaccctccatggctagtcactgccataattgatgggtcatttttttcacccttcatctttgtgttcagcaaacatttcctgagtgctcacagtggtcaggcccagtccaggcaatgtagacacagcctcaatcaggacgaccctggtcctgcttttctggggctcatggtgtggtgggagaggcagtcggtaagcaggattcaggagtatagtctagagcactggatggaggtcattgcaggagcaggttggggagtgggtgcctgagaagggggacaggggcggggggaagggggtaagcaatggaaagagtgtgggtggaatagccagtgtggagatgtatgcagcatacagcagccgctagttttcctcagcttcacatcctgggtgtcggggggctgccaccttgatcatgggagtgcccagtgtagtcagtgccatacctatcagggcagattgttcctccaaaccccagcccctcctgcagggccagcctcacctctacttttcccctaagcttttgtgccagctccggggttccttcttgcctgtccactcagcctgccctggtcctctcctaaccaggatgccccaggcaaccactgtttctctgcctttaggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatttgtgtgaacggtagcaacctgacacctatttcaccctcatacaatgcagatggtattgaacataccctgacatgccatcagcgtttgtcatcatcacagaagttcctggacttggcttcaacctgggtaccctcaagaggccacagagtagagatacagcctgtctgcagcccagggagggagtgggatacctgtatccttttcagggtcagaggtgggttggggtagccaggagctggatgaactgggatagagtggggctgtctggagcagcagccctgctagatgagtcctggtggatcctggcaatgggaggatggtaggtggagaaaccaaggcagggctgtgttccttctgctgctgagatagagggtgtggccatgtgtgatgaccctgcaaggttgactccaaccagtgggcactccatcccatggcttccaaaatcctgcagctatcctgccctatacacaaagagcccagatccaggccccacacacttgatattggggccagactcttccacctgtgaaacctcacaggttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctaccttgtcttcccaccagccgcctccctccatcaagttcctttccacgtctgcttgtgcccctgttgtccctcagtttgtccaccctcctccaatcttcccctccccaaacccatgactgatcagtggcccccaacctaggctcccacctccatgcaggtcttggcccctcggctgacctccctccaacctccccctctgctcttaattttgaataggtagtgactgtaaaagtatccctgggcttctatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcacatgctcggtgcttccaatcggtgatcaagaccactgctcttcatccagagcaggcagcagggattcccaggtatccaaagaaaccaaaacaggcggtgtaatttaggactgactaagtaatggctcggccacttttaagtgtggaagcaaaactgaccccacagatttagaaaactgtaacactgcttattgggagaaactagtgtcaccctggctagttctgctccccaaattcaaaggtaaataaacggttgagcatgtccgatcagcctggagggaaacctccacccccgactttgtaggactgacatctgaagacgtcagagactgcggtcacaaccgtcggtacctccttagggcgcttaacagaggtcaaagatggccctcgcaccctcctggcgggagaaagcccaggctcagggtggtcttctacaccaccgcctctcccgggtccacttggaagcgagtcccagcgaactactcgacctaggaaaccactgggccgccacttccagcctcttcggaagtcgaggcaacgctcctgaacgttgccacgggaacagctggaggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatataaccctgggactctgccgtacctcctagaggaacagagcgcctctcaggcgtcagaggctgctgcaaatgcgggtcagcgggtcacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggtgagcgcaggctgccagagtgggcgcagcctttccaccccgtgggagggcttggggtcgccctctggggcctgaacggctcctgctgtcggcgccctggagggcccgcccacttcccgacaggccgcgcgcgtcacctcagccttcgctcaggcctttcctaccctcaacgccgttccggggggccgggcctggcaagtcctcttggaacgcctccctcttgccttccccttttggggacagatcccgaagttcgagcatccctcggataggccgggtgtcaggcctggtctctcaggcccgtccaggtgggcgtctttcactgcagaccttcagggccgggatgctgtggccatccctcgactccgcgcaacgtggagctttggccccgtttttcttggcctttgcttttcgttttcacatgcacgggccccggcagtgtgagtcgcccacggctcgctgtggtcagcgagcacgatgtccacgtgccccctccccagagccattcctaaaggaggtcccacccagtcaacctccccgagattgtggagggcgactcgtccccgtacattacagcctggccccaccttctacccgcccaccctggtccactctcctcgcacctcggctagacactgtggctcctcagcctggcgctggaactctgtgatgactgtctttctccacctctttagcgtcatctcccagcagtcccctgctggacccaactgtttgcaatttccaggaagctccctggacaccttgcgtccaagcatttgtccctgaggcttcctcctgctctcatttgccatcattgtttgggtcctgtgaccctcctccttccatgaagctttcttggccttatctcttctggcctcagagtacacttggtcctggtctcagccccctgggctgagcctggtgtctgccttcccctggccagattctcttggctgacattccgacccttccttttctgtaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctgggtgagtgtggctggcatcagcttcttggagggatagaccctggctagagccattgtgacctacctcttctcctcagatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtgggtgaggttggggtcccaccagagatgagggactcctggaggaagtgtggacattcctggctagggtgggagtcccaggagaggtgtgtcaaggctgggactcctgaagtgaatgtggatgtccctgtctgggatggggacctgggaggcaggagccaagggctggctacgtgccatgtcacacagcagaggagctcctcatctgccatggctcatgtgggcagcccctgacaccacccttccatctgccccacttttcagcaccctccagccctccacttgcagcacagtcccctgaggggaaccatggacaccaagaaccagcctccacatccttccacccacccaggattcaggtgagcagccccaagtgggaagtataggccccaggtgtgagaagggactgtccccatggctgccctctgcctggtggttttccaggctccttgactagtggctctttgcttcccagaagtggagtctgtaaaagctgtacccctccacaggacctggggcagagggacagactggtgatctattattgaaaaggatttggggctggacatggtggcttacacctgtaatcctagcactttgggaggctgaggtgagcggatcacctgaggtcaggagctcgagaccagcctgaccaatgtggtgaaaccctgtatctactaaagatacaaaaattagccagaagtggtggcaggcgcctgtaatcccagctactagggagggtgaggcaggacaattgcttgaacccaggaggcagaggatgcagtgagccgagattgtgccactgcgctccagcctggtcaacaagagcaaaattgtgtgtcaaaaacaaaaaaaaaaaaaaggatttgggcctcaagccatggaaacccagtttagagtggctggaactagtgggcttggcttcctcacctccagagaagtcagctgggaggtttgctgctcccagaggtcctgagccagacctggggatttgaacttttgtgtgtagctggggaggggagaagatgaccagctgtggcaggactccccccacacctgagaccagatggagacactctccctgggaaatgcccgaagtcccttctctcctaggggtttcttcagaggccacctgttaggcctggaagctcagcttgaggcctcttctacctggatcgcttggttcccaagtgtgggtagcaaggtcttttcctctcccggctcctctaacaactccactggggagcttcagcagcaacattgctggttgagatgtgtttcgaggctaagaagtccttccaggctccctccacagccccatggcacagtcagaaagtgaggcagggtgggtaggctgcacttcccagtgtcctcacctccagccagcaccatctctagctgtggctcctcacagctgccgccttcctgcccctggacttgccacagcttgtccctcaggattatttttcccaacccagcaaagccccagatgatgggactcaggcagcaaggagggctgacccccaatcagggagttcattcctcgataaagtcactcaggtccctgtgatgctgccaaacctgccctctgagcaggatggtgtagtagagggggatgagtgctggcagcagcactggtcaggtgatctgaaggagaacctctgcacttaacaaacacacaccttgagatcattctcagcaggaggggcagatgaggcgtaggtaacctgctgactcttccgggtaataggtaagaatgtgaaccagacagggcagggaaggggtggaaagacgcctacagtgatgggccacatccgcaggaggagtgggggctgctggaccggtcacagaaggaactgtactgggatgcgatgctggagaagtacggcacagtggtctccctgggtgaggaccagccagccccaccccgcccctctccctggggcctgcacccaccctgcagcaggcctagctgggcagggcctctgtgctaccagccctacccagctctcccaccttccagaggaacaccctgtcacctaccagaaccgaccccacccctccttcatgcaaaccccatgcctaactgtgccccccacccgggcagggttaccgccccaccagccagaggcacaggcccagtcagagctggggatgctgctcacggggacaggcgtctgcagaagcctgcgctcgggtgagtgccccacaccatccagcctgaatcacccctcctgtatcggtgggacctgagccacccactcatggggggacgggagcttgtgccacggccacaagcctgagggaggggttgctgagtgccgggactcacctggtttgcccctgcccccaggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataatatggagtttctgaataagaatcctgatttctggcttctgctggtcgggaaataggcagtttgctgtctctgcccagtagctgcagcacagggcagttgagcccagaacggccaaacctctgttgccacagaacccaggtcccaggtccccagcctcccttgctccttgccgcccacatcactcaccagcctcactggccttggaactcatcagtcccggcttgagagacacaaaggggatttcctttcgaagtacggctggacaagggggacctctgagaagaggggctgcaagcaggggttgcgccaaggccatgggtacttctaggtcaggccgcaccctccatagttagctggtcatgcagcaggaaggcaaaaggtcagctccctgggaagcaccggatctctgggcagtcactggggactcgccaatgcactgtattagttttctgttgctgctttaacaaacttggcagcttgaaacaacagattctcttatagctctgaaggtcagaactctgacatgggtcccactgggctaaaatcaaggttttgttttgttttgttttgttttgttttgtctgagatggagtctcgctcagttgcccaggctgcagtgcggtggcacaatctcggctcactgcaagctctgcctcccgggttcacgccattctcctgcctcaacctcctgagtagctgggactacagacacccgccaccacgcccggctaatttttttgcatttttagtagagacggggtttcaccgtgttagccaggatggtctcgatctcctgacctcgtgatccacccacctcggcctcccaaagtgctgggattacaggcgtgagccaccgcgcccggccaaaatcaaggttttaacaggactggttcctcttgaaggctctaggagagaataatccattttgttgccttttccagcttctagagtcagcccacgttcccccttttttttttcttggtccattcctccgtcttcaaagccagccatggttggtcacgtcttccttaggctgccagctctctgacacccatcgatcctttggcctccttaaggaccctcatcatatcttgtcccctacctgcacacttagtcacaccgcagagtcccttttgccaattgagatgttcacagcttctggggattggaatggggactccttgggggccttgattcagcactcttctccttcctactctgaaaacaaggggcattttcacaggggatggtttcaggaaatgggtgccctctcggaaggagccctcgccagctgctggtatgtgcagcatgtgcacaagtcgcaggtggatgttgagggtagctgcgactgtggttaccccaggaggggctccctgggaggggcaggaaccctgctgcggcctgaagctgggagagggaggctctcctcagaggcccatcttccccatccccttttatgagggccttctaacccgttgctcccatgtgcagggctccggaagcagggccagtttggagatggagctgggggtgggtgatctgtgagcaagcaggaggcgagagctgtgctggggacagagaagaagaagacagagcagtacccaggggctccagctaggccccagcccagaagggagagtcagggtatagaaggctgtgaaagggccagatcatgcaagaaaagctgcagggggtgagggcagtttttaaataaactttttcacatttagaagcaatttatgctcacttagaaaaatttgaaatacacaagatggcaaagaagatcatgaaaatgttccctaattcaactgtctcatggcaatgcttactccagaagtttacatatagaagtggttgaatgtaaagtttcttttaaggcaacttatgttgtttcactttgggagaccacgagttcaagaccaatctgggcaacatagtgagaccttgtctccaaaaaaaaaaaaaaattaaaaataatagtaggctgggtgtggtggctcatgcctatattcccagcactttgggagaccaaggcaggtggaccacttggagttcgacaccagcctggccaacatggtgaaacctcaactgtactaaaaaaaatacaaaaattagccaggtatggtgacatgcacctgtagtcccagttacttgggaggctgaggaataagaatcacttgaacccgggaggcagagctgcagtgggccaagacggcgccactgcactgcagcctgggtgacaaagcgagaccctgtctcaaaaataatactactactaattagccaggcatagtggcgcatacctgtagtcccagggagactgaggtgggagaatcacttgagcccaggaggttaaggctgcagtgagctctgataacaccattgcactccagcctgggcaacaggatgagaccctgtctggaaaaaaaaaatacggaaatgggagacggaagggtaggtcagagagagggatgatggatgaaataactgcaaatattcacaataggagagggatgaccccaccatatggaatgcttcacaaatttgtgtttacccttgcacaggggccattctaatcattccaattttagtgtatgtactatagaagtgagcgagcagttaacttttttcttttcatgcctggatgaatctattttctggctggcaccatcatttctaccaagaccaaagaatttcttgttccctcctcaccctgcagtacccagtgctatgattaattctcttgagtaaacacttggatactactgtggctatttctgtagtataaatttctcaaaatgggattggtgagttacagggaacatgagatttatttttgccttaaaacagcaaaaacttattgtacaattctggagaccggaagttagacaccatctcaccaagctaatactagagtgttggcaatggctgggcacagtggttcactcctgtaatcccagcactttgagaggctgaggcaggaggatcacttgaggccaagactttgagaccagcctgggcaacagagtgagaccccatctctaaaaaaaaaaaaaaaaaaaaaaacacacaattaaaaaaaatttttttagctgggtgtggtagtgcacacctgtagtcccagctacttggaaggctgaggcaggaggatcacttgagtccaggaggttgaggctacagtgagccaagatctcacgactgcactccagcctgggcaacagggcgagactccatctcaaaaaaaaaaaaaaaaagtgttggcagggctgcattccttctgtaaacactagggggaaaattgttctgtagctcatggccccttcccccatgtggtggctcacacctgtaagcccagcactttgggaggcaaaggcgggcggactgcttgagcccaagagttcaagaccagcctgggcaacatagcaagaccatgtctctactttttttcgataaaattttttttaaaaaattttaaaaaccaatcagccaattttccccaagttaatctataaagtaaatgaaatgcaaataaaatataccacatttcagccgggtgcagtggttcactcctgtaattccagcactttgggaggccaaggcagggagattgcttgagcccaggaattcaagaccagcttgggcaacatggtgaaactccatctctagtaaaaatacaaaaattagccaggtgtggtggtgcacgcctgttgtcccaactactcgggaggctgaggcaggaggatcacctgagccttgggaggcagaggctgcagtgagccatgatcgtgccagccggagcaacagagtgagaccctgtctcagaaaaataaaaagaagcacattttatatgatccaacaaaaagattctaaaatgcatgtggaaaagtccaagaattgctaagacaatttggaaaaaacgacaagtagggaagaattgtcatattgtaaataaaaacactgttaagttatataatattaaaatagtgtggtggctgggcacggtggctcatgtgtataatcccagcactttgggaggccgaggcgggtggatcacctgaggttggagttcaagactagcctggccaacatggtgaaagcccgtctctactaaaaatacaaaaaaaaaaaaaaattagccgggtatagtggcacacgcctgtaatcccagctactcgggaggctgagacaagagaatcacttgaacccagaaggcagagattgcagtgagctgagatcatgccactgcactccagcctgggtgacagagtgagactccatctcaaaaaaataaaatattgtggtattggcacaggagtggacaactaggtcaatctaggaacagaccttttggaacttgatatacatgaaatgactcaaccaatcagtgaagacagggtggatgttcactgaatattggagaaaactgaactcccccatacaaaagaaaacagatttccactttacacacactcaaaattaaattccagattaaatactaggatatttttaatgatttattaaatttttttttggtagagacagggtctcaatatgttgctcagcctagtgtcaaactcctagcctcaagcaatcctcccttctctacttctcaaattgctgggattacaggctgagccaccacacccagcctgatatttatttttaaatatcaggaaaatgtaaaactttgttttgtttttgtttgttttgagacagagtctcgctctgtcacccggggtgaagtgtagtgtgaacatggctcactgcagccttgacctcctgggcacaagcagtcctctcacctcagcctcctgagtagctgggaccacaggcacatgccaccacactcagctaactttctttttttttttttttttttttttgagatggagtcttactctgtcacccaggctggaatgcagtggtgtgatctcggctcactgcaacctccgactcatgggttcaagtgattctcctgcatcagcctcccgatagctgagactacaggcacgtgccaccacgcctggctactttttgtatttttagtagatggggtttcaccatgttagccaggatggtctcaatctcctgacctcgtgatccacctcggcctcccaaagtgctgggattgcaggcatgacccaccattcctggcccacactcagctaactttcagtttttgtttgtttgttttttgagacgaagtctcgctcttattccccaagctggagtgcaatggggtaatctcggctcactgcaacctccgcctcctgggttcaagcgattctcctgcctcagcctcccgagtagctgggattacaggcccccgccaccgcacccggctaatttttgtatttttagtagaggcggggtttcaccatgttggccaggctggtctcaaactcctgacctcaggtgatccgcccacctcggcctccccaaagtgctgggattacaggcgtgagccaccgcacccagcttttttttttgggggggggcggggagagatgaggtctcgccatgttgcccaggctgaaagtaaaaattttatgacctcaagagttgaaaatgatttcttctttttatttttttgagacggagtctcactctgtcgcccgggctagagtgcagtggtgcgatcttggctcactgcaagctccgcctcctgggttcacgccattctcctgcctcagcctcctgagtagctgggactacaggtgcccgccaccacacccagctaatttttgtattttagtagagacggggtttcaccgtgttagccaggatggtctgaccttgtgatccgtccacctcggcctcccaaagtgctgggattacaggcgtgagccactgcgcctggccgaaaatgatttcttaaataataacacaaaaagtatacagacccctaaaaccctgccaataacaagtattggttaggcagcacagaacaggacctgtgaatttgatgagttatcactcctgtgatttgatgatgtcatatggcatagttgcccttgttttgttttgctttgttttgttgagacagggtctcatttgttgcccaggctgcagtgcagtggtgaaaccataggtcactgcaacccggaactcctagtctcgagcaatctgtccatctctgcctcacgactaaagaaacaactggcaagtttaataaatcgaacttaaatctctgaaaagacactgtaaacataaataaaagataagcaaaatattggaggaaaacataaaccaaaaaaaccctcgacaaacccagaaggtatttttaaactccaaataagtccaggcgcggtggctcacgcctgtaatcccagcactttgggaggtcgaggcagggggatcacttgaggtcaggagttcaagaccagcctggccaacatggtaaaaccccgtctctactaaaaatataaaaattagccagccgtgatggtgggcgcctgtaatcccagctactcaggaggctgagacaggagaatctcatcaacccaggaggtggaggttgcagtgagccgagatcacgccactgtactccagcctgggcaacagagcaagactctatctcaaaaaacaaattaactacaaataaatatgaataggactaaaatatgatagaaacatggagaaaggccataaggcaggaatacacatcagaagaaactaggctgatagaccagaaagaaaatatgcttagcattacatgcctagcagtaatcagagaaaccccagcactgtgaggacagggcttcacctgccttgctcatggccacacaccctgttcatggcactgtgagggcaggacttcacctgccttgcccgtgaccacacaccctgttcatggcactgtgagggcaggacttcacctgccttgcccgtgaccacacaccctgttcatggcactgtgagggcaggacttcacctgccttgcccgtgaccacacaccctgttcatggcactgtgaggacaggtcttcacctgccttgctcgtggccacacaccctgttcatggcactgtgaggacagggcttcacctgccttgctcgtggccacacaccctgttcatggcactgtgagggcagggcttcacctgccttgctcgtggccacacaccttgttcatggcactgtgaggacagggcttcacctgccttgctcgtggccacacaccctgttcatagcactggttggtattcgtagcattgtcaacaaaccagatacacatcaatataacgtgatggatttctcagccttcaaaatagcaagttaaaaaccctgccaattaaaagaaaaggcataaacatgactatgataaaaaaaaaaaaaaaaaggctgggtgcggtggctcacacctgtaatcccagcactttgggaggccgaggcaggtggatcatgaggtcaggagattgagaccatcctggctaacatggtggaaccccgtctctactaaaaatacaaaaaattagccgagcttggtagcaggcacctgtagtcccagctacttgggaggctgaggcaggagaatggcgtgaacccaggaggtggagcttgcggtgagccaagatcacgccactgcactccagcctgggtgacagagcaagactccgtcaaaaaaaaaaaaaaaacaaaaaaatacaaagtgccaatagcaggtattggtgaggaaatgaataccaggacctgtgcatatgatgagctactgaaactgcctttgcaaaattatgactaagacagtgaaagagatctgactaaatcaattccatcttgcttctaacctctaagctgtcctagttcattcttgggcataggctgaagtaactttgagagaaacttatagttcataaccttatggtttatagtttaaaacacagaggataacagccctttcccaaagcagacctccttcttgcctggggaccagatggcctttgtaggactaacattagccccaagattagaaactctggtttaggagtcacgcagctggaggctagaagattctgaccctccctcaactgctcctaagatcagcgcttgggatattttgcagactctgcacttgatggatcagctggccccacccagatccataaaatggctcatctgatcttgtggcccccaggaactgactccgcgcaagacgacagcttcgactctgtatgatctcatccctgaccaatcagcactcctggctcactggcttcccccaacccaccaagttgtccttaaaaactctgctccctgaatgctcagggagactgatctgagtgataacaaaacccttgtctcccgcacagctggctctgcgtgaattaccctttctctactgtaattcccccgtcttgagaaatcagctgtgtccaggcagcaggaaaggtgaacccactgggcagttacgctaccaatcctgtgatatgattgtgtcacatggcatggttgcccttttttctttttgacagtcttgctgtcactcaaactggagtgtggtggcgcgatctcggctgactgcaacctccgcctcccaggttcaagcaattcttgtgcctcagcctcccaagaagctggagtacaggcccacgccaccacgcctggctaatttttgtatttttagcagaggtggggtttcaccatgttggccaggctggtcttgaactcctggccttggcctctcaaagtgctgggattacaggcatgagccaccgcaccagccgtagttttgttttcttgagacaatctcactctgtcacccaggctggagcaaagtggtagagtcatagctccctgcaacctagaactcctgggctcaagtgaccctcccacttcagcctccccagtagctaggacaacaggcacgtgccaccagacctcgccttttttttttttttttttttttgagacagagtcttgctgtgctgtccaggatggtctcaaatttctggcctcaagtcatcctcctgcctcagccttccaaagctctcagattataggcatgagccaccatacctggccccatagttgaacttaaaatagactatatgattatctgggggtgtgggggggctgatctagctacatgatcccttttaaaacatggagctcttggcgggcatagtggctcacacctgtaatcccagcactttgaaaggccgaggcagtcggatcacccgaggtggtcggatcacccaagatctataatttgagaccagcctggccaacagggcaaaaactcatttccgctaaaaatacaaaaattagccgggcatggtggcacgtgcctgtaatcccagctacttgggaggctgaggcaggagaattgcttgaacccgggaggcggaagttgcagtgagccgagatcatgccactgcaccctagcctgcgtgacagagcaagactccatcttggaaaaaaaaaatacaaaaattaggccaagcgcagtggctcacgcctgtaatcccagcactttgggaggtcgaggcgggtggatcacgaggtcaggagatcgagaccatcctggccaacatggtgaaaccccatctctactaaaaataaaaaaattagccaggcgtggtggtggacgcctgcaatcccagctactcaggaggctgaggcaggagaatcgcttgaacctgggaggtggaggttgcagtgagctgagatcatgccactgcactccatcctgagcaacagagcaagactctgtctcaaaaaaagagaaatgcctatttttattttttttgagacagagtcttgctgtgtcgcccaggctggagtgcagtggcatgatcttggctcagcgcgacttccacctcccagattcaagcaattctcctgcctcagactcccaagtagctgggattacaagcacaggccaccacgcccggctaatttttatatttttagtagagatggggttttgccctgttggccgggctggtctcaaactcctggcctcaagggatctgtctgcctcaccttaccaaagtgttgggattacaggcgtgagccaccactcccggccccatacatttattttaaagtaaatttccacatcttgcaataataaaataaacagtatttcaagtcaccttaaaatagataatgtctacattaatagatgttcatccacacagccccgtttatcacctggaaccatacttgagaagtcctgcctaccagtgtccatcaccagctccattcctctgtagttggtgccatctgcaagaatcgagccccttcctggggtttgcacaggctgcagcctcctcctactacagcagatgccaaagggcactgggcatggtgtgggggtcagttcactttcacacagggcttgtgttttccgtggtctcggcaacaccaacagtgtctgaacatgactgcacagacattggtgcccgccgctgcttgtgagctccaagaccatctctccttctgtgggtgccccacttatctcactttttgacccctccccaggtctctggaaccctctcttcagtcttgacttcctgctggcctgtctggaccaggtctgtcagtcctactccccagcaccagatgggccctaagaatccccctcctgccacacctgctatttcctcatatccagcctctcaggctacgatcaccacgccacccttccagaaggttccttccaaccgcccttccgaaaaggccctctccatggccctcttgtcaatgactcactcccagcatggacagcagagacgtgacccacacctctaacccatgaggctctgcccagccctccctggacatgtcagaaaacagagagaccctagtcactgtgggtccagaggcaggaccagcagccacgtccatgccttttcagagcaccctcaccagggtaaggcaagttctagcaaggcagagagggatctgtgtgaggaggtacctctcattaccaccactgttaatcatcattgacttattcattcatagagaaaaagtcatcttgaaccatcaaacccgagagcataatgtcggatacggaaagtcggtgggagaagtcatctgtcattaggggtgggagcggggaacttaacacgggcatccaggaaaaggcaggatgagaagaaaccgtggacttggtaaagtctgtaagaaacgtcaccatctgagccatcgctacagcatctgcctgtatttctcacatgcttacatgaaaggcattatttattcacttggacaacaaaggctgcttttcgtgagagtcactggtcctcccatgagggcatccaccgatacttcaagaatccttcctggggccgggcacagtggctcacgcctgtaatcccagcactctgggaggctaaggggggggcggatcacgaggtcaagagatcgagaccatcctgggtaacacggtgaaacctcgtctgtactaaaaaatacaaaaaaaaaaaaattagccaggcgtggtggcgggcgcctgtagtcccagctactcaggaggctgaggcaggagaatggcgtgaacctgggaggcggagcttgcagtgagccgagattgcgccactgcactccagcctgggagacagagctagactccatctcaaaaaaaaaaaaaaaaaaaaaaaaaaaggaagaaagaaagaaagaaacaatccttcctaggacagtgaatcactcctataatcccagcactttgggaagctgaagcaagacgatcgcttaagcccaggagttcgagaccagcctgggtaacacagtaagatcccaactctacaaaagaaaatatgttttttttaattagcaaggcatgatggtgcatgcctgcagccccagctactgggggggatcacttgagcctaggaggtcaagggtgcagtgagcgatgatggtgccactgcactccagcctgggtgacagagcgagaccctatctcaaaaaagaaaaaaaaaaacaaaaaaaccagtccccacactagcagccacccataagaatataaagaaagcatggtgccctccaccaccttttacttctatacctaaccagcaattttggggggaaaagacataaatgggaaagagttctgacacatgactagctaagaaggttttgaaataaaagtaaagagtaggaattccgccaggtgcagtggctcacacctgtaatcccagcactttgggaggccgaggcaggtggatcacctgaggtcaggggttcgagaccagcccggccaacatggtgaaactccatctctactaaaaatacaaaaattagccaggagtggcggcatacacctataatcccagctactcaggaggctgaggtgggggaatcgcttcaacttgggaggcagaggttgcggtgaactgagatcaagccactgcactccagcttggacaacagagagagactccttctcaaaaaaaaaaaaaaaaaaaaaaaaagagagaaagaaaaagaaaaaaaaaaaaaaaaaaaaaatatatatatatatatatatatatatatatatatatattacaagcctatgctaattacagcagcttgggacaggagaaacagaaagacttatagaatgaaattaagaatacgctgggtgtggtggctcacgcctgtcatcccagcacgttgggaggccaaggcgggcagatcacctgaggtcaggagttcgagaccagcctggccaacatagtgaaaccccatctctaccaaaaaaatgcaaaaattagctgagcctggtggcacatgcctgtaatcccacctactcaggaggctgagacaggagcatcacttgaacctgggaggcagaggttgcagtgagcccagattgtgcaactgtactccagcctgggtgacagagtgagactacgtctcaaaaaaaaaaaaaaaaaagggtgcagtggctcacacctgtaaccccagcactttgggaggccgacgtgggtggatcacgaggtcaagagttcaagaccagcctggtcaagatggtgaaaccccgtctctactaaaaatacaaaaattagtcaggtgtggtagtgtgtgcctgtaatcccagctactcaggaggctgaggcaggagaatcacttggttccgggaggcggagtttgcagtgagccaagatagtgccactgcactccagcctaggcaacaagagtgagactccatctcaaaaaaaaaaaaaaaaaaaaagaagaataaaatgtgtgtcaccagcccccagcacatcccctccacaatagtagagtgtagggtagggctctgcctgctcatttcgccccaggaggccaaccctccctgatagtccaggatatttttggaaaaaaaaaaaaaaggtgcttttccgtctccccaagatcctcaagttcaactagacatttcctatataaatgttttgttctgcctgttcattttggtgggtgcccttttctcccttccccaccacccgtgctcctcccagtctgcccctggcctccagccctgaggatcagttgaggtagggtccctggtattccgtaccctcctccctttgtttctgttggttgtcactcctgctgaatgtattgctttttaatactgtactgcaggttttttttaaataaaattgtttggaaagtaaaagagaaaaggaataacgtgtgtgatatattgaataaaaaacacttcatagatctgtagtctagtgggggaataagaaaaagttttaaaatttttatttattttagagacagggtcctgcctctgttgcccaggctggatggagtgcagcagcacaatgatagctcactgttacctcaaactcctgggcttaagccatcctcctgcctcagcctgcccagtagctaggactaaaggtgcacaataccactcctggctaatttttttacttttaattttttttctagagacgtggtctcactatgttgcccaggctgatcttgacctcctagggtgaagtggtcctccgaccctggcctcccaaagtgctaggattacaagcatgagccactgcacccagccaaaaattatattattatttaaatttatttatttatttatttttattttattttttgagacggagtctcgctctgtcgccaggctggagtgtagtggtgcaatctcagctcactgcaacctctgcctccccagctcaagagattctcctgcctcaccctcccgagtagctgggactacaggcatccgccaccacacccagctaattttttgtatttttagtagagacggggtttcaccatgttggccaggctggtctcgatctcttgacctcatgatccacccaccttggcctcccaaagtgctgggatttcaggcctgagccaccgcgcccgcctatttattttttctgagacggagtcttgccctgtcacccaggctgcagtgcaatggcgccatctcagctcactgcaacttttaccttctgagttcaagtgattctcctgcctcagcctcctgagtagctgggattacaggcatgcaccaccacacctggctaattttttgtatttttagtagagacggggtttcactatgttggccaggctggtctcaaactcctgacctcatgatccactcacctcggcttcccaaagtgctgggattacaggcgtcagccactgcacccagcctcaaaaattattattattattttgagacagactctcagctctgttgcctaaagtggagtgcagtggtgcaatcttggctcactacaacctccacctcccaagttcaagcgattctcctgcttcagcctcctgagtagctgggattacaggtgcataccaccacacccagctaatcaaatattattttttaatccttgcaaatgtaatagcaaaaactatgaatgccccaagctagctagggcttagggaggcacggatttgtataaagtgctggtgaacttgtaaagctgaggatccacagtgagatatttctacaacatccacaccctctgatccaacacctgcaacaatgggcttggcaagtaactcatggggaaagcacctctcttggctggggcttcctcaactatggtgggagcaacacaacacaactcatcccatgagatgtggtgaagatatcagctctaggccaggcacagtggctcacacctgtaatcccagcactctgggaggccgaggtgggaggatcatgaggtcaggagatctagaccatcctggctaacacggtgaaaccccctctctactaaaaatacaaaaagaaagccgggcgtggtggcgggcacctgtagtcccagctactcaggaggctgaggcaggagagtggcatgaacccgggaggcggagcttgcagtgagctgagattgcaccattgcaccacagcctcggtgatagagcgagactctgtctcaaaaaaaaaaaaagtatcagctctagcctggccccaggtgagtccacaagggttattcttctttttttcccactatactaacaaggacgtgagggttcttttttttttttttttttttttttgagacggagtctcactctgtcacccaggctggaggagtatgaaggaactggacaacctactgtgtgcgtgggaggatccaagtccagttgtatgaaagggccagggctcttcagggaacatgtggggctccactggccacacagggcacagaaatagcaagtcacaacaactatcacttcgcagaagagaattacagtgcacggccaccaccaatgacaaacagatgctcatagtgggaccccaactgaaaaggatactgtctcagctccaggctgcagggctgacaggaagagcctcgaatgctaccaggaactctgtgaagcccagctgcctcacagcccacgtggggtgctgcctgcactgctcccttcgaaggctagttctgtctcaaagtggcccatagcctgatgaggaggctgaggcacgggagagcacagtattgtgccaaacccctactgactccaatggggacggcaccaggttcaagaggccgaagaagagactaagagccagcaaacaagatgtagggttttactgggggcttacataccggggagagtccaggggcggtgggctgggcaggagaaccacttgcaaaaagcatgcagtttatatggcattttcacttaacatcctccccctggcaaccttcatttaactgaaagcaaaaggccaggatcccttataccaccagcattccatgggacagggctaaggacccagatgttcctcaaaaataaggaatgaatctctgagattccttagctgggaactctgaaccacactcaggtgcgtctgccacacagggccattctcaggtgtgcttaagcattgctgtggggtgtgtttactatgcacacgagaagggatgggcagggtcgcagtctgcagcactgcccacggacagccctttgcatatggcgtttactgctgtggggttccttttctcaccatcatcaccccagctgtgctcccaaagttaacccatggaccaccggcctggcaccaccacaactgttccagtgtctgtagcctcaccttcagttcctactgggccgagaagccttggaggcagaggctcagcacccacacacccccacctacatctccactaggcttcgggtagcaggtccaactcctgagactgtgcagactcccattttccagaggcctctgctcccactgctccccacctacaaagcttgccccagggcctctacacgtgccgttcacagtgccagggacactcctcccccagttacctcctgcttgcccttctagcctcagtccagcaacctccaggctttgtcagattgtgtatccacagcacttcacaggggagttatccacatccactggcccagccaccgcctcagtggcccaccaaagacccacagatgagaatcagagttctcatctctctacctcagagcagctgcgaggctggccagctcctcccacacccttggcgttacacagacagggtcatcccacagggatggctgaggttctttgctgggagacagggaagaccctaaaataaggtcttcagggcactagcccctgcactcctccattgctccttcatccacgcagacatacagacttctgtgaacacatctgagtttattctgccactgctacagggcccactgtcatttccagcccactgaggttgagggtatggccaggctgggattcacacaggcccaggatgaaagggacaccgagtgtgttggggtgggggtggctggctttgatccctaccccagtgggttggccaggtgatcagagcctccaggttccctcacacacagcctggtacatttctgccgtcaggggccggaaggactgggcccggttgtccagtacaaacagagggtcaaccacgatccccacattgaagccctcacgcaccaaccgggtcttcatcagtttgaacgtgctggtgacctccatggcgtcctgcagggcagtgaccatggtccaatcactgtgacatccacccgccccctggctatgatcttccacccacccaccaggccaccctgggctcacctggatgcggatgaaatggggggtagcgtaggcagggagccaagcgcgaacgtgctggtacaacttctccccgtcgaaagtctggccgggggctagctgcacagcagccatgcccaccttaccctcacaacctagagagcagtctggtcactctcggctgacccatctcgagggcccatagctgaccctccagcctcgcccagctctgctcactggctgtgagagccagcaagtctctaaacctctctgggccctagcacttccccacctgtaaaatcagaataacgacccctccacccacaaagctgttggaagtttaaaatgagaaccctccgcacctggcacgcacacgccatacacgttaacctgttgcaagaagtccacctgcgacaacacgccctccacctcgtgcgtggacacgttctcgcccttccatctgcaaggagggagccggcgcttgtgaccacgcccccgggaaggagaggccccgcctcttgcccccgccccgccccttttggggatcaggaggcccagtcagccccgccccctcgaaaatcgagaagccccgccttcgcgtgagaagtcctgactccaagttccgccctcttacgacaggaaagtcccgcctcttcagcctgactccctctaggatctgaaagcgtccgtggccccgcgccagccccgccccgagaaaccctgcctcggaccggaaggtgtccccgaggcggtcgcggaagtagaggaagccttcgcggtccatggccagtacgtccccggtgttgtagtaaacgtcgcccgattgccgcacgttgcgcaccagcttccgttccgacagctctcgggggccgcggtagcccacgaagggttgctggcttaccaccttggtcagcagcagccccggctcccctggggtaggagcaggaacaagaacccctggagcccaccagccaagccccctgctggaggttttcaacaacggtggactcttcatcacccagcaccctgccaaggacagacccaaagacacagacagggagatccagagatgagagagacattcagagaccttgagagactgcgacaagcgacacagaaaatgagagagaagtatagagaaggcggtatggggagcccatgagaaacaggaaaaggataacaagggatggaagacggacagacaaatggcagtgagaatagatatgaccaggaccttgcaaggccctgggagaagacactaacagaaggtacaggacaagggaccaatggctggaatgccgtcttccacagaaagctcaagagaacaaatcagatggacacccagagacccagtaaatcagagcaagagatcaaggcaggggagctggacagagccgagaagctgaggcggaggccccagatggtggtaaggcaggccactggctcagggtccagatgaaggctgcagacccctctagtgagcaccaacgtcaagcttttgagcagctcgttccagccaagcagaagactgagggtcgccacccctgccacccaggaaaggctcctcaacccccatacctagccctacagggatgcagaagccctgattgtccctcacaggctccgccgcctccatgtcgaactgcaccagctcaaagggggacagcatctggggtggagggtggagtgttgacataggtcctgtgggctcagcctcagggcagctgcacaccaggtacccgcacactcactcggaggaggcagctcatcttgcccagggccccgcagcgccccacatagttgactaagcccatgttgccttctgtggagccgtagacttcccagatccgaataggaccgaagcgctgctggaaggtctcccacacatcagcccgtagtccattgcccattgccaggcggactgtatgtgtccggtcctctggttgctacaggaatgtccccagaagggtgaggaggaggtgctcttggggcatgccttggaacctttacctagagggggtgttatcctgggtccttaccttgggagttacctggaaggtgatgggggacctctacctaagggatctacctgggttacttacatgagagtagttactggagtcttaaatagagggttacctgcaggggcgacctcagagctttgcctgggggacgttaccagaggtgactggaggcctcatctggggtctcacctaagagtagttacctagaactttaatttaatggaaatttaattttaattaattaatttttaatggaaattctcatgataggggtaggggctattatccctgttttccaaatgaggacactgaggctcaaggtagcacagct

SEQ ID NO: 817 - DNA, 164815 bp, Homo sapiens
tgttttcccaaagagatttttcttatttgaaccatggaacagtattttccattgcacagcctttccggatggtgaccaacagtgataacccctataaaacagggcaacaccggtaaccccttcgtggggctgctgcaagggtgacacagcatcagcctgagacctcctttgaaaagcttggaataagaaagcacccaaacagcacaagaaccacctgctttcttccaactctgcaagcacagctcatttactcacctgactgaagtaacagtgtaaaagacaagcgttcaggtaagaagctgactggaccagtttgaaaaatctcacaaaattattactgttcaatgcagcaaaagcctgaacagcaaatttcacctcagatgagtttctaacagcaggatggaactgttgtacttctctgttaattaaaggagagaaaaggggttggaatgttattttaaataagacaaaattttcatgaagatagatctgataaataatagatttcactggccagatgcagtggctcacacctgtaatcccaaaacgtggggaggccaaggtgggaggatcgtttgagcccaggaggttgaggctgcagtgagctgtgatcgcatcactgtactccagcctgggtgacagagcaagaccctgtctcaagtaataatgatactggatttcaaccatactgagaaggagggtcttactggtgaaatgtgccgttaaattcatagtttactaactaccacgcttggattggtttgacaaaggtttccttcaaaacaataatgaatagaataaacaaattcaaaaagcaatttaggaatcagttatcaaaaagttactttaaagtaatgccaatggactgtcagctgtgctggatggtaaagtctaaaaaacagaaaacttaactctttttgtttagaaatgaattgattttgactgaattattcgtgatggagaacaaatgcttgtcacgtagaaaaagacaatacagcaatctttcataaccagtttaattttttttttttttgagacagagtacttgctctatcacccaggctggagtgcactggcacaatcacagttcattgcagcttcaacctcctggcctcaagcaaccctctcatctcggcctcccaaagtgctgtgataacaggccatgggccaccacacctgggttttttttttttttttttaagagatagggtcttgctttgtcacccagactggaggacagtggcatgatcacagcttactgcagccttgacctcctgggctcaagggatcctcccacctcagcctccccagtcgctggaactacaggcacacatcaccacacctggttaattttatttatttattcatttttgtggaagggtctcaccatgttgcccaggctatacaaggcttaattttaaaatttaaaatcagccgggcatggagactctaactgtaatcccagcactttgggaggccgaggcaggtggatcacctgaggtcaggagttccggacaagcctggccaacatggtgaaaccctgtctctactaaaaatacaaaaaaatgaggcgggcatggtggtatgtgcctgtaatcccagctactcaggagactgaggcaagagaatcgcttgaacccaggaggtggaggttgcagtgagccaagatcgcactactgtactccggcctgggcaacagagcaggactcggtctcaaaaataaaatgaaataaaaaattaaaatcaaccacacatctagatattctgtcacacagttcttgaggaaaatacaaagaaaaaaaaaagaggttcaccattgataggggattcttagaactaaaggggacactgtccaccataagtccagcttaaccacaagcagagggtccaccacaagcagagggccagagagctcgccagacttcgcatgtaagtgactaattatggatcagaccagggttttacattcattcattctcactaccccattcttcgcatttttgttttacataattttttcctctcttattctgagatctttgacaaaactatctgggaacagggaactgctaacaaccttgcagggcacctggaactccctctcctggttcactcacctgtctcatgaggaggattccttcctcattttctcactggtgaggagaaactattttcagaaatgaacatgtggggcctacgtcagatgtgctggtcccagggcacacccccatcgctcttcccccagctcagctcagccgactgcaaagccagaccaaggtcctctactatcatcccaacatctgctaccagacagaatgctgcactattggctactgccactcctgaaagctcttctcctgtttaaagcctgccttttcagccaccttaggacaacttttggatgtgaaaattcaccttaggatgtctcccttgttgagactgagcagaacattgtagccctggaactccgcttcgctggcacagaagacacccttgtttctcaggtcctggtacatctccttcaggctctgcaggcacttggtcatgttctcattattgatcttggcatcaaaggaggacatgggctcctcacacatgaagtgggcacagtggatgtgaaaccgggtgcacttctcaatcagggacaccgtcagggggtcacagaggtgctgctgcgtgatatcctggccacaggcgagggggaggatcacacacacattcccatgcaaagaggcaaccgtgagaaggatcatgctacgacctcaatttctcacttttcaatttgaaacaaagcccatgatgcacattttaataggactttgtagtgacttaaataaaagtcctggggtttgtttttttttttgagacagaagccaggctggagtgcagtggtgtcatcttggctcaccacaacctccgcctcccaggttcaagcaattctgcttcagccgctcgagtagctgggactacaggcgtgtgccaccacgccaagctaatttttgtattttcagtagagatggggtttaaccatgttggccaggctggtctcaaactcctgacctcaggtgatccacccacctcggcctcccagagtgctgggattacaggcctgagccactgcacctggcccacaaaagtacatttttgttacagataaaatatataacagagtaataaaaatatcagtttgactttggaatttgcgtggattttttagcatccaggttggaggcagccaataccttccgtatgccacgcgtgcggttccacacgaagtcataccaatcccgcaggctgccctccttctggtccatgatctgggtcaccaggtagtccatggtcctgctgagcactggcaagggccgcagctcgtggggcaggggctcctcctgatccgccgaggaccgactgtactctttcacagctgctgcgtggtccacctagagacatgaagccgagacaggatgcccatgtggcataccttgggccaggcatagttatgcctgaaaatgagggggaaaatcacatacacacccacacaagatcagtatttgagaatatattttttcaacataaaatttctgttaaaaggtgacaatcaaaattcaaagacaaatagagaaatttgattttggcaaatatgacaaggagttaagatatgagtgcgtcatgacaaacaggaggaatgttaagtgaaggcacatctgctagcctccaaagcagagagacgggacagggaagggcctcaagcacttaaaaggtctcaggcccgctcacacaccagattaagtctacacagagcagaagtgaaacagagacaggcggtgaggactgctgaggacacagcatcaggggctggctgcccacctggggcctggaattgcatctcccacctcaaaaggaggctgaagacgtggccaagggaagaggcagagatgtacacaggacaaggccctgggcatgtgcctctcctggggcaggggccctacagtgacacgagttgctgggctggggaccccgcaccaggcgaagggtgtataaagccaccagccaggaagaggagaagcccataagcaaaattcacaaagtccaaaaggatctatattggtgcagctttctggggcaacaatttgggaagatacatggataatgttcaggaaaggtcataccctctgatgcagtaatttaattcttaggatctgaagaaaataatctaaataccagagaagcattacatacaagatgccaaacaatattactaatagaactaaaaatttagaagcagcctatctactaatggtaaaaatgcagagttttgacagagctactaataaaataatatgctgtcatttttaaatgctcatagtttaccctaacaaaggaaaatgttcatgacataattttaagtggaaaagatacacataaaattgtatctagagcataatctcgaatgtgtaaaacataagcatagaaacagacaggaataagatcgtaaaaagaaaaaagttagctggatgtggtggctcacgcctgtaatcccagcactttgggaggcggaggtgggcagatgacttgagcttaggagttcgggaccagcctgggcaacacggcaagaccccatcgctgcaaaaaataaaacagtaactaggcgtggtggagcatgcctgtaatcccagctactctgtaagctgagtgagaggagaggatcacctgagcctgggaagttgaggctgtagtgagccatgattggaccactgcacttcagcctaggtgacagagtgagaccctgtctcaaaaaaaaaaaaaaaaaaaaagaatttgaaaaacaactttatttaaaataacttgcatctataccttatcatgtataggtaccaattacagagtgaacatctcacaatgcaaaacagcttaatatgattgttaatagcacaaatacccaacactgtctaaaacaaacacccaaatcaagtatgtacagaaatgacaaaagcagccccgtcccctgcccacactccacggggagatgcagggctctacctggtcagtccctgggaccacttcgaacacgctcagctggctacgggtctcccgcatgtacctctccttctcaggacacatatccaggcaggtgccaacaaaagtcctcgctttgtccagatcggttctcttcacccgagctaaatgacgtcaagtaaaaggtaagaatgtaccacatggttagcacgaacctacagaagtgtattctcataatgataaaaagaaattaaaacttaaaacacacacacacattacaaaagaaaagaaaaacatttgtaaaactcagagcctcagacaaagaggacttatggtctattatgccaggcagtgggacatcaaagctcccaaagacccgagtccacctctctctaacagtcacagaccctcactgcagactaagagaaagacccccgagtcacctctccaacagtcacagaccctcactgcagataaaagcaggggagtgtcctcactttcagccggagttttctaactcctgtaatgacctcaatgacaaaaaatcatggtgcaggatgtttactaaaaggattgacttgtaacaactgcaaatattcaaaatatatcactattctaaaactgtctcagtattcaccatgactttaatataagaatcatataatggacgttaactgggttcttacctgaatgagtaaactgctattacacttaagttacaatgtagcttgcaaggaaaaggaaatgcaacaacttcacactcaaaatatatacttattgttttcatgttgaaaaattctaatacctgggcccggcctggtggctcacgcctgtaatcccagcactttgggaggccaagactggcagatcacctgaggtcgggagttcgagaccagcctgaccaacatggagaaaccccatctctactaagaatacaaaaattagccgggcgtggtggcgcatggctgtagtcccagctactcaggaggctgaggcaagacaatcacttgaacccgggaggcggacgttgcagtgagctgacgttgcgctcactctgtcatggtactccaccatgggtaacagagcaagactccatctcgaggaaaaaaaaaaaaagaaaaattctaatacctaataataatttttagaatataaaaatcactgtatcaatgatatgatgtttgatggcagcttttattactatatgttattatattaaggaaacatggtgattattcaaattatccacagcttttaaaaagaggaaactcctatagctgattttttttttctttttgagatggagtttcgctcttgctgcccaggctggagtacaatggcacaatctcggctcaccgcaacctcagcctcccgggttcaagccattctcctgcctcagcctcccaagtagctgggattacaggcatgtgccaccacgcccggctaattttgtctttttagtagagatggggtttttccatgttggtcaggctggtctcgaactcctgacctcaggtgatccaccagcctcgacctcctaaagtgctgggattacaggcgtgagccaccacgcccagcatttttttttttttttgagacagaatctcaccctgttgtccaggctggagtgcagtggcacaatctcggctcactgtaacctccacctcgccagttcaagtgattctcctgcctcagcctcccaggtagctgggactacagatgcacaccaccgcacccagcctgcttatttattatttatttatttattgtagagatgggggttttgccatgttggccaggctagtctttaactcctgacctcaggtggtccctcatgcctcagcctcccaaagtgctgggattacaggtgtgagccaccatgcccagcccggctgaaatttaagagaaaaaaattggctaagagaagtacctgtgttttttccttttatttttggtccctgcatatatttttagtgttaatggaatacttactttttagtaggtaatacattcacacagttcaacattgtaacagtgtaagaatgccctgtccaagacggagcactccaccataacctctgcccctcggaatcccgctccctctacagacaggagcccattcttttgcatcctcccactactattttatacatacattagcaaacatatttgcacatttatgtacacatacacgcaacactcactccaagaagacaggcagactatgaagatcagacacagcatatcacaggctctgagactcaacagcaatagagcccaatggaaaggagttgctcctgccctgatggcacccaagatgacgacctcaccaggcccctagaacctctgccaccaagtgccataccttgccgcatgatcctgtctctctggtcaagcaggcggtacttctccttggatgtctcagccacagtgcctatcagggtactgagggagagcacacatggcccgaggccctcggagccctcggaggctgagtcaaaagagtctccctcgaattggtgggcctttagaagacttggcttcttcactggagagctataaagtaaacaccacactgagggccctcgtcccaggaaggccttcagagcattttcatttctgaacacgtcccctcatctttcaagattttctggtcctctaaagctgagaaactacaagcactgaaatgagatgagttttgataaggatggtaatgagcacaaaagcgttattcacattactcactgactttaatataattttgaaatatttcatacttttgaaaaacaaaatagcctgggcaacatagggagaccccatctctacaaaaaatttaaaaattagccgggcatggtggcatgtgcctctagtcccagctactcgagaggctggggtgagaggattgcttgagcctggcaggcagaggttgcagtgagctgagattattacactgctgctctccagcctgggtgacagagtgagactctaacttaccaccccccgaaaaaaaaaaaaagataggctcatttaaacagctaaaatgaacacttactgatttctatttcaaagaaataaactcagcatgaaaaaagtctttaatatcataaggaaatattaagcctacatgttttaaaacagaaattattttggtagaaggacatactaaaaggaatcaggcattctctctcagcttccccattttctagctttcatcattttctgaacttgaatgtcaaagattatgtcaaaccagcaactaaactgctcgtcacaaaacggaaagtgaggaaaatacattggccaaaagatgaaaagatggattcagccggagatctgtcaaagtaggcctggtgtgaaaagcaaaagcctttgagaacagagttccccagacagacaaggtagccagggcacttcacatcacatgccggttaacacaactaacatggccgaccgtgtctgcttcactgtgataagctgcacctgcaaaaagtcatgctgcccttcctttaggagacagcctttttttttttgagatggggtctcgctctgttgcccagtctggagtgcagtggcgcaatctcggctcactgcaagctccgcctcccgggttcacgcagttctcctgcctcagcctcacaagtagctgggactacaggcacctgccaccatgcccggctaattttttgtatttttagtagagatggggtttcaccatatcagccaggatggtctcaatctcctgaccttgtgatccgcccgccttggcctcccaaagtgctgggattacaggcgtgagcactgcgcccggccaggagacagctcttcaggaaaaaaaaaaaaaaaaaagtaatgctggaaactgctgaaagtgattattagaaatgcatggtttggccgggcatgcatctctagtcaggagttcgagaccagcctggccaacatggtgaaaccccatctctactaaaaatacaaaaatattagctgggcgtggtggagcgcacctgtaatctcagctactagggaggctaaggcaggagaatttcttgaacccaggaggcagaggttgcagtgagccaagatcgtgccactgaactccaacctgggcaacagccagactgtgtctcaaaaaaaaaaggaatgcatggtttattacagccagttaaatgtcttgaggtaaaaagttattgcttatacatttatatgtcaagtggaactgcacttaactgcagtgggattcaggacgagttagatgagcaaggagatttcctactacaatcctgtgaggcaggcagcgacccgccacagggcgccagcctgcgtgtgtcccacagagcaggcactctgtgcaaggacagaagttctgctgtcctaagtgagcagcctcccctggatctcctgtagctgcagctgaaaggtctgtaccagctataacaactgtgtgatgagattctcccatagaaaatgccaagatggaaacaagaaaaaaaggccagccccaaaggaaggctttctcagcaaccttggccctagggtatatgagaacaagacaggacagaatcactgctctccaccatctctgcagctggcagttaccagtgtcagaaaattctctcttctggctgggaccaccagccccacacagacccacctcctaacggcccatgctggcaggaggggcagagcccctgcccctccacccccaaccatccctagcaactggcttttgtctcctcaccactccccacagtcttgcaccctgactcaggtgtcgctatagggcgctatttcctggtccttccggaataaggtcattaggagggaccgatcccaccttttattcaggaggctgctagcaccagtcctccctgcggccttgccaagaggagagtgctgaaagggtgcatcctctgtgctcgggctgacttcaccgtcacctggtttcttctccttcagggaaaagggtttcttattggggcctgtggacataggaggcagaaaagagtttatgcaatcacagatcacctggaactggattttttcactctgtttctaagaaagtaatattattttcattgtcacaggaggttagagaagagcccaaggaaataactgtgagatgcaaatccactgagagccagcctcctccactggctggggaaagggctcacgctcaaagggtttggaccaagagcatgagaaactgaaaagagggccatgcacaatggctcatgcctgtaatcccaagatcagactgggcaacatagcgagatctcatctctataaaataaataaaaataatttttttaaaaagtgaaaagaataattgaaaactcacttattttcttcctgtgccaaaagatagccatgtctttatgcaaacttttccccttctttctagccagggctgcagatgcctggaaaacagtccacaaccgccatgtgtgagtatatcaggaaaccaaaggaaatgggattgaaaactcaaatgcagtaagcacaacagaccattcaaaggcaccaggagctcctgtcctttgcacgacagtgatttctccacccacacgtctgctaactgcatggtctctggctgcggcagcagcagtattcatctcccttacctgtctcacaagcatgtatttgctctttccccctttttttttttgagacagagtctcgctctgtcagccaggctggagtgcggtggtgagatctcagcttactgcaatctccaccttcagggttcatgcattctcctgcctcagcctcctgagcagctgggactacaggcgcccgccaccacatccggctaattttttgtatttgtagtagagacggggtttcaccgtgttagccaggatggtcttgatctcctgacctcaggtgatccgcccaccttggcctcccaaagtgctgggattacaggcgtgagccaccgcgcccggccccttttttttaattaacaactttgcttcatagaactcacaaacttggccttgttggcatttggtgagatgattctcaccagctgatcacacatacagagacagaaagtttgcgaagtcacaattaagcacaaaagggagctgcagaataacacacatgggatgccacttaccacagaaaacacacacaaaaccaaccacgttagtctccgtgtagatacactcataaaaatgtctaaaaaaatacacatcacactagttaactggactgctcctgagtaacaggagagatgaggatattcagttttgtctgtatcaatgaattgtttataaaggcagtctatttacatattagttatgtcataaaatatttaaggttcagctgggaaaataagcacattgcaacaggcaaaaaataactgtaaaaacaaaagggggttgggcatggtggctcatgcccgttatcctagcactttgggaggtggaggtgggaggatcacttgtgcccaggaatttaggaccagcctgggccacatagtgaaacttcatctcaaaaaaataaataaataataaaataacaataaaataaatagtagtaataaataataaaaacaaggccaggcatggtggctcacgcctgtaatcccagcactttgggaggccaaggtgcgtggaacactgaggtcaggagttcgagaccagcctggccaacgtggtgaaaccccctctccactaaaactacaaaaattagccaggcatggtggtgcacacacaatcccagctacttgggaggctgagggaggagaatcgcttgaactggaaaggtaaaggttgaagtgagccaagattgcgccactacaatacaggctgggagacagagcaaggccccgtctcaaaaacaacaacaacaaaaatgagagccggtacaatgactcaggtctgtaatcccaacattttgggaggctaaggcaggaggacagcttgaggaccggagttcgagacctgcctgagcaacacagtaagaccccatctatacaaatgtaaaaatacaaactttttttaattaaaaaaattaaaactaaaaacaaattaggattaccatatgacccagcaattccaatcctaagaatataccccaaaaaactgaaagcagggactcaaataagtcatatgccaatgaacattattcacaatagccaaaaagtagaaacaacccgcgtctgccaacagacgaatcaacaaaacgtagtccatccactcaatgtagtatcattcactttataaatttatactttataaattcctatagaacgtaattttgtctatgagaatactcagaaaaaatagtgacgatataaagctatataacataagcagtccacgttcactgcaccctagaaagtattatgcatacatttaggctgggcgcagtggctcacgcctgtaatcccagcactttgggaggccgaggcaggcagatcgtgaggtcaggagatcgagaccatcctggctgacacagtgaaagcccgtatctactaaaaatacaaaaaaattagccgggtgtggtggcgggcgcctgtagttccagctactccggaggctgaggcaggagaatggcgtgaacccgggaagtggagcttgcagtgagccgagatcatgccacggcactccagcctgggtgacagagcaagactccatctcaaaaaaataaataaataaataaaaagaaagtattatgcatacatttaaagtcaggatacaaacccagtgcttcaaagcagttatctctagaggacagactgacaaggggaatttcactttttttctttttcttttttttgagacggagtctggctctgtctcccagactggagtgcagtggcacgaactcggctcactgcaaccgccgcctcccggattcaagcaattctcctgcctcagcctcccgagtagctgagatgacaggcgcgagccaccacacccagctaattttttgtatttttagtagagatggggtttcaccgtgttagccaggatggtctggatctcctgacctcatgatccgcccaccttggcctccccaggtgctgggactacaagcgtaagccaccacgcccggccaatttcactttttctgtattgtttgaacgtttacagcgatcatcttctatgaccaaataaaacaaaaacaaaaccaaaaaactcaacttccaaaagtactatgtggttagagcctttcagaagaatttctgaatttctaaagcctttcagaagaatttcacttcatgagaacaactctcccagcatttctagagtactatattctgtagggacctagaatatgccaagttatgaaataaatagtgctatcccagcctatgctaataagatatttgagtactttctctatattatagtaagcaaacaactgagggaccaaaaaaaaaaaacaggttttaaagtgacaaggttcaaatctagggtaacaaatggcaagatgggagtactcacatgatcaaagaaatgtaccactgcaagctttttgctgcgcctggtaaagatgcgctgcactttagcaattttgccaaaatggttctccagaatggtcctgtcgttgaggtagtcagggatgttcttgcactggatggctgtgacttcagagggagacaagcccccaagactgtctgtgctctcgcttctgttactctgacgcgccggagttcctcttagagaatctaggggttcagagaatggacacttaaaccatcagatgtttccaacaacaggaggcaccaactgtgtcgaagcagaggaaattttcagatgtaagacctgctccgatgacatgttagaatccctaatgtttatgggagatttatctgaaaaatcaagctaacacccagagaaacgtattgaaaacctgcctgcaggatttactctatgtgctacattttcagagctcaccttctttcttctctctactttcagtttcttcctctttattcacacctggaatccgggaaggtgccaggacagactgattccctcctgggatagccatgtggtcactttctgcagactcaacaaagccagtttcctttttggcctccttgttgcccagacgacctacttccttattgcttttgaaaacatcctgtatcgtccgaccaaataaagtacctccccggggtcgattcaggcggacaggtcgtttgtctggaggatgatcgccccgggacagaggatccgaatcttctgctggctcgtggccatgtctccttggggagcgatcctggtcctccttccttttcagtcctttcattaggctgggaagtggttccacctgggaaacagcttcttcacacccctgcctgacacctgctttgctagcctggaaaggttcgcccaaaaccgcagatgatacagggaagctactgaagctattattagaacttccaaatattgacttaggtcctctcttctcttcctctacattttggtttgacaaagcaggggtaaaggcagataatgaattattactactaacaggttttgaaaaggtaaaatttgaagtggtagctgaactacttgttacttgaggaaaagagaaaggggccaggcctccaggtgcactactaattgggtgggaaaatgtaaaaaacccagaagcaatttggctctgggttttctctggctcagattcagcccccagtattggtttgaacactgcattttccagaggtttaaagctgaattctgttttcccaaaaccagagttcactatttctccagcttcttgtccaaaagcagaagtgcttgggaaagccccaacactggtgggtgatttaaaactaaatcctgtgtttcccagcacagatgaacttgaaggcccagaggtagccacaaaggtggaagtgtgctcaagtccagaaaagggtccaacacttgaggtttgggtgaaccctaatgtttgcactgaagaggaatgacttactccagaagacgctggaaagctggatacctgtgaaaatcccgagctcttcccagataaggtactgttttgtccaaaaagagaaggttgaccaaatcgaaatggcggcttagatggaagtgttcctacattactagaagacgccgaaaaagcactaggctgctgcccactgaaaggattagttgggttcatcttctgctccaattattagaaggtaattaagtattatgtgtacaaaattaattggcttcctgaaacagcctgtagcactagggagttccccttcgtctttagaacaagctgaaagagaaaaattcagatcatcatagctatgttctgctacaagtctaagaaaagaatttttgaacactgtcatactaaaaggataactatttcaaaggcaggcaaagggttattattttctgagagccgataggttattttgttggagggtggggtagagagtggtacaaataattactttgttacagaggtttaaagcgtgatcctttaagattaaaaaaaaaaaagccgaatctttttactgagttagtaaattcatgaaaaacctccattggcagtaagaaaatgaatgctgttccaccttacaacttagagacgaatttctcccgacttcctccaatctctacagccggagaattcactgtaacgctgtcaaaaccttagcgtttcgggatctcctcccacctggcttccctcggagcggctggagcgctaagcactttctcacattccttcatcgcgccctggcggccaccctcgagcgggctggaaggacgagggcgctgccacgaagctgaggcctctcggcggggacggcgtgcccggggagcctaatcttccacccagcacagcccgaaacggcggaggccacgcgctgggcccaggccggcctggccactgtcccgccccgggctcgccaggggtcgccggcgccgcaacgctccgttagcgacgatgtggaggcccgggcgcgcggagctgcgtgggggaaggaaacggcgcccctggcgccggcccagcccccacgctcaccgtctcgccccaggaccccgaggcccgcgctgcccactggcccctcggaaagacttgaggcgcaagcacaggctgctgccgcgacactcagcgctgcgcaccgcgggcagaaaacgccgcggaccgacttccggttcgctcagcactaccggattccgccccgcccgctgcgatccggttccgctccccacaacccgctctgtggcggggcttccggtcgggagggtccgcccgctctcgcgtcctttgctgggtccagacaccggtacgtccgggcgggtttttagtctcccaagcgagagcgtcgcattcacccgcgtgggtctgcgggcgccccagaccccagaggacccggcccccaacgcttacctgtcccctctcctgtccctcccccattccagccccttctctccccagccgttgcccctccccgcaccccgccgcgtccgcgcgcctctctccgcgcgcacccccaacccgcccccttttctctgggaaccgctccttccgctccgcccgcctggagtccttctggccggattccgcggcatccttccatagaccctcgttgttgcttcctccttgtggtaaatgtaaattcccttaagattttcaatcagttccaccaaataaagtgatctgattgcgcgtgcatctgtatttttacagaccgtattatcacttgtactgattggtcttctcttacactttaaccccaggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgaggtaaaaaaaaaatgttcctcttcttgtctagcccatcttcccagagtaaatttcctgtcgttttgttttgttttgttttgttttttaattgagacggagtcttgctctgtcacccaggctggagtgcagtggtgcgatctcggctcactgcaacctcccttcctggttcaagtgattcttttgcctcagcctccccagtaggtgggaccacagatgctggccaccacgcctggctaatttttttttgtcagtatttttagtagagacgggggttttaccatgttggccaggctgctcctgaactgatctcaggtgatctgcctgcctcgggcttcccagagtgttgggattacaggcgtgagccagagcacccggcctaaatttcatgtattaattatattataggctaggctccatggtgcctataagtatatatgttacagacatgatttttaattttaattttgaaaattttcaaatatacacaaaagtagagagagcagtatattcagcctccactgatcgaggcccatcacccagagtctacaattacactggtaacccagcaggaaaaagaaaggtgacagccgagcgcgatggctcatacccataatcccagcactttgggagcccgaggcgggtggttcacctgaggtcaggagttcgagatcagcctggccaacatggtgaaaccctgcctctactaaaaacacaaagaattagctgggtgtggttgtgccgggcgggaggtggaggggggcacctataatcctagctacctgggaggctgaggcaggagaatcgcttgaaccccagagatggaggttgcagtgagctgagatcacaccattgcactccagcctgggcaagaagagcgaaactctgtctcaggaaaaaaaaaagaaaagaaaaaggtgactagcgtccaccccccttcccctcctaatgctctcagtgaattagaagagagaagcaaactgcttctgcaatatttttgcagttttaagtgggattcgttaatgaatatgtgcacattggaaaaattaaaacaacactgaaaataaacagactggggtaaatatttccaacaaactcaatgtaatagcagtcaggttattatctacattctgtagatgacttcattcaaggcttcccacattgtagcagcaggaattggagcaatcctttgggaaagcaacttggcatttcaaacacatgtatcctttagtcctgtggtgacacacccaagacaataaaccaaaaggcagaagaggccgggtgcagtggctcacgcctgtaatcccagcactttgggaggccgaggtgggtggatcacgatgtcaggaattcaagaccatcctggccaacatggtgaaaccccgtctctactaaaaatacaaaaaaagttagctgggtgtggtggcatttgcctgtaatcccagctactcgggaggctgaggcaggaaaatctcttgaaccaggaagtcggaggttgcagtgagctgagattgcaccactgcactccagcctggcgacagagcgagactccgtctcaaaaagaaaaaaaaaaaaagaagaaaagaaaatgctgaatcacgtaaaaatgtattgaaatgttaatttattggctgggcctataatcccagcactttgggaagctaaggtgggaggatcacttgagcccaggagttcaagaccagtctgggcaacatggtcaaaccttgtttctacaaaaaataaaaacaacaattagccgggcatggtggtgtgcagagctgtcgtcccagctactcaggaggctaaggtgagaggatcgcctgagctcaagaaactgaggctgcagtgagccaagactgcacctctgcactccaccctgggccacagagtaacaccctttttcaaaaaaaaagttaccattttctgtaataggaaaataagaggagcatcctaaatatccagccataggtgactggcttagtgtgaacagtccttaactaagtggactggtctttatagtctttatgtggaaaatgtgaaagactctttaggacaaaataccaagtggaaagaacaggaatatacagtcgtgtccatgtgatgatttaactctgtagaagttgtggatctgcgtgattctgcattgggagggatgaaagaaatgaaaagccatttgacaaggtgatagcaacctaaacaaacaggcttttaaagaaaaggatgtttatttgggatagagcattgcagtgaaaatacatgccacatgccatagtagactgtgtggatattcgcatattcagggaggtaaaggaaggcaagggttttgtttttttttttttttttgagacggaggcttgctctgtcacccaggctggagtgcaatggcacaatctcggctcactgcaacctccacctctcaggtccaagcgattctcctgcttcagcctcccgagtagctgggattacaggcgcccaccaccacatctggctaatttttttttttttgtatttttagtaaagttggggtttcaccatgttggccaagctggtctagaactcctgacctcaggtgatctacccgcctctgccttccaaagtgctgggattacaggcgtgagccactgagccccgcctggcaaaggtttttaaaggaaaaaaacataattgttttgagataatgatccttggttgcaaagatcaataacaagattaatgtccgtccaaggttagacaggcagttgctgggcagattatccttgcagaagtttctgtgtgcgtgtaaggttgtcatagcctttgtgcaaggttgcagttttgtgtgtgtgtaaggttgtcatagcctttgtgcaaggttgcagtttcgtgtgtgtgtgtaaggttgtcatagcctttgtgcaaggttgcagttttgtatgtgtgtaaggttgtcatagcctttgttgcagtttttgccatctttagtgacagtttttgttatcaggcatggaagtatgagaatcctctcttcatagctttccccagctctatttgtcaggttttttggtttgtttgtataaccctaatggctccatttttattctgacaaattcctttttttttttgagacggagtcttgctctgtcagccaggctgaagtgcaatggcgcagtctaggggctcactgcaacctccgcctcccaggttcaagcgattctcctgcctcagcctcccgagtagctggggttacaggcatgtgccatcacacctggctaatttttgtatttttagtagagatggggtttcaccatgttggtcaggctggtgtcaaacccctgacctcttgatctgcccgcctcggcctcccaaagtgctgggattacagctgtgagccaccacgcctggctattctgacaattttcacaatggaaacaatttagggcacttgtgtacggttggctgggcaacccacccgccacaggcccagctgccactctggcctgagacatgcatcttaagagtgatttgggtggctggcacagtggctcacgcctgtaatcccagcactctgggaggctgaggcaggcagatcacctgaggtcaggagttcgagaccagcctgacccatatgatgaaaccccatctctactaaaaaatacaaaaattaggccagacgcggtggctcacgcctgtaatcccagcactttcggaggccaaggcgggtggatcacctgaggttgggagtttgagaccagcctgaccaacacggagaaacccagtctctactaaaaatacaaaattagccgggcgtggtggcgcatgcctgtagtcccagctactcgggaggctgaggcaggagaattgcttgaacccaggaggcggacactccagcctgggcaacaagagggaaactctgtctcaggaaaaaaaaaaaaaaaagaaatacaaaaattagctgggcacggtggcatgcacctgtaatcccagctactcaggaggctgagacaggagaatcacttgaacccgggaggcagaggttgcagtgagccgagatcgcgccattccactgcagcctgggcaacaagagtgaaactccgtctcaaaaaaaaaaaaaaaaaaagtgatttggctcagagataagtgcttatttgccttgggattaaccaggatgaaacctgtcaacctgtggttgggttacgtttcctgttctctaagtctacatttcctcattttttagcatctgaaagcaggtgaatttccccagcctgattttccagatgactacaatttgggagacattttcctaggagtggagtatatcttccatcagtgtaaagaaaatgaagattacaatgacgtcctgactgtaagcggggatgctgaaatcatataacctggctcatggaacatgggccttgcaaaggggtcaagatcacaaccctgcatccatgtgtgtccgtgggtaccgtaagggctactgggggaagaacctgtaagcagggtgtgaggagcacccaggctgggtagggactgcatgccccatgccacagttgaaggagggagagaacacgctgtgaaaacacagaagctcccagagaagccttctcagcttttatctctggagtagagcagactatgttgagctaacacagacctgctgaatcagcttctttctgagctgccagaagtacagaagttggagcctccaccaccttccagatctgtttctcctcagtgtaatccacctatgggttcttcctgcccactgcacagacaaaaccaattcactgcaattgtggtattgcagtagagaaagagtttaacacagagctagccaagcagaaaggctggagttattattcaactcaatctcccagagaactcagaggctacagtttctacaggcaatttggcaggcaggggctagggaatgcctgctgctgatcggctgcagacggaccatggggtgtcaacgatttttgtcccctgagtccgcctctgcgtggagccacgggatcagctgagtcatgagtctcaggtccaggtggagtctgtaggttgccagaactcaaaagtctgaaaaacatcccaaaagaccattcttaggttgtactattgacgttatcttattggggagcaattggggcggtcacaaatctcgtgacctctggctgcgtgagtcctgagcagtagggaattacagcagggcaagctggggaagcaaggcctgcgggctggttctcctcaggacacctacatctgagcagaattcaggcccctcccatcatcctaatcttgtggcccttcacaagcttcacagaggtggcttcggtcttgagcaaggaggggattcgttttagggagggatgattactattcttgatttaaagttaaactctagattaaattcctcccgtggttagcttggcctgtgcccgggactgagtggggacagccacgcaagttaaactctagattaaattcctcccgcggttagcctgacccgtgcccgggactcagtggggacagccacgcaagttaaactctagattaaattcctcccgcggttagcctgacccgtgcccgggactcagtggggacagccacgcaagttagactctagattaaattcctcccgcggttagcctgacccgtgcccgggactcagtggagtcagccacacaagttaaactctagattaaattcctcccgcggttagcctgacccgtgcccgggactcagtggagtcagccacgcaagttaaactctagattaaattcctcccgcggttagcctgacccgtgcccgggactcagtggggacagccacacaagttagactctagattaaattcctcccgcggttagcctgacccgtgcccgggactcagtggggacagccacacaagttaaactctagattaaattcctcccgcggttagcctgacctgtgcccgggactcagtggggacagccacgcaagttaaactctagattaaattcctcccgcggttagcctgacccgtgcccgggactcagtggagtcagccacacaagttaaactctagattaaattcctcccgcggttagcctgacccgtgcccgggactcagtggggacagccacgcaagttaaactctagattaaattcctcccgcggttagcctgacccgtgcccgggactcagtggggacagccacacaagttaaactctagattaaattcctcccgcggttagcctgacccgtgcccgggactcagtggagtcagccacgcaagttagactctagattaaattcctcccgcggttagcctgacccgtgcccgggactcagtggagtcagccacacaagttagactctagattaaattcctcccgcggttagcctgacccgtgcccgggactcagtggggacagccacacaagttagactctagattaaattcctcccgcggttagcctgacccgtgcccgggactcagtggagtcagccacgcaagttagactctagattaaattcctcccgcggttagcctgacccgtgcccgggactcagtggggacagccacgcaagttagactctagattaaattcctcccgcggttagcctgacccgtgcccgggactcagtggagtcagccacgcaagttagactctagattaaattcctcccgcggttagcctgacccatgcccgggactcagtggggacagccacgcaagttagactctagattaaattcctcccgcggttagcctgacccgtgcccgggactcagtggggacagccacacaagttagactctagattaaattcctcccgcggttagcctgacccgtgcccgggactcagtggagtcagccacgcaagttagactctagattaaattcctcccgcggttagcctgacccgtgcccgggactcagtggagtcagccacacaagttagactctagattaaattcctcccgcggttagcctgacccgtgcccgggactcagtggagtcagccacacaagttaaactctagattaaattcctcccgcggttagcctgacctgtgcccgggactcagtggagtcagccacacaagttaaactctagattaaattcctcccgcggttagcctgacccgtgcccgggactcagtggagtcagccacgcaagttagactctagattaaattcctcccgcggttagcctgacccgtgcccgggactcagtggagtcagccacgcaagttaaactctagattaaattcctcccgcggttagcctgacccgtgcccgggactcagtggggacagccacacaagttaaactctagattaaattcctcccgcggttagcctgacccgtgcccgggactcagtggggacagccacgcaagttagactctagattaaattcctcccgcggttagcctgacccgtgcccgggactcagtggagtcagccacacaagttaaactctagattaaattcctcccgcggttagcctgacccgtgcccgggactcagtggggacagccacgcaagttagactctagattaaattcctcccgcggttagcctgacccgtgcccgggactcagtggagtcagccaccccagacctctctcactgttatcatttttgcacaggtggtttcagcagcttgatgccaaaaaaaaaaaaaaaaaaggaaaagcattctgaaaagccatgtatgagtgaatcatacttaacttggcctcctttggctgcacagccatgccctgaatcgcccttgtggatccaagtgcatctgtgtggcttgaggcagagcttcccagccagacccagtgtgaaaggatgggacggccacacaggaacctgggccccaactgctccctccagacctgggtgggacttgcccgccatgcacaccctgctggggaagagggagtttctgagagtgacaggaagtggcccagccggagattcagccctgggatctctgtggccagcaactgtgggcgggggggtatgtggacatctgcttccattttccccaaacctaagattctgttccctggtcttcccctggcatttcttcctcgggcccagagccctctccttggggctccctattaccctgaggggagggccagcccaccagcccaggaccccatcctcatagccacaggccaggccagctctgctcagggctggctctcagctgcactctccatctaccctgccttgtcctccatgtctccaggcacctcccgccagccccaaggatacccacctcccagacctccctcttccctccacccaaaccccaggggagtgctacccctatggcccatgtggctccataaacccccttggtgctgtgcctgctcagggtccacaggccctccctcctcttcctcctcctcctcctcttcccccagctctgggctccatccgggtgcccctcccctgtgggctttaatccagccctctctccagggggacatggcgactgtgggtcttcctgactcaccagcagctgcacctccctccgcctccgccttcatacctctcccgcactccctgtgctgcctgtgccccaaagctctacccagagtgttcagtaaaatcaggggccaccggaggccccatcctgactgggggttggacctggggtgtgggctgtgcgcttgcctcgtccctcttagggcagggaggccacccctggccggtgccccactgccccaccaccccgtggcacccacccctccccacttcttcatattccatccccccttgcccattgctcctgcggctgggcagttccatcctgggggcccctccccagcacagtgctggcccagacagcaatccacgttgactaaagactctcaaaggggcttgcttgctttccattttagatggaagggaactgaagctgagtgcctgtaattcctgcccaggggtctcacagcaaccctggggtcctgcagccacataccaagagcagcctgtggccctggggtggccctgaaggggcaggttcctgtggggtcatcctctgagccggtttaaaattattctgacaggtgacggccacccacggactctgtcacttgctgggattcacacacggcacggaggcagagtggcagcaggtaaggagcccatccatcccactaccgagggggtgcgtgggggaaggaggctcccccaggcccctgccagcccccaccctccatcttgaccgcccccgcaggaactggacctcagacctgcccttgtaaaaatgacacagatgtttgctttcaacaccgggctccccaaatacttccagctgaatgtgttcactaaggaaagcggtctgagtgcagaggccgagagccacagctgacactagcacgtggcgcttggtcaaaaaggtccaatcagctagagactaggccagacccagggcggaggcgggagctctgcgtggagtgagttccgggttggtttcctccagacccatgcgctccgcctacggaggcccacgtgggctccggtccacatggttaacacgcacgcaagcccgtgttgggagcaaactgcttctctgaaagtcatgaaaaacctttttcattaaaaaaagaaaaagtttggccgggcgcagtggctcacgcctgtaatcccagcactttgggaggccgaggcaggcggatcaactgaggttgggagttcgcgaccagcctggccaacatggagaaaccctgtctctactaaaaatacaaaattagctgggcctggtggtgcatgcctgtaatcccagctactcaggaggctgaggcaggagaatcgcttgaacccaggaggcggaggttgtggttagccgagagatcgcgtcattgcactccagcctgggcaacaagagtgaaagtccgtctcaaaaagaaaaagaaaaagttggccaggcgcagtggctcacgcctgtaatcccagcactttgggaggccgaggagggtggatcacttgaggtcaggagttcaagaccagtctggccaacatggtgaaacccggtctctactaaaaacgcaaagattagccgggcgtggtggtgggcgcctgtaatcccagctacaggggaggctgaggcaggagaatcgcttgaacccgggaggtggaggttgcagtgagccctcctcccctcctcccccttcccttcccacctcccatgcccccctttcttcctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggaggcgaccccagagagtggggcgcggacaccttccctggggagggccagcgcgcttccttccttccagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttcacgttgcatcgggtatttttcgttattgtaaataaaacggttccgagccgtggcatcgagagggcgtctggagttcagggaacgcgtggcccccgcccgggagcaccgcgcagcgctcgcctctcgcccttcaagggggtccctgcccggagcctgcgcccccggagaggaaggggctcgaggggcttgggtgccgcagcgcgtccttccgtagaaaaggcttgcgtcagtatttcctgcttttacctcctgagtattggaatattcgagtaaaccctggagtttcagcgccagcgcacgcctcttcatcagggcagcgcgtcgcgagcgcgctggttccccggggcctcccggccacggacaccgctctagccagggccacggcgaggccgccgagcagcacctcagagacctgcgtgagttctaaagcctggggctactacaattctgctcatctgtttgtcctgtgaaatgattcagggacatgaaaatgccttcccactgacttgcgtcctgtcttagcctggacttgtccccttgggaacacgggccaggcccctctgttcctgaagtcgctgcaccaccgcgcccttcggtgaagagcgttctgtttactgtgagacatagcttcatgtcgaaaaagtactcgtgaaaacagaaaatggagtcagctttaatccaagcttttttttttttgagacggagtctcgctctgtcgcccaggctggagtgcagtggtgcgatctcggctcactacaggctccgcccgccggggttcacgccattctcctgcttcatcctcccgagtagctgggactacaggcgcccgccacctcgcccggctaattttttgtatttttagtagagacggggtttcactgtgttagccaggatggtctccatctcctgacctcgtgatccgcccacctcggcctcccaaagtgctgggattacaggcgtgagccaccacgcccggcctgttttgttattttgaggtagggtctggctctgttgcccaggctggagtgcagtggtgcagtctcggctcactgtaacctctgcctcctgggctcaagccattctcctgcctcagcctcccgagcagctgggactacaagtgcgcaccactacgcccagctaatttttgtttctgtagagacagggtttcgctgtgttgaccaggctgggcttgaactcctgacctcaagtaatctgcccgcctcagcctcccaaagtgctgggatcacaggtgtgagccacacaccgtgtccggcccaatcctgtatttctttctttctttttttttttttttttggagtgattctcctgcctgagcctcccaggtagcttgtactacatgtgtgtgccaccacacctggctaatttttgtatttcttagtagagacagggtttcaccatgttggccgggcaggtctcaaattcctgacctcaagtgattgatccgcctaggcctcccaaagtgctgacattataggtgtgagccgctgtgcctggccccaaccctttgtttctttagggaatgtgagcaaatgcccttctgacctgaatctgaggaagagccgcccgtggcccaggcagcagcagcatcacctgttgcagggtagtttcctgctctaggaacctggtagttaggagtgggggctcacaggtcaccactgcccagcctgtccccagccatactgccctgattctggaccctcttgcaagccagagtgtcgtcagagcaggtccgtcctcatccttctgctcccagagtcacccggcccttcacgttctgtgtggttccagattcagctcctcacatgccaggaagaatgtggtatcttgactggagttgcattgaatctgcagatctgccaaccctgtggaggctctgacccatgcatatgtgctgccttggtccctgggtcatcttcaacctctctcagtgagtgtcacccaacttatcaggtgtacaggtgtgcacaatgtgccctgagccccccccaccacaggcaaggaggtgtggccatgagaagcccccactcctaactaccaggtaccaggcacccagaccccaaaacccctgccaagtagcccaagcccattttcagggcctgctctgagctcttcagcctacccaggtggaccaagggggaccaagggggactgtgtatgggggtgagctcatcccctgccccaccctcaggtgtgaccccacccctcctgcaggccagtcaaggctaagccagtgcagctgtgccctcaccagacactctggatgccagagcctttcatccctgtgaacccagcaagaccaggccatccaaagaccaccacttcctgtgacatttcttccctctgttgtatgaaaaattctgttgagaaatatttaataggctgggcgcggtggctcaacgcctgtaatcccagcactttgggaggccgaggcaggtggatcacgaggtcaggaaatcaagaccatcctggctaacacagtgaaaccccgtctctactaaaaatacaaaaaattagctgggtgtggtggcgggcacctgtagtcccagctacacgggaggctgaggcaggagaatggcatgaacctgggaggcggagcttgcagtgagccgagatcgctccattgcactccagcctgggcgacaagagcaaaactctgtctcaaaaaaaaacatttttaatagaaagaaagaaatgccatgctggaaagtcaccttgaaaagaggaaatggagtctgagctttggtttgagcttttaacgagagcacagagtctctggaatcaccttcaagaggcacgaaaagatggttctgagagaagtgagtgttactgccagtagctgcgctgggcccttcggtgttcacacctgcccgtccatgtcagcaccaggtggctgtccctggggagctctgcagctcagtggcaactctctggtcatcctgtctcctacctgcaaactttcaaagatggaagcactgggacagggttcctccttgtgcggaacttcaggaatgaaagaatctgtcctaatagggggtgaatgaaagtttatgtatactacttaaaaatatgtaaacaacattaaaagagcaaagaaacataattgcacccaaaaaaaaaagtaacaaaaagtaaagaaaagaaatagtcaaggtagcctgtccacatggtaagaaaccccacagcacagaaggaaactgaactgaggggagtgagccgcccttccactgcccagcactcacctttgctttacaggaacaagagctgtgcaaaccagcatgtagagatttctgcatttatagcattagcactctcccttttttttttttattaactcaaaagggatcacgtcatacacagcttgcttctttcacttttttattttatttttgagacaggggcctgctctgtggtccaggctatagtgcagtggttccatcagagctcactgcagcttctaactcctgggctcaagcaatcctcccacctcagcccccagagctgctgagataacaggcgcatatcaccacacctggctagttttttaaatttattttttgtagagacggggtcttgctatgtgacccaggctggtctcgaattcctgagctcaagtgatcctcctgcctcagcctcttaaagtgctgggattacaggcatgagccatgcacccctacttctttagtgggagtctgtgccacagctgtggacacaggtgtccctagttattaaattagactttgtggtattttccccatcaggatgttcacacttccatgtggctaaagctattgatcttttctgttctggctcctgagctgagattttcttaaactctttctggatgaaatctttatttcatcaggctggtggcgtccacggcctcaactttacctccgtgatggaagagggggatctgaggctcccaggtgggccggcgccgccctacaggaaaggaggggtccctgggaggggctgttgccctggtggggttcacaggcccctcactgcaggggacccggagcaagggatgccccctggaatggccccgtgaccagaaagcgagcctgcccagcttccccaggaggagcctgcagtccacactcgcgtagccactccgggtggtggcagggtctctccctgctcccttccatagtcccgccacagcccacagccctgaggaagcctgggggtggagggtgccccggccagggtctctgtgactcacactcagggtgggccaggcgtccacaggctgggggcgggctggaggacagtggcagccccaggtggccacacagcatggtggtggtggtggtggtggtgcacggcaggcagccttggcctggcagctcgtgggaccctcgggggcacatgtggcgggtcctgccacagacgcacctgctgcttaggacgcagcccaggctgctccccacctccactcccgccctgttcctaactggggctggatcccatgtgataggcaggatggcagggtctaagcatcctcccagaggaggctcctcccccgccccaaattgtgcaacccattcctcatctgggctgggactcgatggggatgggggcttcacagccagactgtagacctgagccaggaatgccctttcagagctacacagatgcagaaatttccagaagaaaaaccacccaggccctgtttccttggcctagggttctgctgggggctaagcctacctgcagggctgggggcagggccttgagcatccagttctgcaggaccaactggtgcacctgtgcgttctgcagcagcagcagctccaccatgtctgcagggaagaagcagggggaccctgaataaagtttccgtttttcctatttgttaaagtgatagagcattataggaccagagaacaggtgtgtctgtacactgtgcaggtccccggggcaggctctgagtccgtctgcacacggtgcgggtccccggggcgcgccctgagcccgtctgcacacggtgcgggtccccggggcgcgccctgagcccgtctgcacacggtgcgggtccccggggcgcgccctgagcccgtctgcacacggtgcgggtccccggggcgcgccctgagcccgtctgcacacggtgcgggtccccggggcgcgccctgagcccgtctgcacacggtgcgggtccccggggcgcgccctgagcccgtctgtacacggtgcgggtccccggggcgcgccctgagtctctactaaaaatacaaaaattagccaggcgtggtggttcaagcctgtaatcccagctccttgggaggctgaggcatgagaatcgcttgaactcaagaggcagagcttgcggtgagccaagatcgtgccactgtactccagcctgggcaaccagggcgaaactccgtctcaagaaaaaaaaaaaattaaaacatctaagccagttgtagtggtgcatgcctgtagtcccagctactcaggaggctgaggcaggaggatcacttgagcccaggagttcgaggctgtagtgagccatgatcatgcccctgcactctagcctgggtaacagagcaagatactatctccccagaaaataaataataaaatatctgttcatctacagacaccatgaagagagtgaaaaggcaaccacaagaaggatggaacactcaaaatgcacatatcaaaaaagggctcattacagaaattataaagaatccctagaaaccaataagggaggcaggcaacctgaaagaaaaatgggcaaattacttaaatggacactttacaaaaaaggatattcaagtagccaataaggccaggcacggtggctcatgcctgtgatgctcgcactttgggagaccgagacaggagaagtccttgagaccaggagctgacaccagtcatagcaagacctcatctctacacacacacacacacacacacacacacaaaatatatatatatatatatatatatatatatatatatatttttttttttttttttttttttggagacagagtcttgctctgtcgccgaggctggagtgcagtggtgcgatctcgactcactgcaagctccgcctcctgggttcacgccattctcctgcctcagcctcctgagtagctgggactacaggtgcccgccactgcgcccggctaattttttgtattttttgtagagatggggtttcaccgtgttagccaggatggtctcgatctcctgacctcatgatccacctgccttggcttcccaaagtgctggttttttttttttttttttttttttgagacggagtctcactgtgtcacccaggctggagtgcagtggtgcaatcttggctcactgcaagctctgcctcccaggttcatgccattctcccaccttagcctcctgagtagctgggactacaagcacccgccaccacgcccggctaattttgtttttgtatttttagtagagatggggtttcactgtgttagccaggatggtctggaactcctgacctcatgatctgcccgcctcggcctcccaaagtgatgggattacaggcgtgagccactgcgcctgccctacacaaaatttttcaaattagttgactgtgcctgtagtcccagctacttgggaggctgaggtgggaggagtgcttgagcccagaagttgaggctgcagcgaggtatgattgcaccactgcactccagcctgggcaatggagtgagaccctgtctcttagaaaaaaaaaaacctcaaaaaacaaaaacaaatggccaataaatatatgaaaaagtgaaatgcaaattaaaccagaatgaacttccataagatgcccaccacgctggcaaaaatgaaaagtgtgaaaatgccaagtgttggtgaagtgctctggcgactgaaattctcattcatgtatgtggagtgtaaatgggcacaaaccttttgagagactgtgtggctgtatttcctgacacagccatttctgtcctaggcatgcgttccattagagggcaaaaaggactgtgcagatgtaagcctggaatcttgagcggggacggaagcaacccaagtgtacatcagtagatagataaatggaggcagaaatgtggtctatccatacaatggactgttactcatctgtgacctgctgcaatgtgggtgatccttgaggacatcacactaagcgaaataagccagtcacacaaagacaaatactgtgtggctccactcacaggacacagcgaacacagtcagactcatagaaacagaacacaggacggtggttgccaggcactggcaggtggggatgatgtagtcacacaaagacagatactgtacggctccattcatctgacacatcgaacacagtcaaactcgtagaaacagaacagaggaaggtggttgccaggcactgacgggagggggtgacgtagtccgacgggtggagtctgagatttgcaagataaaaatgttctgcggcacagcagtgactacagttaacgctactgaactttgcacttaagtggtcacaatggtaaagttacatggttttttttttttttaatcacaaattaatcttttttttttttttttttttgagacagggtctcactctgttgcccaagctgggacgccttggtgtgaacacagctcactgcagcatggacctcctgggctcaagggatccccccatctcatcctcccaagtagctgggaccacaggcacatgccaccatacccaactaattttgatatgttttgtagagaagaggtctcaatatgttgcccaggctggtcttgaactcctaggctcaagtgatcctcccatatcagtctcccaaagtgctgggattacagatatgagccactgtgccatgctgtaaattaacttttaaaaaaagaatcttggccgggcgcggtggctcacgcctgtaatcccagaactttgggaggctgaggtgggcggatcatgaggttagaagatcgagaccatcctggctaacacggtgaaaccccgtctctactaaaaatacaaaaaaaaattagccgggcctggtggcgggcacatgtagacccagctactcggaaggctgaggcaggagaatggcgtgaacctggggggcagagcttgcagtgagctgagattgcgccactgcactccagcctggcagacagcgagactccgtctcaaaaaaaaaaagaaaagaatcttgagtgctgggtgctataatcccagctacttgggaggctgaggtgggaggatcgcttgaggccaggagttttggacctgccttaggtgatatagcaacactgtgactcaaaaaaaaaaaaaaaagactcatgagatgggaatataatcctggattatctgggcaagcccagtgcaatcacagggtccttagaaagtggtgagataaaatgactgtcaatctagatttgaatatgcagcaaaacttgcatttaaaaataaaggtagggccgggcatggtggctcacgcctgtaatcccagcactttgggaggctgaggagggtggatcatgaggttcaagaccatctggccaacatggtgaaaccccgtctcaactaaaaatacaaaaattagctgggcatggtggcacacgcctgtagtcccagctacttgggaggctgaggtaggagaatcgcttcaacctaggaggcggaggttgcattgagctgagatcatgccactgcactccagcctggcaacagagcgacactcccatctcgaaaaaaaaaatcttttatgaattcctttagaacagttatacaaactccctcagtatctactttcctgcaaatgttttttatttccatttatttatgtatttatttagagacagggtttcactctcttgcccagactgcagtacagtggcacagtcacagctcactgcagcctccacctcctgggttcaagtgatccttccacctcagcctcccaagtagctaggaccacaggcatgcacctaacacttggcaaatttttgtatttttttgtagagatggagtttccccatgttgcccaggctggtctggaactcctgagctcaagcaatcctcccacctcggcctcccaaaatgctgggattacaggtgtgagccgctgtgcccggcctccccttatttttatttattttttttaagacagagtcttggtctgtcacccaggctggagtgcagtggcgtgatctcagctcactgcagcctccgcctcccaggctcaagcaattctcctgcctcaacctcccaagtaactgggattacaggcgcccaccaccacacctggctgatttttgtatttttagtagacacgggatttcaccatgttggccaggctggtctcgaactcctgacctcaggtgatccagcctctttagcctcccaaagtgctgggattacaggtgtgagccgctgcgcccagccaagattgcatcttgctatgttgcccaggctggtctcaagctcctaggctcaagcgatcttcctgcttcagcctcccaaagtgctgggatgacaggcatgagccactgtgctggccgttaaccactgattttaaatgctgcattttctctcatatggcatacaagcataggcacacactcacccattcacacacacccctacctcggtatgctttttagaacctatggcatacaagcataggcacacacacacccacacacacacccctacctcagtgtgctttttagcacctgacagactatcactaaacttcatctggaaaaatcgacaggtaataaggaaagacaggactacccttctttatgatggcacaagctatgctctctgccactccaggggctcctcatatggatcacaataggaaaggtatcccctggatgtgggttacatggccgtcctgggccagatctggcttggattgcaatatatgatagagctacagtaattaaccaagtcagcacaggggttgggataggcaggtcactgggacagatttgaggacagctgtcaggtgattcagccattctacacacgtctgcccctagactaccaattccattagtcattagggcaatgcaaatcaaagccacaatcaaccaccactgcatcctgttaaaatggataaaatgagaaagactgaccataccacatgttgccaaggttgtaaataactagaactcacaaacattactagtgagaatattaaatgctgcagacactagataacagtttggcagtttcttttttttcttttttgagacagagtctcgctctgtcacccaggctggagtacaaaggcacgatttctgctcactgcagcctccacctcctgggttcaagtgattctcctacctcagcctcccgagcagctgggactacaggcatgtgccaccgcacctgctgatttaacttttaagaaactgctgcccaggcgcggtggctcacgcccataatcccagcactttgggaggccgaagggggcagatcacgaggtcaggagttcgagaccagcctggccaacatggagaaaccccgtctctactaaaaatacaaaaatcagccgggcgtggtggcacatgcctgtaatcccagctgctcgggaggctgaggcaggagaattgtttgaacccgggaggcagaggccgcggtgagccgggatcacgacactgcactccagcctgggcaaaagagtgagactccatctcaaaaaaaaagagttaaatctcatatgattcagacatttcacttctaggtatttacccaagagaaatgaaagcatacatccacagaaagactgaggcaggaatgtccacgacagctttgttggccataagcgaaaacaagaagcaacccaaatgttcattactgtggttggaacttaatcctcaatgtggcagtattgagaggtggggcctctcattgctatggttggaacttaatcctcaatgtggcagtattgagaggtggggcctgtaaggggtacttggatcatgagggctctgcctttatgaatggattaatgcatacatgagataatggattaatgatttcatgggttaatgtgttatcatgggaggagaaatggtggctttataataagaggaagagtgacctgagctagccatcagcacactcagcccccttgccacgtgatgcctccagactctgcagagtccccaacagcaagaaggctctcaccagatgtgcccccgaaccttgcactccccagtctctataactgtaagaaatgaatttcttttctctataaattacccagatttggccaggcgcagtggctcacgcctgtaatcctagtactttgggaggctgaggtgggtggatcacctgaggtcaggagttcgagaccagtctggccaacatggcgaaatcccgtctctactaaaaatgcaaaaattaaccgaaggccaggcctggtggctcacgcctgtaatcccaatactttaggaggccgaggcaggcagatcatctgaggtcaggaatttgataccagcctggtcaacatggtgaaaccccgtctctactaaaaaccacaaaaattagccaggcatggtggcaggcgcctgtaatcccagctacttgggaggctgaggcaggagaatcgcttgaacccggtgggcagaggttgaagtgagccgagattgcgccacttcactcaagcctgggcaaaagagcaagactccgtctcaaaaaaaaaaaaaaaaattactcagtttcagatattctgagcaacagaaaatggactaagacatccaccaacaggtgaatgcataacaaactgatatattcacacaatgcaatactactcagcaattagaaggaaccatttattgatacacccaacgacagtgatgaatcttaaaacagtcatgctgagagaagccatacaaaaaaagagtacatactgtgtagaccatttctacaaaaatctagaaaatgcaggccaggcatggtggcccacgcctataatcccagcactttgggaggctgaggtgggtggatcatgaggtcaggagttcaagaccagcctggccaagatggtgaaaccccgtctctattaaaaatacaaaaaattagcagggcgtggtggcgggtacctgtaatccccagctactccagaggctgaggcagagaattgcttaaacctggaggggcagaggttgcagtgagccgagatcacgccactgcactccagcctaggcgacaggcaagactctgtctcaaaaataaaataaaataaaataaaataatctagaaaattcaaactactacatagtgacggaaagctgctcagcagttgcatgggggtgtaggaggagggattaaaaagaaacacgaggaaactttggaggtgatggatatgctcagtcttgattgtagtgatataagtatatgttatatgtatatgttaaaacttgtcaagccaggtgtggtggctcacacctgtaatcccagcactttgggaggccaaggcgggtggattgcctgaggtcaggagttcgagaccagcctggccaacatagtgaaacccctgtctctaccaaaaatacaacaaaatagctgggcatggtggtgggcaccagtaatcccagctactcgagaggctgaggcaggagaattgcttgaacccaggaggtggaggttgcagtgagccaagatggcgccattgcactcctatctgtgcaacaagagcgagactgtctcagaacaaaaaaaataaaaataaaaaaaaaaaacaaaacttgtcaaattgggccgggcacagtggcaaacgcctataatcccagcactttgagaggctgaggtgggcggatcacctgaggttgggagttcaagaccagcctggccaaaatggcgaaaacccacctctactgaaaatacaaaaattagcaaagcatggtggtgcaggcctacagttccagccacttgggaggctgaggcaggagaagtcgcttgaacccaggaggcagaggttgcaatgagctgagatcatgccattgtattccagcctgggcaacaaagtaagacactctctctctctctctctaaataaataaataaataaattttaaaaatcaagtatttaaaagctattattattattattatttttgagacagagtctcactctgtcgcccaggatggagtaaagttgtgcattcttggctcacactgcaacctccgcctcccaggttcaagcaatttctcctgcctcagcctcccaagtagctgggattacaggcatccatcaccatggtgagctggtttttgtatttttagtagagatggggtttcaccctgtgggccaggctggtctcgaactcttgacctcaggtaatccacccgcctcagcctcccagtgttgggattacaagcgtgagccaccgagccgggccctaaaaattattttaaaagaagcatcttaataatggtttttgaatggatgatgattggatgagttggaattggagcccaattattttacctcctagttatctttcttatacctcttgtttccttccctgtgagatatcatttatataaggatttcttaaagttaaaattattttcatgttgaacagccaaaagctggccctaagtgactgtcctgcttccaggaacattttccctttcagtagataatttcctcaacccacaacaatatgaatatggaacacttaccttccttaatacttcctgaccgttgagtagggaaggcctggggaggaggaatctgtgctatgagtggctgctgagggagctgctgaatgatggtggcaggaggctgggggacctaggaacagccaggtgattagctatctgcatatgtccttgaagaaagtgtctccagtatctaccacccatccatccacccacccatccaaccaaccaaccaaccaaccatccacccatccatccaaccaaccaaccaaccaaccaaccatccacccatccatccaaccaaccatccacccactcatccatccacccatccatccacccacccatccatccaaccagccaaccaaccattcatccacccacccatccacccatccaaccaaccacccacccatctatccacctacccatccatccaaccagccaaccatccaaccagccaaccaaccattcatccacccacccatccatccaaccaaccaaccatccacccacccatccatccacccacccacccacccatccatccacccatccacccatccacccacccatccatccacccatccacccatccacctacccaaccaaccaaccaaccaaccacccacccatccatccacccacccatccatccaaccagccaaccatctacctacacatccattcatccatccaaggagaactttaaatgattaaccccagacactgaataaatggttgaatggaaaggtacttcagtctagatatcacttaggatgtagtatttttaatgtttcccacatttcctgtctttagcggggtgggctgaggcctggttccaccaattctgctttaataggagcaaccaacacttggtatggtgtttttgtttttttttgagacaaagtcttgctcttgtcgcccaggctggagtgcaatggtacaacctcagctcactgcaacctccgcctcccaggttctagcgattctcatgcctcagcctcccgagtagctgggattacaggcgcctgccaccacgcccggctaatttttgtgtttttagtatagacggggtttcaccacgttggccaggctggtctcgaactcctgacctcaggagagccacccatccaaccaaccaacagtgtccaggcaggggaaatgcagtagcggttggccaccttggcctcccaaagtgctgggattacaggcatgagccaccatgcccggcctggtcagtctttttaattgtagccactttaatagagatgcagtggtggctcacagtggctttaatttgcatttccctaatgacggatggtgttgagcatctggggcagacccgtgggtaggatggccgcatcccaacaggcgttctcaattctgtcccagtgacctctctatcccagcccccataacaacttggttaattactgtcctccatcatatactgtagtacatatatagaacacgtcatgaaaatgaactttggtttctcctctgagtgaaaataaattatagccaaatattcgagcatgaaaggccttctgttttatcctcttctagctgtgtgaggctgcctggccttgtcccttcttcctcagttcacagaaaggacggcagagaccaagagttggcaaacttttgccaagagctacatcgtaaacagcttccaaagcaggacacaccgtcagctcttgagttggccattgcagcatgaaagcagctacggacaatgtggaaacaaatgggcctggcccaataaaactttatttatgaacactaaaattagcatttcatataattttcatatgttgcaaaatattattattgtattggcttttccccaaacatgtaaaaatgtaaaaccattcttggcttgcaggttgtgtgagaataggaggcaggccagctccggtctgaagctgtggtttgcccacccctggcacagacccatgaggctttcttagagctgccgtgcccgtcctggctgatgggacctcctacctcaggggctctgagtccagctgccaggaagctcatcttagtgacccacagcccctgctcacccacctggtgtcactggggctgagagtgaaacctgcaggcataactggccctgatggatacacagtaagcatagatgtgtttgggatgaggaagatggggggtccacagcaatgaccccccgtactcccttctgtcctgggaggaggtttctggtgctggaagacaggaaggcacaggctgggaatatccagaacctggtgaaggccacccatctgcagaggagggtctggggcaggtccttcggaggctccccttccctctgtaccctccaccatgtgctgctgccagggtcccctcccaaagggcaaaagccttccaggtcatagactctgctgccctgtctagaaattcccacctcagcctcttctcttccaccttccctgcaccccagtcacacgaatcccaccaaagccttgacctccgggcccccagcttccatcccacctctgggtgcctggtttccctctgatccattttttgcttcagaaagtcagagttgttttctgctgcctgccacccagaaggctgaacagctgtaggaagctctcagaagtggagcactatttacctttaacattctgcccttgacattggggccttaagcatctcctgggcatgataaagttttttttttgagatggagtcttgtaatctcctctttctgggctcaagcgattctcctgcctcagcctcctgagtagctgggactacaggcatgcaccaccacgcccagctaatttttgtatttttagtagagacaggatttcaccaagttgcccaggctggtctcaaactcctgacctcaggtgatccgcccgcctcggcctcccaaagtgctgggagtagagatgtgagccaccgcacccggccagtgataaagttctgaggagttgacacacttccccaaattcagggccgcccgctgagctctcctgatacttctgcccctaatgcaacatttaaggccagggctggggtttgggagacagagctgggccccagccttcctctgtgatgaggggtaagcagtccggggaggcccaggcagtgcccaggcaggcagctggcccccttcaagggtgggccttgggaggatgggggtgacgaggcaacctcgctgcaggcacagcgcctcctgccttctgtaaaatcttaattccgcacccgcctcccactctcagatgtgctcctcgacttcgccctcttaccgtaggcaggatgatccttggcgggtctggggccagcggggatggggaggcagtgggtaggatgcccgtggggggcagctctgggggcagggctgacccgagggctcctctgcttggcccgctccaggcctgggcccgagagagctcgtccaggaggtgttgttcctgcaaggccgatgcagagctgctgcacacggggacggggagccccaacgccacagaggcacccccagcatcaggctcaggccagcctgggccaggtacaggcgcctctccgggcaggatggccatgactggaagacccttccagggttatgtgcatgagggtggcctcctgaaattgacccaagcgtgtcagctagtttccagttgttttctttttccagccccagggtctgttctctctttcaagccagttccaggcctacttttttctaggtctccccctagaaaagcggccccacctcccctgcatctctgccactcggatgcatctttggtgagtgccgtgggagcaaacctccaggcatcccagaatttcaggtcctcctggaattgggcccttactcaacatttccagtcctgatggaaacctgcacccaggcaggtctctaagctaacagtgtccttgctggggcctggccctgagagtctggaaaggtcttccctaatactccccgacctggtgccttaaggctgagcagctatctctgctacagtgagctcagccaggttcgctcagagggtgcagggcctacccggagtctctgcagaaggtccctccttctcttcagagcagtctgcagggcatcgtccggccggtcctcatttcctggagggaagaacctgcttgcttaccaaggaacgcgtagaggctgtcgctgcaagcactcggactggatggtactgcacccatgtcggaaggccctgcctcacccacactcccaggatgggggaggcctgggaggatcctggtcttaggttatcccagataaagagggaccagtgttgggtaaggagggcaaggggcagcatcaggggaggggtaatccagggaactcagtgctggaggatggtcatctcattcctggaagggaggctgaaatgacgcgaccaggttcctcctgagtgcatttcatacagagtgccctgggctccaggaggtcaagggctctacagggctggctgcagcctgaccttggccacctggagccaccctctggccccaagtggtctagagtctggtctgatccccaagtatctgcacatccctcaagtctgccccctagtccgggcgtggtggctcatgcctgtcatctcaacagtgggaggttgcactgggaggattgcttgatcccaggaggtcgggggtgcagtgaattgtgatcaggccactgcactccatcctgggcaacagagcgagaccaaccctgtctcaggaataaaaaaaaaaaatctggccaggtgcagtgagtcacacctataatctcagcactttaggaggccgaggtgggtggattacttcaggccgggagtttgagacgagcctggcgaacatggcaaaaccccttctctactaaaaatacaaaagttggccaggcatggtggagcgcacctgtaatctcagctactcgggaggctgaggcacaagaattgtttgaacctcagaggcggaggttgcagtgatctgagattgcaccactgcactccagcctgggcaatagagtgagactccatctcaaaaaaaagaaaaagtctacattccttgggggagggtctacactcaagagaaggctccggaaggtggggggcagggttctggcctcctttcccttaggcacaggggtcctgcccctcacccagcatcacactggagaggggccgttgggaaccctagccagcccttgggggggtccccaaaccctctgccccaggcactggtagccattctattccctcgcactggctctgcagtcaggggacctggtttgggattttctctctgtatttgagactgggctctgcccttggcagctgagcccccacagctcacagcttgccccacgttccaaagaacaagaaatgctcctctggcctcctcagcttctccctggacgtccccgggtaacagtgaggacagcagctcctccccaaccaatggacaagctcagggtctggaaccagagcaactgggtctgatctgggtgcgaccactgccagggtgagcaacctctctgcctccattttctcatctgcaaaatgggaacaatgaaggtgcccctttttggggtttgcagactaaaggtgataaggaatgggggtgtcttcaactctgaatgtaaaggaaaagcgttgaggacaatctcgccggtaccaggagtgggggtgattcccagagttgctgtccccacctccccctggaggtggctccccctggagtggctacacttgcgtctgtctgtgctggttccaagcagcccaggggctctcacctggctcgaggtggaggccctcaggtcccccttccacgttctgccgttcttgctccagcttctgtgaggaagagagaccgtgacagagacggtggctccacgcaaaggccctgtgtgctccaggaatgactaagaggctttctgagtgaaaagaatggtacgtcaggagtaacccagcctctccagggccaacaggcgggagtcaagcccctccgaggatctccctgagctgcctctgtaagcctgacctctagcaaattcatgtgttccatccacaagtctaggggcggatgctctgagtggtcccttcaggcagatttctgaagagcaaccctgggagacacctcactggtgaggcctccaggcttcccagccagtgcatgcctagatcaccccccacctgaaccctgagctgagcagctacctgctgggtgtgtccaggggtgagtccctctcatggcggcctgtgggccaggatgcagggctggcgaaaggtgggcagcaggtccctcaggcagcaggagagggaacaatgcaggcagggggtgcagaggtgcccccaggcaccgaggctccccagaccctgtgctcagtggcctgcgaggacaggcaggtcggtcatgggccacccagaccctcagagaatgtgaagactaagtctgaggatgggtccgctgggctgccagccccaggcctagcccttggggccctgcattctgcacctgcagggctgtctcgaagagtccctccaacgccacagcctgcgagttgttaaaaacaggagcatcccgggctctgcctcacctgtcccaagagcttcagcgtcagtcgggtcacttgctctgctgctgatgagtccagcatggtgggagctgcaggagacgactgtaggggcaggggaggccacagcccacctccctccctggttctgttactcgcaggaaagaactgctcagcaggagcccaagcaccggtgttgcctgcagggcgggccttacctcctggagaccagcctgagggaagagaagagccctgtgggaagatagccacaccctccctggactgcagtgccccagaagccagcgctgggcgccgcgtgacagttgccaggctgccagacacagggaggccccaggttgccaggtttccactgtgcgtcctcaggctaccggtaaacactcatccccaggtgtggccagctgggcttcatgggaaggcaaaaaagtgggcagcagctgaggcagaggggcagaaccctcagacctgggggaagggcagtcgtgaccccctatgcaccaccagcctcaggacccagtccagaagaacctgtgtgtcaggggagggcgccccacctgtgtactgcctccagggtgttaatacctccctcctagggaccctcagagcaagcagggaagacagggtggggagacactgggaggacagggtgaggagactgcctaccaaggagttcaggaaattgcaggcagcagaaggggtaggacagaggaggggttgtgacctgcagaggggctgggctttagcaggaccagagggggtgcccaggggatatgtcccaccttggggctgggggcactgggcagggagtcaagtttgcaggaagcttcgcagagggtgacgcaaaacaggagcgtggtctgcacttggttgggcattaaactccacgttgatgagttagtcaatcccactagcaggcagactgacatgtgggggatgtcagcagcaggggcccagacctgtggacccgaggggcagaggtcagcaccctcctcggtgcagctaacccaggaacttgcctcagtggccaaaattgctctcttgccctcagttctgtaaatggcccatgtccatcagtatctatggttgtgtgcctgtcctgtcttccaacccacatccatgtagggaccctgaagctggaccagtgagtgattgggtgaaggctggctagcccgtaggaggtcaggctcacagaggcagctcatggagatccttggaggggcgcaccttactcctgctggccctggaggggctggattactcctgacgtagagttcaactcaccttaccctggaggccatccaaccagaaatgaagtcagcatgaaaccaggccttaccctccctccagatctgtggagggtgtgggctagggtcacatgacctgcctggtgccacacattcccagatggcagtcaggggtcctcgctggtgctgctggacatgagcagactctggccccatgtttaagatcccagtgccattgggcgttggctcacgcctgtaatctcagtgctttgggaggccaaggcagaaggatcacttgagtccacgagttggagaccagccggcacaacacaacaagaccccatctctataaaaaataataaaaaagggccaggtgcggtggctcatgcctgtaatcccagcacttagggaggctgaggcaggcagatcacgaggtcaggaggtcgagacaacctggccaacatggtgaaaccccgtctctactaaaaatacaaaaaattagccaggcgtcgtggtaggcgcctgtaatcccagctactcgggaggctgaggcaggagaattgcttgaaatcggaaggcagagtttgcagtgacccaagattgcgccacagcactccagcctgggcaacaagagcaaaacctccgtctggaaaaaaaataaaaaaaataaaaaaataaataaacaagataataaaagaacctggctcttgtccacagtcattaacagtgacagtcttgggagacatttaaacagctctgagtgtgcacagaacaaaaaccaggttaatttagttaagcaactgtatagagcacccttgatataagtgacctcatctgagaaaaggactccatcttatgtatttttttttgagatggagttttgctcgttgcccaggctggagtgcagaggtggagccatctcagctcactgcaacctccgcctcccgggttcaagtgattctcctgcctcagcctcccgagtagctgggagtacaggtgcacgccaccacgcccagttaatctttgtatttttggtagagatggggtttcaccatgttggccagactggtctcgaactcctgacctcaagtgatctgccgtcttggcctcccaaagtgctaggattagaggtgtgagccatagcacctggcccctgatgccttttaaattataagatagggccaggcaggcggaagttgcagtgagccaaggtggcaccactactgcactccatcctgggcaacaagagtgtaactccacctcaaaaaaaaaaaaaaaaaaaaaaaaagggtatcaggccaacagggaccagatgtttcctcatcagtagatactgcacccacccagataaagacataaacaagacactcttactatcagtccttaccagagtactctatggccatgaaaagagcagaacaccaccaggtcaaagtggccgttttacagacagtcttgctgtcacttgtgagaagccctccacatctgctgctgcaggctctgcccacatcagagatgcttccttgccagattctccttttcgttgaactggttaactttttttcctctcctctttctcttgatgtggaatgtttataacatttatgcagtggtcaagtatactattatgtatggtttgtaatactgactgacttaaggagagacttgagcctgtgtgcccacagctgtgactgccaagtgaatgggaagcactaagaattgcctcctcgggatctctagtagtatacataacatgctccagagggcatggatttgtcagactttttttttaaatagggtttttaagaacagttttagatttagagtaattgagaagatagtacatggagatcccacataccacatgtgtggcttcccctcttattaacatcttaccttagtgtgctacatatgttatatatatatatattttttttgagacagagtctcgctgcgacgcccaggctagagtgcaatggtgcaatcttggctcactgcaacctctgcttcccagtttcaagcgattcttctgcctcagcctctcgagtagctgggactacaggtacgtgccatcatgcccagctaatttttgagtgaaagccagtgcacctggcccatttgttatgattaatgaaccaatattgagacacaagtaactgaagtccacactttgacagtttccttaggtttgcctcatgtccctaatgtggtatccatcagaacaccccattacattgagttatgtgtctttaggctccttctcagactttcctcgtttttgatgaccttgacagtttcgaagagtactgggcagatattttgaagaatgtccctcaattaaaatgtgtctattatctcctggttagactgggactgcaggttacagaaaggaagcatctaggggtgaagtgccactgtcaccccatcacatcagggacacacactgtcacctcgactataactgtgaggctgacctgcgtcacttggctgaggtggagtctgccagttttctccacaataaagtggctctttccctccttttctttattgcactctttgggaggaagtggctatgtgtggtctacacttaaggagaggggagttacgtttccctccttgagggtgagtatctacaaaatttatctgggcagcttttttttttttttttttttgagttagggtctcagtctgtcacccaggttggagtgcagtggttgcctggccttgacagctttttaatagtttaaaatgaattgaggctgggcgaggttgctcatgcctgtaactccagcactttgagaggccaaggcaggtggatcacttgagcccaggagttcaagaccagcctgggcaacacagtgagaccctgtgtctactaaaaatacaaaaattagctgggcatggtggtgtgcctgtaattccagctgctcaggaggctgacatggagaatcacctgagcccggggaagttgaggctgcaatgagcggtggtctcaccactgcactctagcctgtgtgacagactgagaccctgcctataaaaaagaaaagaaaaaagaactgaaataagacccaagtccaacattagcagaacctctctaggatgtccacagaaacgactctggggttctgaggaacacagtctaggcaaacctgggcacatcccctcagtcccacagttgtaaatgtattgtaacacgtaacagttgtgagattcaggcgcggtctgggtctctgttcctggaaagtgtgatcctgtgggtgcagcccctgctcgcttggctgtgttgcctgcctggcccctgctctaatgagcccactgcccagagtttgctcaaaccacccaattccgagtctgggaaccaggagaccgctggacaccccgctcaccacacagaagactgtggcctgagtcaggagaaggaagtttctggcggtcgagcttccacggcttcctgagggaggttgcagggagccgagatcgcgccattgcgctatagcctgggcgtcgcagcgagactgtctcaaaaaaagaaaaaaaattctgagcgagattccagggcttcctgagggcgcgtttaagttgcagttgctgaggaggctgcaaggtgagcttgcgtcagcgaggagccactccagcacgctcgggaagggcatcgttactgctgcaaacaagcacacggccctccacgacgaaccttttgcaagtgaaggcgcacgaacaggcccggaggactacaaagaaacccagaaaccagacttggacacatgaaataaaggggttagctgaaggaatactccacagttaaggacggcctgcgcgaggtcaccggccctgtcttggttttttgccacttcgctccagttagtttcccaagttccacctacgcgcgcgccagctgagaaaacgcccaccccggcggtcccgccacaggtcacaggcggtgcggaccccgggactgtgtccgggcttcggtgtccagagagctccaagacacccaaaccttccgtggtttccacctctgcaagcttatgttccgctgagctcaagctgagggacgacgacctcatgcgacgtcagtttccccctgggaccacgaacccacggccccatttctcttctgtctactaaaaaccttttcttttcttttttttttgagacctaagacatcagtgagacacacgagcagacacgggctcggtcgggaaaggcgggagctccaagcggcggggcctgcaggtccaggcggttcgcgggctttctgaccgcattcggccgagttcttctctgaagacccaggacccccggccgagggggcgcattcggcgggctggtggcgtaggattttgtttcgggttcccagggtcccggcaagggtgagggagcccttgcggatcccctgagatccacctcagcagcctcctccgtggtaggcctcaacttcccgcggcggcccacagccaacgactaatgcctgagcgggagaaaacggcctggccctgtccgggtggttgctgagcaccgttcggcgccgcccgcgcctgcagggagcccggcccgctgtcctggtggacacaaagcccaggggccgcccgcgcgggaccagcagcgcgaactttttgccgctcggccagcctggcaggggattttaaaatcggccaatcacagcgggcgccaggcctccgctttccgcttactggtcctgccgtaggaggcgggtacgtgagcgcaccaatctgtggccggcgagcgtaaagggcggggctccgcccaggctgcaccgcccagagcgcgcgtgcgcgagaccggaaacgcagccccctgattggcggcgcgtgtcgggggcggggccgcggctgcgtgacagttgtcgcggggggagggcgagcccaagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaaggtaaacattaggggcttcttctctagctgctctggcgtgaagtcctaagggcggctccggtgcccgccaccgccccctgccaggagaggacgcggtccggcggaagccgccgcggaggtctcgctttttcccgccggctccgctggaagccgcctcctggccgccgccatcttgaatccgccgctctccgccaggtcccgcccccgccgcggccacagccaatcagcggccgggacgcgcggcgcctctcgggcgggccggggcggggctgcgcctgcgtcggggggggtggggcgcgggctgggcgcggtgcacgccggggcggggtgtggctgcagggcggggctacaggggcgtggcgtggctgcacggagggggtggggcgcggcaggcgctggaccccaggctggatcttccagtggctcccgcgtcctccgggaccgggtggcctggggcgggcggccggtattcgggtggctgcttggtctagggccagtttcctgcgcggccggggccgggggcgtggcgcgggtggcctgcagcgcctccccagggtgcgccttcgcctcgtccgtcggagatgctttccccgcgcgtttctcgcggcgttgcagtccttactgtgtgaaaggcccccgcggcgctcccggccgccgtcttcttcccgcgcccttgggctcgcgtcctgcccgtccgggcctggcgtacgctgccgggaacccacgcggcgctggcgccgggcgccttcaagggacgcgctcccgtctttctcccgccccgggtttctccgtgaaaaagcgctcggtttgatggccactgtcctaggtttcgtgggaataaagcgcgcagagcccatgactcgggggcaggagaaagggagtcccgaaagcgcgaggcggaaccgcgggagcaggccggcctctgcgaggtgcgcgccgctcccccccaggatgttctggctggggtgctggggaagagcggggctcccgggcacggcggacaggggacgcggggctaggccggggaagggctgaggcgggcaggaggggaaggggagcccggagcctgcagggagctgcgaacaggagcagagctcccaggagggtggaggggggagggagggacaagacgccgcctgtagggcgacgcaggccgcagaccaggtctgtgctatatcccgacatggataggtgtggtggaggaggacatgaaaataaacgacatgaggttgactttgaaggaaatatttccttgagagaccattttcttgtgtaaatggccttgtgtaatttttctgggtccatgagcttgtgtacttgtgttatcatttacacaaatgtgtgttccatgcgtttgtttttgtggccacagttgtcttttgagggaacagatgtctccccgtgaaaggctgatgtgggatcgatcgcatacctcttgagtaagacgttagcgggagatgaggctcgcacatagtctcaaactctcggatttgaggactgagcagagctaggctgtgccttctgatgggcgatgctctgtggatgtccctggtgctttggtgagctgtgtcatgaaaaatagaacatctgattccataaaggaagatgtgagattgacctggcttaattaattttttgctatttctgtatcttgtctcagaatctatggctaggaagttttggctgggctatatatttcttcagttgggggaaaattggggcaagaagggagagatttagcttttatatcattttaaaacttaaatatgccttgattaagctatcaatcttttatacaaattttttttaaagttttatttttctgtaaactgccaagggctaggaaagctattctgccaatcagccgtatggttttctttaccaggcataattagcagtcctcattgttagaccccttggatatagatattgatgaaggcagtgtttgtggagagccatctgttggccaggtgtggcagagtagactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcaggtagatttgctcaatgttgtatttgaacatttcgcttatcttctagtgatttctagtgtgatttactaaagatggtctttggtctgtttttgcctttcaaaagtgaggaaagagggtgttattttagtttataaaaagtgagggccgggtgcagtggcttacgcctgtaatccccgcactttgggaggccgaggcaggcggatcacctgaggtcaggagttccagaccagcctggccaacatggagaaaccctgtctatactaaaaatacaaaaattagccggacatctggcgcacacctgtaatcccagctactcgggaggttgagggaggagaatagcttcaacttgtgaggcagaggttgcattgagccgagatcacgccaatgcactccagactgggtgacagagcgagactctctctcaaaaaaaaaaaaacagtgagtaaatttttatggttttattctttttattttattttttatttttttgagatggattctcgctctgtctcccaggctggagtgcagtggcgcgatctcggctcactgcaagctccgcctcccgggttcatgccattctcctgcctcagcctcccaagtagctgggactacaggcgcccgccaccacgcccggctagtttttgtatttttaatagaggtggggtttcactgtgttagccaggatggtctcaatctcctgacctcgtgatctgcccgcctcggcctcccaaagtgctgggattataggcatgagccaccgtgcccggcctatggttttattcttaataaatttgggttttctttttctttttttttcttttgtttgttccagacagtgttttgctgtgttgcccagcctggagtgcagtggtgtgatcacaggtcactgcagcctcaaacccctgggctcaagtgatcctccctcctcagcctcttaaagtgttgggattataggcatgagccactgcgcctggccctgttttatctttattatgtaattttgagaagttttggattaactacttgaagacaagtgtcagttgtttgctttgtaatggaagactgggagttcttcgtgtgtggtcgtgtcagcccctttgatgggtgtttcttgggacatttaaaacataatattccttcacatagttgtaaatgcacctgcttgtcacatttgtcttttacctttttactaaacgtgagatgaagagggaaggggtgaaggtgttgcagacatggtgtgttgctggaggagactgggtctgctgcttgaggccttgtgagctgcaggggcacccccatgggcaggtgtggcaggtgagtgcacactgagtcctgaaggggctggccttccgggctccttgggggcctacaaacctgcctggaggcgggctgtccttgggccttttgtatgaattatgaacgagggccttaggtgttgagtgtccctgctgctgcagcagaatgggtgcaggctttgatgtttgctaggatttgctggaaaactggtggccaaaggcagaatctggctcaaggtcataatgtatgtatcctgctttacttaaaaaattgagttgttggcaacagttaaaatttgtgttattctacctacaaatcctgaattttgctttttatctcttgagtgtttttggttgttgggttggtgtgttttttttttttttcccgttttctttttaagatacagtctctctgttgcccaggctggagcgcagtgacgcgaactctgctcagtgcaacctctgcctcccaggctgaagcgatcttcctgcctcaggctcccaaagtgccaggattacaggatttctgccaccttgctgggcagaaagttacttttgatatattctggttgcatatgttttttggttttttttgaaatggagtctcactcttttgcccaggctggagtgcagtggtgcagtcctggctcactgtaacctctgcctcctgggttcaagcgattttcctgcgtcagcctcccgtgtagctgggattgcaggcgcctgccaccaaacccagctaatttttgtatttttagtagagacagggtttcaccatgttggtcaggctggtcttcaactcctgacctcaagcaatccacccaccttggcctcccaaagtgctgggattacaggcgtgagccactgcacccggccctctggttgcacatactttttttttttctttaaggcgaagtctcactctgtcatccaggctggagtgcagcggcacgccctctgcttcctgcaacctctgcctcccgatttcaagcgtttctcctgcatcagcctcccgagtagctgggattacaagtgggcaccaccatggccggctaatttttgtatttgtttggttgagatggggtttcaccacattggccaggctggtctcgaactcctgacctcgtgatccacctgcctcggcctcccaaagtgtggggattacaggcgtgagccactgtgcctggcctgcatagacgttttaaaagtagtaagctgataaatatatgtgggaatctcaggatcctatcagaaaaccattccaaacttagcacattttgtggtaaattgtatttggagactgatgggtcgttaacattagaaggcatggtatagactcctgattaaacactcatactttgctgtttcatcaggtagagactctcttagtttctaactctgctatttgatgcatgccttcattcaggaagatgatctgatgaaaagcattttgatttttgttttcaaaaccagaagggcatataccagaaaattaacagtggtggtcagaaaggaatagagttgttggttttttcgttgttatggtttttggtatttcctacaataaacacattaggttacttatataacattttttttcattttagaattaactataccactaataaaacatgtattttggacatcttaaagcaatctataaataacaggcccattactggtccccttgacttagagatgcacacgcacactcactgcacttgctgcattttgtgtcacctcctcgtgaccacagtggacaggacacttcaccctcaagcgtggggtggtgtggcagatgtgaggagaggtctgctttcacaaaacttggtgaaacaatggcaagatggccaaggtaaagcattctgttacttataactgttgctgtgagtagtaacttaactgtttaaagcagtattttaaaaaccaaaagctggtaaaatgtaaggatactttctctaggaaaagtatgtgctcctgcagccaggattcttcatggaatgaaggcatggcagggcctgactgattttcatctcacatcgtcatcctgaactcctctgcacagttacagcttgacatcagcagagacatacctcctcttcctgtccattggctctaaaatggtgggcaaaggtcaggtaccagtcagctttttccacagaattcctgacattttaataagctaaacatgcagtcatcaggtattaacccctattggatcttggacatcagctttttcccccttttttttgagatagggtcttgttttcttgaccaggctggagtgcagtggcgcaatcatggctcattccagccttgacctcctggcctcaagtgaccctcctgcctcagcctccctagtacctgggactacaggcatgtgccaccatacctggctaacttaaaaaaaaatttgtagagacagtgttacactgtgttgtcagggctggtctcaaactcctgtgctcaagtaattctcccacctcggcctcccaaagtgctggaattataggtgtgagccatcccacctggctaaaatttattttctttatacatgtataggtaaactaagtagtatgtgtagaatagagccattgtctttctgctgtacactaagttaggaatcaaatttcttaagccattttgtcaattatgtatataaaaaccattggtgctttagaagcagatatttcattaacttttttctgattatatcattgtacatcatcagttcagtctaaaaaggagtttttttcatatgtattataaaatatttcatgatatttgagtttagtatgcctttaatccagttgtagatgttaaaataggagtaattttgtgttcaaaataatgatcttctgaaaagtgaaattctaggaaagagtccactgtttaaagctagcagctggtggccgtgtggccgaataatgtcccaggccagggcactcccctctcagatggttggtcatgctgcgtcggagatcaggaatcctcaaggaacctttatgttatagttgtaccagtgctttaaacataatgaaaggtgcatttgttttattttacccatctataaattgtgagaggtttggctatggagagtctagtgagcttattgaacagcataagaagataagtgtgtgtgtttgtgtgtgtgtgagagtgtgtgtatgtgtgtgtgagggggagggagaagttattgtgctttccaacatataataaattgcttactttgatcactaactgttaggtaaatactgatgatttctagcataagtcttttttcttttttttggagacaggtcctccctctggcgcccaggctggagtgcagtggcccaatcagcttacttcagccttgacctccctgactcaggtgatcctcccacctcggcctcccaaagtgctgggattacaggcataagccgctgtgcccagctgatataagacatatttttaaccaactttaagatcttagttttttttcaggatggttataagcgaaggtagaattgcagaaagactttgtggtaaatattcaggattcggctctgttgccttacaatttgttaagtgcatgatggaaaaatagttgaaacaatgcaacagctgtctcagttctgaaagttaactcagaaatggcagaaagcaaggtcaggcatggtggctccgagcactttgggaggccaacgtgggaggatggttgaaactctgtctctatgaaaaatataaaaattagctgggcatgacagtgcacacgtgtagtcccagttactcaggaggctgagttgggaggatcacctgcgcccaggagtttgaggctacagtgagctatggtggcaccactgcacgccagcctgggcggcagagcaaggccttgtctcaaaaaaaaaaaaatcataaaaataaagcaatggtagaaagcagaatttgacctttcagttacagatgaggaacaaagtgaggagaggccattttttggtaaaagaaccatctggcgggacgcattggctcatgcctgtaatcccagcactttgggaggccaaggcaggaagatcacctgaggtcaggagttcgagaccagcctggccaacgtggtgaaaccccatctctactaaaaatacaaaaattagccgggtctcatggcaggcgcctgtaatcccaggtactcgggaggctgaggcaggagaatcacttgaacccgggaggcagaggttgcactgagccgagatcgcgccattgcactccagcctggaggacaagagcgagactttatctccaaaaaaaagagaaccatccaaaaattgctcagaggtcaagaatttcagaagaaaatacaaaaactttggctgaagaagatttaactagtgctatagaaggcttaagaagtgtggttctagcacttttccaactcatatttgtatcaaataccaggaaaaatagttatcaccatttatcatctagatttctgggccgttttactgttttgtcattttaagttgttttacacgtaatttacagaagtaagaataaagcaataatttaaaacaactttataagaaatttgatccaacctctttgtatcaagtaagttttgacacacaaacattagaagtgtcctcttaaggaagtggatggtccaggttcctttgaagtgtgatcattcatgtgagcgggcagctgattgagactactgtgtccccttttcgtccctcacttcctcttgattctgagaagattgatctagggtattgtcaaatgaagacttgtctgagattttattttcacgtcagttttgccatcatcattggccatgggtgctctctctctgcattcatcttgtgactcatctaatgatcccgaaaagtcgacactgtcatgtttctttgctattttgggaagaaattgaaatgttcttagtgaatcatcttgttaaagcaagctaatctgggcactgtggctcatgcctgtattgccagcattttgggatgctgaggtgggaggattgcttgagcccaggattttgaggccagctttggaacataatgaacagagaccctgtctctacaaaaaaataaaaaataagctgggcacagtggcgcatgccagtagttccagctactcaggtggctgaggcaggaggatcacttgagcccaggaggttaaggttgcagtgagctgggattgcaccactgcacgccagcctgggtgacagagcaagaccttgtctcaaaaaattaattaaatttcttttttaaagtagaattcatggccgggcgcagtgactcacacctgtaatcccagcactttgggaggccgagttgggcagatcacaaggtcaagagattgagaccatcctggtcaacatggtgaaaccccgattctactaaaaatacaaaaattagctgggcatggtggcacgcgcctgtagtcccagctactcaggaggctgaggcaggagaatggcgtgaacccgggaggcagagcttacagtgagctgagattgtgccactgcactccagcctgggtgacagagtgagacttcgtctcaaaaaagacaaaaaagaaaaaaaaaattagccgggcgtggtggcatgcgcctgtagtcccagctactcgggaggctgaggcaggagaattgtttgaacccggaggcggaggttgcagtgagccgaggtcatgccaccagcctgggcgacggagtgaaactttgtctcaaaaaaaaaaaaaaattacaggctgggcacggttactcacacctgtaatcccagcacttggggaggccgaggcgggtggatcacctgaggtcaggagttcaagaccagtctggccaacatggtgaaacccccgggaggttgagacaggagaatcacttgaacccaggaggtggaggtttcagtgagccgagttcgtgcaactgcattgcagcctggcaacagagcaagactccgtctcaaaaaaaaaaaaaaaagtagaattcattaagaagaggggcaggaacatcattagggaaattacttgcattataaaaatgtttagagctggccaggtgtggtggctcatgcctgtaatcccagcactttgggaggccaaggcgggcggatcacgaggtcaggagatcaagaccatcttggctaacatggtgaaaccctgtctctactaaaaatacaaaaattagctgggcgtggtggcgggcacccatagtcccagctactagggaggctgaggcaggggaatggcgtgaacccaggaggcggagattgcagtgagctgagattgtgccactgcactccagcctgggcgacagagcaagactccgtctcaaaaaaaaaaaaaaaaatgtttagagcttgggaattgttaatgcggaaggtgcacgttctgaacaggtggaagtgagctctacttgttaaatgaagtcagcacaggcctgcagatagaggagctgggaagggcctgaggctgcagccctagaccttgctttaaatgcttctttctggtcctccccttcttagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacagtcagtgaccacccaccagaacagcatgggatgttcacagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggtattctttaagttctctgttaaggtgtattctttgtcaaaagatttctttatgttgtagaaatccaaaccagtgagaggaccttccatctctgcagggcctctctttagaagtggaaactggaagcatagagagctggaggcagaggctcaccctgtaggccccacgtgctgccgcctgcacgttcttagtgttgcctgtgaatgggaagcctctcttcatacccttctccctgagctcaaatctgcctcccttgtgatcttccttttttgtttttcccatgggacattgaagagaagccacccttcataagtttgaggaatgtcatgaattccctttattctagttgcccttgtcgattgactcacctgtctgttcagcctgtttcttaggcctggtacctcgtttctcacatcatcagtttgtgactggaagtcctgtgccagttgagagcctggcagggcagggaggctgtggtcagtctgcatgtccctggtttctgccacgttcctggtgggatgaattccatacgtgttgagttgattacctttattttattgacatgttttttgttagcatgtggaggaaaacattaagtttggaattgactacttttgaagtgttatgttaaaagcatatattttaggctgggcacggtggctcacgcctgtaatcccagcactttgggaggccgaggtgggcggatcacgaggtcaggaattttagaccagcctggccaatatggtgaaacccctctctactaaaaatacaaaattagctgggtgccactgcacttcagcctgggagacagaccgagattccatctcacaaaaaaaaaagcctctattttagccatttgattctagctagactcagttcacactgctttaggcaagtttggttgttttttggtttttggggttttttttttttttttaaatagagacggagtcttgctctattgcccaggctggtggtgcgatcttggcttactgtaacctccgcctcctgggttcaagcgattctcctgcctcagcctcccaagtagctgtgattataagcacccaccaccatgcctggctaattattgtatttttagtagagacagggtttcctcatgttggtcaggctggtgctgacctcaagtgatctgctcgtctcagcctcctgaagtgttgggattacaggcgtaagccactgcacttggccggcaaattgtttgttttttgagatggagttttgctcttgcccaggctggagtgcagtggcgcgatctcggctcactgcaacctccgcctcccaggttcaagtggttcttctgcctcagcctcccaagtagctgggattacaggagcatgccaccacgcctggctaatttttatatttttagtagagaaggggtttcatcatattggtcagactggtctcgaactcctgacctcaggtgatcctcctgccttggcctccccaagtgctgggattacaggcgtgagccactatgcaggccaagtttagtttttaatctgcattattgcaggaaagatctaactcctaggtgaggcctggaagcacagtctctggtgggttctataaaacccactcttcatttatttattgacttcttgggaccgggtctcattctgtcccctgggctggagtatggtggtgccatcacagcttagtgtagcctcaacattttgattcttaagttgttgcagctctgtccgtggggagccccttcaggtggctcctgtgtcatgtgtttgaagcacatcctggcttgtgacactgcaagttggtgccgcaggctcatcgtgtaggccctgtctccgttctgagtccgctgtttctccaaggagtcttggtgccttttactagattatggtgttgagaccaagacctgggctctaggtgtgctcactcctgctgggatgttgctgctgcttctgggctctctccgtggacagagtgaggaagggtgtgcctgggagctagtctgtgtgtacactcatagctgtatttatgttcatttgtatttatagacatatatgttaaataggaatacatactgatacctcagagcctaatccagcaccacagagttcattctgccctcccccccaggtttatttgcagtttccttctcggatagtgagaagcctggctctcacttctgccatttatttactttaaaaaaaaaaattagaaggttgttttttttgtttgtttgtttgtttgtttgtttttttgagacagtctcgctctgttgcccaggctggagtgcagtggcaggatctcggcttgctgcagcctctgcctcctgggctcaagtgattctcctgcctcagcctctctagtagctgcgattacaagtgctgccaccatgcctggctaattggggtttcaccatgttggtcaggctggtctccaactcctgacctcagatgatccacccgcctcaaccccccaaagtgctgggattacaggtgtgggccaccacgcccggccccatttatttacttatttgttcaactctcctgtaagtgtataatagtttcagaattagcaacccacatcatataagaaacaaatttaccaagtggatttaagtgtttgtttacagctcctttgtctccattttcagtttccagtcacaactgttttccaaggttactcaggtcactcctctcttccccagcccttcactaaggttgtgtcttcactggtgagtatgtagtcaggttcattggtcactggctacttcctatcctgggatcccacaacatcctggtcaattttttaaagttgcatactgttttgttttgttttttgagatggagtttcgctcttgttgcccaggctggagtgcagtggcgcgatctcggctctccgcaatctccgcttcccggattcaagcgattctcctacctcagcctcccgagttgctgggattacaggcatgcgccaccacgcctggctagttttgtatttttagtagagatggggtttcaccatgttggtcaggctgatcttgaactcccaacctcaggtgatccgcccccacctcggcctcccaaagtgctaggattacaggcatgagccaccgcgcagactgttttttttgagacagtgtcttgctctgttgtccaggctgtagtgcagcggtacaatcttggctcactacagccttgaactcctaggcttaggcagtcctcccacctcagcctcccaagtagctgggattacaggcacgttccaccacacctggctaagttttgtttttatttttttgtagagacagggtctcactgtgttgacaggactggtcttgaactcttgggctcaagtgatcctcctgcctcggcctccaaaatgctgggattacaggtgtgagccacctcgcccaccctaaaatttgcatgcttctaagttcattctttgtgatgcacaattgtgtagagtcatattcaccacccagttaccctcgagaacaaccccagcccccaagagggcccgtgtcctctttctaaccagccgctctctccttccccagcctctggcaaccagtggtctgttttttgttctatggttttgccttttccagaatgttctacagatggaattctataatatgtaggcttttgggtccaggtttttaaatcacttagcaaaatgagttgaagattcatccaagctttagattgatcagtagctcattcctttttgatgctggttagtacttcattgtgtgcatggtacacagtttgtttatccactcacctggtgagggacatctttcttctagcttttttgtgaatatgaataatgaatgtgtctttttttttttttttttgagacggagttttgctcttgcactcttgtcgcccaggctggagcggtgatctcggctcactataacctctgcctcctgggctcaagcgattctcctgcttcagcctcccgagtagctgggattacaggtgtgcaccaccatgcctggctaatttttgtatttatttatttatttattttgagacagggtctctcactcgcccagcctagagtgcagtggcccattctcagctcactgcaacctctgcctcccaggctcaaggggttctcccgcctcagcctcccgagtacctgggattacaggtgcatgccactatcacttggctaatttttgtatttctagtagagacggggtttcaccatgttggccaggctggtctcgaactcctgacctcaaatgatccacccgcctcggcctcccaaagtgctgggattacaggcgtgagccaccgcacccggcctaatttttgtatttttagtagggatagttttaccatgttggccaggctgatctcgaactcatgatctcaggtgatctgctcacctcggcctcccaaagtgctgggattactggtgtgaacaactgtgcctggcctgtttttatttcccttcttgaaagcctggctggcgtagacatatagttggcagttggtgtcttgcttgccggtggtttcgctctgcccctctctagcttgtgttcactgccgtggccaccctgaaggcttttgtctttggtgttctgcagttttgattttatgtgttctttagagggacagaactaaaaggatagatagacatataaaggggagtttattaaggagcatcgagtcacataatcacaaggtgaggtcccacagtaagccatctgcaggctgaggagcaaggaagccagtctgagtccgaaagctgaagaacttggagtctgatgtttgagggcaggaagcatccagcatgggagaaagatggaggccagagggctaaccagtctagtctagtccttccacgctcttctgcctggttttattttggccacactggcagctgattagatggtggcaacccagattgagggtggatctgcctttcccagtccattgactcaaattttaatctcctttggcaacaccctcacagacacattcagggacaatactttgtatccttcaatccaatcaagttgacaatgttaactatcacaccaggtatggctttttatgatgtctttgattctgcttgggatctagggttttcttcaatgtgtggatgatgcttttctcatctgttgcctcaaatcctaaccagtatctccatcataccttctacctgttctttctctccattaagttttagagttctcttgcataccgtatttgtccattctcatgctgctaataaaggcatacccaagactgggtaattaaggaagagaggtttaatggactcacagttccacgtggctggggaggcctcacagtcatggtggaaggcaaggaggaccaagtcacatcttaggtggatggtggaaggcaaagagagagaacttgtgcagaggaactcctctttataaaaccatcggatctagtgagacttattcactctcaggagacaagcacgggaaagacccgcccccatgattcagttacctcccactgggcccctcccatgacacgtgggaattgtgggagctacaagtcaagatgagatttgggtggggacacagcccaatcatatcacatacgtatagctcagcccacttttgtgcttgccttctttttgctcttggccgtaggctggatcgttttatctgtgttatctcccatttttctaaacctctgttcatctgtatataatctgctgttaaatacgtccagagttgttaattttgttcttgctgtttttagttctatttggattctttaaaattggttgttattctgcataattttttgtttcctagagatattttcaaacttattttaactgtacatctttttttgtgagtgaattggtctccactttggcctggtatttggaggtgcagtgagcctatccactttgttttttattgagatggagtctttctctgttgcccagactggagtgtaatggtgtgatctcggctcactgcaaccttcacctcccaggttcaagtgattctcctacctcagcctcccaagtagctgggattacaggtgcccgccaccatgctgggctaatttttgtatttttttttagtagagacggggttttgccatgttggccaggctggtctcgaactcttgagacgaagtctcactctgtagcccaggctggagtgcagtggtgccatctcagctcactgcaacctctgcctcccaggttcaagagattctcatgcctcagcctcctgagtagctggaattacagacgtgtgccaccatatccggctgatttttgtatttttagtagagatgggtttccccatgttggccaggctggtcttgagctcctgacctcaagtgatctgcccaccttggcctcccaaagtgagggggttacaggcatgagtcaccgcgcctggccagcccatccactttgaatggaatgtgttgctcgggttgatttggatcactattattttgggtctgccgtgggtgccacttctcaggatctttttttggttccttgaatgttttctgttttccatatgtccgttattccgcttggagtagcacattgtctggtcttttttagtgaggtgtttgtgttacttttgtgagaagtctgtgttatggctcgtgggagtcccttcaagttcagtgccacattttcatctgatcagtcttccaaaaatatccctttccctagacacgttttaatataatttttattttttattttattttttctcacgtctagtaaggcagggaatatttttaaatttttttgtagagatgggatctcactatattgaccagggtaggctctaactgctggtctcaagccattctcctgcctcggcctcccaaagtgctgggattataggtatgagcctccacacctggcctcctggacgtgttttgttttgttttttaattttgagacggggtcttaccctgttgcccatgctgcagtaagtggcacaatcgtagcttactgcactctccacccctgggctcaagcagtctttctactcagcctcctgagtagctgggaacacaggcatgcaccaccatgcctggcaaatttttaaatattttgtagagatggagtcttgttacattcactaggctggtctcaaacttctggcctcaagtgatgctcctgctttacatgctttttacttatttttttttttttgagatggagtcccgctctgttgcccagcctcgagtgtggtgatgcaaattcggctcattgcaacctctgcctcccaggttcaagtgattctcatgcctcagcctcctgaggagctgggattataggcatgcaccgccatgcctgactaattttttatttttagtagagatggggttttgccatgttggccaggctggagtgcaatggtgcaatcttggctcactgcaacctctgcctcctaggcttaagtgattctcctgcctcagcctcctaagtagctgggattacaggcgtgcacaactgcggccagctaatttttgtatttttagtagagacagggtttcaccatgtcgcccaggctggtcttgaactcctgacctcaggtgatctgcccccctcgccctcccaaagtgctgtgattacaggcgtgagccactgtgcctggtctccatactgtatttttatagtgattgtactagtttacgttcccaccagcagtgcaaaggttttctgttttcactgcatccataccaacctggatgtgttttttatctgtttgtgtcatcaattctttcttttttttttttcttttttttttgagacggagttttgctcttgttgcccaggctggaatgcaatggcatgatctcggctcactgcaacctccgcctcccgggttcaagtgattcttctacctcagcttccagagtagttgggaatacaggcatgtgccaccacgcccagctaatttttgtatttttagtagagacggagtttcagcagatggtctcaatctcttgacctcgtgatccgcctgcctcggcctcccaaagtgctgggattgcaggtgtgagccaccgtgcgcagccagcgatttctttcagcagtgttttgtggtttcccttgtagagatttttcgcctccttggttaggaatattcctaagtattttattttattttttgcagccatcgtaaaaggtgttgagttcttcatttggttctcagcttggtcacttttggggtatagcagtgctactgatttgtgtatgttgatttcgtgtcctgaaactttactgaattcatcgatcagatgtaggagctttctggatgagtctccagggttttgtaggtaaacgatcctgtcatcagcagacagggactgtttttcctctttactgatttggatgccctctatttcttctcttgtctgattgctctggctaggactccagagcagtggtgaaagtgagcatccttgtctttttccagttctaaaatgccttcaacttctcccttttcagtataatgttggctgtgggtttgtcatgaatggcttttattgtcccttctatgccgattttgctgagggttttaatcgtaaagggatcctggattttgtcaaatgcttcttctgcatctattgagatgatcatatgatttttctttttaatgctgtttatggggtatatcacatttgttaacttgtgtgtgttgaaccttcatccctggtatgaaacccaagtgtattatcttttttatgtgctgttggattccgttagctagtattttgttgaagatttttgcatctatgttcatcagggatattggtctgtagttttctttttttgttatgtcctttcctggttttggtattagggtgatactgacttcatagaatgatttaggaaggattctttctttctctatcttttggaatagtttcagtaggattagtaccaattcttctttgaatgtctgatagaattcagctgtgaatccctctggtcctggacaatttttgttggcaatttttaaattactgtttcagtcttgctgcttgttactggtctgttcagaatttctgtttcttcctggtctaatctcgaagggatgtatatttccaggaatttatccatcgcctccaggttttctagtttgtgcacataaaggtgttcatagtggccttgagtgatctttggtatttctgtggtattggttgtaatgtctcccatttagtttccaattgagcttatttggatcttctctcttcctttcctggttaatctcactaatgatctatcagttttgtttatcttttcttttcttttctttttttttttttgagatggagtatcgctctgtcacccaggctggagtgcagtggcgcgatctctgttcactgcaagctctgccgggtctgcctcccgggttcatgccattctcctgcctcagcctcccgagtagctgggactacaggcgcctgccaccacgcccagctaatttttttgtatttttggtagagagagggtttcaccatgttggccaggatgttctcaatctcctgacctcatgatccacctgcctcagcctcccaaagtgctgggattccaggtgtgaaccaccgcgcccggcccgagctcctgacattgaagggagatgttgctgcactcatgtggccgcccaccctggggacgagtccccgcacaggcagcccttgtggagcccaccatgccgcccttccctgtccagttcctccgggggcctttctagcttttgcaactgtatcaagcctgtatctctccatccctagccagttccccagttggggcagaaaaatttagtttgggtcattttttaatcggaagtactctgtgagcaagtgggtcacctggagcccagaaaggtgcctggctgatgcaggggaagccagagaatggtcgcttccacaggcaggggatacgtcccaggcgccagtcgaggggcaggagcctgcagggagggccacagtgacggtgggctcaggatccgtgccgacgggccccctgcagcttttcttttccctttgggttattgctgctgaaaaggtttccagaggtgggaatgttgagacagggaaaggctttctgtggctcgacctgtgttgccaaaatggctgctgagaaaaaagttgaagcaactgattctgatgttggtagcatttgggtgcatttgtttcttgtgactgtggtggcactgaggattcgtaatattcttcccaacttttgctgatttagtggccatacaaggatctttaaagtttgtgtctctagattggtttacctttcatcggtacccactttttccaggcattttatgcacattttctctctgtaggcgtcatttccgcctttttcctgagagcaggttgtttgttcctcccgtggcagcactgctgtggcgtggggagagtccacagcttctgtttctgggactttattttgtttatttatttttttgaggtggagtctcgctctgttgcccaggatggagtgcagtggtgtgatctcagctcactgcaacctctgccttccaggttcaagtgatcctcctgcctcagcctcccaagtagctgggactacaggtgcccgccaccacgcctggctaatttttgtatttttagtagagatggggtttcaccatgttggccaggctggtctcgaactcctgacctcaggtaatctgcctgcctcggcctcccaaattctgggattataggcgtgagccaccatgcctggcctgtttctgggactttgactttacattgtgatttaagcgagtttaatatttttccttcttctttttttaatgagatacaattaacaagcatacgattcaccattttaaagtacagacctcagtggcacttagtacactcacagcatgtgtgagcaccatctccagtggctccagacatcatcatcaccccagaaggaagcccggtgctcgcggcagccaccccgctctcctccctcagctcctcgcagcctccaggctgctccatgtctacggatttgcagatcctgaacacttgatgtaaacggaacctcaccatacgtggccttctgtgtctgctctgtcactcagcctcacgtcttcagggctcctctgtgttgcagcctgagttggggcttcgttccttcttgtggctgaatggcagcccacgtttgttcaaccattcatccctcaggaggcatttgggttgctcccaccttctggccgttgcgagtggtgctgctgtgaacagctgcgaacggggttttgtgaggacgtgcgtcgtcagttcttgagcacatcactgtggcttctcatgtgaattctggacctacattctttgccttttttccccaggagtgtgaacaagaatgtgaacttgccattactgacctggagagcggccgtgaagatgaggctggcctgcatcagagtcaggtgacccggcggggcctgcacaggctcacagcatgggctctgttatccccacagggcacagtgggcatccgggtgggggtggggtgggcgctgccatctcctttctctgagttgtctgtttccacgttctgtgtgtggggccatcagcagggccggtggaggagacacacgtggatgctgggggtcagggggcttggtcaggtgcaggccacatgaatgacacactgacctcaggccggttgctctccctgtcagctgcgaagccccctccaggtacacacagtgccgtcatacagcgagggaattcggggtgctggtgctcagggcagtgatgcgctgtggggtcactggcagaggagctgggtggcatctcagtggcatccgggcctctgtgtcctgcccctgcttccacgggatgtctgctgtttcattttctgtgtcttccttactcattctcattcatgcttctgtgtctccctgatgcgccctggttctgaccatgggcccttatcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcaggtactgcatggctaggcgggcacgggcagcgtgtgggctcggtgtgggcattctagtgcctgttccctcttggggttgggagctggggcgccctagcaccgtctccccatctctgttctcagcaccttgcctggtgtctggcaccatgagaggggtgaacaaagggggcccttgggtttttgtggccaggagattattagagcaggtttccaggtggtctgtgataggtgcgacccagggctgaccttcacctcctctcttagatcgtcctgtgtgtctggaagtcacggtgtcctcagtttgttattaaagccaagcatcatcacagacacatcctgctagcccgtgaatgctggcacgtgtccagtgggtgccagagcctggtcgtttcctgggcagttgggtcactgaaaaggttgagatggagtggcctgagctgctttttgtttttcttgcagctgagctgaaggagaagttacaatcagaaatggagaaaaacgcccagatagtaaaggtacccgggatcgattctaaaatgcacgcctctgtgtatgttgtttttcctttctcgccaggtcccatgagaacgctcctcaccttgattcagacagaagccagtcgaggctttattagaatatgctggttgaaagtgtattgcgttctttgtttatttatatcatttgtatttgtcagaaaacttgttttgttgtttcacattgacttgcataacacaaaggcactgctcggcccctccatgctgtcttctgagtggcccccatggcctgcccctgagctgtgttctgggacacagcctctgccctcgtggatgtggcagttccctgcagtgcatggggtgtgggtgctggggtgccggggagaataccacacagggaggaggttttgggtggggtgggttgcacctgctgtgggtggcctcactggggaccacaggtagcagtgccccgtcattgccaggccctccgctagagggctgagctgtcagccatgctgagtgtggaggcccttcctgagtcaggcatctgggcagctctcaggcccttggcagacgatgggtgttagtccaggcttggggttgtgttccggtcacctgctcctctgacgcaggcagtgagacccatttctcagaacacttgggacagagcccagcccttgggtggaggttggcaaagttgccattggcccctgggacttatagggagatgtattactaacgctttgagggtgactgtgtggattaggccttgcgtgcagaggctcgtctgtttcggggtgggtggtccttgtgcagaggctggtctgtttcagggtaggtggtcctctcgctttgtgcagatgcaggtctgttttggggtggatggtccctgtgcagaggctggtctgtttcagggtgggttgtccctgtgcagaggctggtctgtttcagggtgggtggtcctcgtgtgcagatggcagtctgttttgtggtgggtggtccttgctcacttttcctcaactgcttgcctcctggatgcttctgcttttctgtcctgccagcattcaggggagagactgggtgtaaggcctgtcaggacagtttagttgggggccatgactgcccattcttttttttctttgagacagggtctcattctgcctcccaggctggagtgcagtggcacaatcacagctcactgcagtcttgacctcctgggctcaattgatcctcctgcctcagcctcccgagtagctgggactatagttgcatgccaccacatcccactaatttttgtatttttttttttgtagagatggggtctcactatgttgcccgggctggtctgtaaccctaactcctgggctcaggcgatctgcctgcctcagcctctcaaagtgctgggattagaggcatgagccacgttgcctggcctgctcagaggttttgactgtgtgatttaaatttctttagcacagataatcaactattgagtttaatttttttttcttttaaattagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgtaagtaatgaaaatgagcaagtttggagtgggactgaattttcctaggtagtactggaaggaatgtcgttcatgtcaccatgcgtcattgcgcacgtttcctaccttctaaatgctggatggccccatgcacgtgtgacacgctggtggccgtcatgggtcacaggtctctcagggtccttaaaccttcctgatctttgtttcagagatttttcttggcatgttcagttgctaaattattacaaagcagcagctttgtggttgttcacttttcatactccagggttgtgtgttccagcttgaccctcatggtgggtggcatgggtaggcgatgtcccctggtgctatcaggcatgtgaggctcaaacgaggggcccgggggcgcccaggatggggctctgggtggcagcgctctgggtgcaccattattgtcactgaggtcgctgttgaggagagtgatgtcttgtaaaccaagtgccattgctttacctttctaggggcccttaggaacctggagagtcatcatcaagcagccattgagaagttacgtgaagacctgcagtccgagcacggccggtgtttagaagacttggagttcaagttcaaagagagcgagaaagaaaaacagctggaggtgggcagcagcttcgttatttaattacttggtatattagggaagttttaacagattttggaattgggctatttcgtattgtgttatttgctaaaacttaagttctaaatttaaagagactggctgggaacagtggttcacgcctgtaactctatcactttgggaggccaaggtgggcagatcatgagctcaggagtttgagacaaaaattagccaggcatggtggtgggcatctgtaatcccagctactcgggaggctgaggcacgagaatcgcttgaacctaggaggtggaggttgcagtgagctgagatctcaccactgcactccatcctgggcaacagcgagcctccgtctcaaaagcaaataaataaaataaaatgaaataaaaaaataaatagagtgttagtggtgaataaaagtgtaaggatatagtctctgagactgatttaataattacgttcaatcttgtacttaggaatgcatgttctttgcaggcgtccctgagacagttacacaaatcgcagacactaggtaggagtgtaaggccacatcctctaaccgtgatccagtacacacgagattcctaggaaaagttaacaagcatttctttctgctgtgtgtattcaagatgcttctctaatgaagcactacaatcaaaatgttgatgtggccaggtcctcattggaggcctgacaaacctgagactcaaactgagtatcccaagaatcagttgaagaaattaaagcataaatcagagatagggttaatcgtggtgtgtgaaagatttacaaacatgagaatatggaagtagttggggtctagggtcttagggaggcctgtcctgggccccttgtgtctcccagcgggactctggtgcccacacaccctcctctcctgcagagagtccaggccggggctcactccacacccccagtctctccctggtcccttccaggctctccctccgagatgggaaagagggggctggtagcatcttctggtcctgatgcccatgattgggaaaggtaggaggagccgtttccatgaggaggacaggccagccccaggtgcagcgttgcccaggaggaaatcacgccatgctgcgctgggctgggctcttgctgattgtacagaaaagtttagtgtcacggtgtaagaggtacctgcttccttaatgtagaagtattgaaactgagagacctcctatttgggagtcttgggtactgtgggctagtaagactccctaaattccattcagcagtctgtatgtatgaccctaaaccgaagcagggaggtgcacaagatgaaactgcaccgctgcggccggcatggaacctggccgtgccacctcctcagctgagacagacctggaagttcctgagattctgaaagtgcctggccttgtggggtcagcgctgaccgatccctcttgtcacggacagagctctctcggtctctgctgtggctggctttctccgagctgcaggtttgggatgtgagcttttacccttaggatcgcagtggcagggataaaaccgcacacgtcactgctggggtgggggccttgagctcattagggtttcacctggacactttgctttttccagttagagaatcttcaagcatcatatgaagacctgaaggcacaatcacaagaagagatcaggcgcttgtggtcccagcttgattctgccaggaccagtagacaggaattgagtggtgaggaattgtattggaaaattcagatcctcaaaagctgaagctgtgtgtttttcattgttgtaacaccaagccagaatttaacaattctagcaaacacaaaaaagtggatttacctgtttgacatcctgaaggttgaggtgtctggtttgaaagtggaggtttgctttgtgggagagagccctggttttatgctaagcaagtcagtgcagcagtgacgtgcacctgtgtgtccctcaaggccaagagcaacacttgcagggggtgccttcatgtctaaggaaagcttaccagtggtgctgagcgtttgcctcggaaggacggttgagtgctgtccaagtgcgggctcacctggtgtctggggtcacagggcagtgccccacatcctgctgccaggctcctgtggccccagctctccaggccacttgctgaaggcagctctgctccaggtgtccccttatagctgagcacctctggagaccccgaccccaggccccccattccgtgtcagagaggtctttgtgcagcaggcttggatggtgcctgagggcaggggctggccaagcccaattcaggcaccggcgcccaggtccacaggacaggagggtgagccactgcgtgtctcctggcattcatgtgccgacagagccttttggcccaacttgtccttgtgggtggtgggatttgaagcaaagagcacttaggagaaagaactggagacactgccactgtcaccagggcaccaggcctggctccgcctcccagccctgcgccctgccgggaccaggtgcagctgagagcatgtcgatttatcttcctctgggggtctgtctgtcgctggaggctggagaagagagaagctgagggggccacaggcacagctgctccccgcgggctccggctctggcttggtcctctgcttgtctctgtcctgcctctcgggacccatgcagagaaccccgatttgccctctctggggtgcccgttgctggctgtcagctgctgtagagcagcgggctgtattctgaccatagtagccatggagacaagttcttttagggtccgtgttgcttctctgctgctgtgtaacaaattatcacaaacttggtggcctaaaacaacacagttgtcagcttacagaaagtccaagatggtacagctgggttttctgtccagggtcccccatagcccacatccaggtgtcagctgtcgtgtgccaacctgatgagcctgcttctgggctcgaggttggtctggatccagtttcctggggctgcaggaccatcgtctgtctccttgctggctgtgccccccacatccctgccacttcgagtgctgcttttgctcccagccctgtggctcttgccaccgcttggagagagctctccacattcaggggcgtacgagagtctaagccgtaggggtccctcatccctctccggttctgggatgggcccttttccgagttctgcccccaccacaggtaaccaggctcttgcctctcgcctggcttgttgtgggtgtcccattttaagacgattgcctgactccgttatgttgcagagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggtaagcaaagcagttccagcctcagtgagtttctgccatacaggggccaggctctgagttcaggggtagttttgttggtgatttcatgctagtaggcaccaatggccttttatacaaacacattttatggtccagatttaaaagatgacacaggcacgggcacccgagagtggcctgcatgtgtgtgtgcgagccattggtggccacactctgtccaggcctgcgtgcacatgttggtggtggacacgctcgtgtaggccagcatgtgtgtgtgtgtgcatgagtcagtgggcacgctcttgtccaggcctgcgtgtgtgtgtgttggtggcaggggcgctctcctccaggcatgtgtgtgtgttggtggcaggggcactctcctccaggtgtgtgtgtgtgtgtgtgtgtgtgtgtgtgtgtgtgagagagacagagagagagtcagtggcgggcacactttcttccagacctgcatgtccctgtgccgtgtctctggctttgtgactgccacggctccccgcacatggacattgcccgtccttgactggaagcacgaggaggcgcctctgctgtgagcagtcggtcctggggagggaatggcgcacacatggaaaaggggtacgtgtgtaaagcttttataaaatgttttcccttcaggttgtcctgtgtgggtttagaagagaaacctgagaaaggaagaaaagatcacgttgatgaactcgagcctgagcgacataaggtaattggccgcgcgctgagaagtgggggagtcctgtgctcttgaccttccagccctgcgtcttccacattatagagcctgtgtttccgtccttcccaccttgtccaggggaggaaggctgcttgcggatgctgccccgacctcactgctgctccgcggtgggcctcaccatgcactgtttgatcaggaaagggggtggccgggggagccggagcccctccctcagccctgggatgccctggctgtgggcaaggcctccaccctgcagtggggctgcattcgtcagacttgacagtggcagttcaaagggtgtgaaattgtgtctttgctttgagtccacacggagcgtctgctggcttttgtgtttcttccttgagttgcttccgtgctgcgacttctgtcacctttaacttctgtggggcaaactgtccaaacggagcttctgggatgtagactgttctgggtctgtgctgccagtgtggtgcccagcagtatgtgtggctgtggagcacttgatgtgcagcatgagcaagcccggtgtcgggctccgggggacacacgggagggcagggaggagacgcaggggcagcaccgcgtggcttgttgcacggtggaaccagtggaggggaactcggggcatctgggctcagcggccaggagccctcactctggagcagggtccctgggcctgctggaggccacagggtgtccaggcagggtggcagcgggctgtgtgccagtttgagttccctgcaaagcggaccccaacacagaatttgctgcacaagaggctatgggggaaatgccagagaagggcaagggcccggctggaacaggcagccaggaccttcccacgagcaggccttgcaccagagagaacccaggaagggctggggtgggtagccccaccaggcattcgtgtatcacctgagagccaacccctgcctctgcgcgtgggtgtgacgaggacccagctgttagtgggcagtggtcacaggaggctggccttgagagcccagccctgagatgtgaggccaccaggggagacgcgaggggcacgtgccctaccgaccttgctgctgagagaattgaggagaggtctgcccggtccagggccctgccgccctgaggagcaccagtccctgtcagtgccaccaattcttgtatgtcttccggaggcctgactgagagacgggtgtgggcgggagagcatgtgagcacgccagtgggctggcggggttcaccagggcgcagcgtgtggtctcatgaacctagtgaggtttgagttttctttgtgcatagcaggaaacacctttgagggttatagctgcgagcgaggtagcttggctcactaacgtgcttgtcccacgtggtttctctgtaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaaggtgggcccctcccgcctcgccatggtgtcggcaggtcccgggtctgggggacgttctcggggagcctgggtgcctgggttcgatccaagtcctccgtgaagcagctgagtgctccgacctcttcttctggggctgacacctcaacagagtgtgtcctgatgagggtttggcgttagaggcggggtcactggctgggcaggagtgcgtgtcctgggccagcgccccagcagggcaggtctgacctgggcagccaccctgggggtcatggggattgctggatggacatggtgaccattcacctctggagggagaatgtgtgtccactgggcccaggggaggcttttccaggatcctgctctgctcccagcaggcccaggtaccccagctcgcctagtcagactaaggttgtgggatgtccaggcagggcacggggcacagggctgtggggtcagaaggtgacggagaggaaactgcagtcatcccagagtcgcggtcccatggcgccggacagtggccactgacgggttccaggaggggcaggcggccctggccactggcgtggactgtgctgatggtggggctgccgtccatggtgggggtgaggggctgaggccgcgggtcctgctgggaggtgtgtggtctgactccattctgggctgtggccaagttgagagaagcctgggcctgcctgggcctccttcaagctgggggtggtgcagcggcgcctgcatctggtcctcactcctgcctgccctgcaccacaattgtccccacagccaccccttgatgcccatggtcgttggcaccactggtgcctggccagcacctagtcccttctgcttttttcctcttctgcagaagaagagatgggccagtgggggtagcgtgcctgggcacagaacagcagggggaggtgctgggacaggaaccctggcaggcccctgagctcaggccctgtccttgtggctgcctcatagaccctgggtgacacatgtgtgcccacatctggtcacaggcatgaggctcactcaggaactcatggagggtcacatgtcacacctgacctgaaggagtagcctgggcgggtcgtgtggctgtcgtgtgggcccaggacatccctgtgactcgggacggcactgtgctggggcagcatggaggtgtcccgaaagggaggggagacttgagagagccatgcctgctttcatcactgagtcagcacagagcttgaaaatccacagtgtctgctgtcagaagcatttataggttgccgttctgcctgtgcggactgtgggctccatcgagggccggcaccggcctgactgtcttccctgctccttttccacacagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtatgggaagttgcagcatgaaactcgtctgaaggacgatttggagaaggtgagtcgtgactccacagcccagcgcctcccgcccgagtccttgctctcttccacctggaaggcttgtgtccttgtgtatggaggggcatcctggggacagcccagtgctgtacatggcacatttgtaagggcgacagtcccgtaaattcttgaaactattcctggcaatgccagtagtgggtggcggttggatagaatcttgtcagggtcagcaccggggcgaaagtgaagttctgagtgaagatttctttttgttttgttttgttttgagacagtctcattctgttgcccaggctggagtgcagtggcatggtctcagctcactgcaacctctgcttcctgatttcaagtggtcccctgatagctgggattacaaacgtatgccaccatgcctggctaatttttgtattttttttgtagagacagggtttcaccttgttggccaggcaggtgtcaaacgcctgacctcaagtgatctgcctgccttggcctcctacagtgctgggattacaggtgtgagccaccacgcccggccctctgagtcaagatttcttagggaaactgtccaggtgtcctaagagggctctgggaggaggcacaagcccgggtgccaagcacgtggctggcctctgatgctcaccccaagtcttaaattgcgtccgcgttccccaggctcttcctgtgctgttttgcacctgtggaagaggcaccctctgactccctcgccctttgcgagtgtgaggacactgccatgctgtcataaatgatgacaaagcaacacgacagcagcctccacatggcccgatgggcttggttacagccagggcagctcagggtccatcccatgctggagcagtggatttcaagtgagccgacagggcagctcagggtccgtcccatgccggagcagtggagttaaagtgaaccaacagggcagctcaggctccgtcccatgcgggagcagtggagttcaagtgaaccgacggggcagctcagggtccatcccgtgccagagcagtggagttaaagtgactgaaattgtcatgtcttgtcatgtgtgttctgactcaacctcatgcttgtgacagtgttttcatttctatttgtgtcctgcttctcccacccctttgctcctccctgtgaatgtctccctgagaatgattttcattctccatcaagagacagcttcataggaagctatgatgacctgcaagtctgatcccatgctgtttgttaaatgcaggtgttggtaaggacttccagcaaaatagaggtaagggtggagccctgtggggagccggacaggcggtaggtgggccgatggtcatgtgccaatggcacctgcagccaccagtgtgtggccttctctggcactgttggctgaagacagacttcccaagtgactttttgttgttgttgttgttttgttgttttgttttttttttttttgagactgagtcttgctctgtcgcccaggctggagcgtagtggcgcgatctcagctcactgcaaccttcacctcctggcttcaagtgattctcttgcctcagcctccctagtagctggaattacaggtgcacaccaccatgcctggctaattttttttatttttttttattttttttgagatggagtctcgctctgtcacccaggctggagcgcggtggcgcaatctcagctcactgcaagctctgcctcctgggttcatgccattctcctgcctcagcctcccgagtagctgggaagacaggtgcccgtcaccatgcctggctaattttttttttttttgtatctttagtagagacgaggtttcaccgtgttagccaggatggtctcgatctcctgacctcgtgatccacccgcctcagcctcccaaagtgttgggattacaggtgtgagccaccgcacccaaccatgcccagctaatttttgtatttttagtagagacagggtttcaccatgttggccaggctggtctcaaactcctgatctcaagtgatctgcccgccttggcctcccaaagtgttgggactacaggcgtgagccaccgaacctggctccaggtgactttttgatgctcatgtctttatgcttttcacaggccaccattttacctccttatatcaattatggggagaggactgtggatttctctcttgttaattttaattcttgttttgagtatgtggaagctctgttgttacacgtgtacacatttgtgattgtaatgtcttcctaaaaattcacccttttctgtcttgtagtattctgtccaaaaatacacctgttttttttttgttttttttttttttttgagacagtgtctcactctatcgccagggtggagtgtagaggcgtgatcttggctcactgtaccctccgcctcctggtttcaagcgattctgctgcctcagcctcccgagtagctgggactacaggcacgtgccaccacacccggctaatttttgtatttttaatagagacggggtttcattatgttggccgggctggtctcgaactcctgacctcatgatctgcctgcctcagcctcccaaatttttgggtttacaggcgtgagccaccgtacccagcctcgtcttttatcaatacagtcattccaaccttcgtgtgcattttgtctggtgtatctttttttattcgttttacctttttttttttctttttttttgagacaggctattgcccaggctggagtgcagtggcacagtcttggctcactgcaacctcttcctcccaggctcaagggatcctcctacctcagcctcccaagtaactgggagtacaggtgcacactaccgtgctgagctaatttttgtattttttgtagagatgaggtttcgccatgttgtccaggctggtctcaagctcttgggctcaagtgatccacccgcctcggcctcccaaagtgctgggattacagatgtgagccactgcacctggcctacttttaatctattcaaagtaaagtgcattttatgtggacagcatatagttggcaattttttttttttttttttttttttttaaagacggaatctcactctgttgcccaggctggagtgcagtggcacgatctcggctcactgcaacctctgcctcccgggttcatgccattctcctggctcagcctctccgagtagctgggactacaggcgcccgccaccacgcctggctagttttttttttacatttttagtagagatgaggtttcaccgtgttaggatgttctcgatctcctgacctcgtgatccgcctgcctcggactcccaaagtgctgggattacaggtgtgagccactgcgccggcttttttttttttttctgagacggaatattgctctgtcgcccaggctggagtgcagtggtgcgatatccgcccactgcaagctccgcctcccaggttcacgccattctcctgcctcagcctcccgagtagctgggactacaggcgtccgccaccacacccagctaattttttatatttttagtagagacggggtttcaccatgttagccaggatggtctcaatctcctgacttcccgatccgcccacctcggcctcccaaagtgctgggattacaggcgtgagccaccacgcctggccatagttggcaatttttaatccattctgataatctctgcctttcagttgcagtgctgagtctataaatgtttaaggtaattactggtgtggttgatttaggtcttccgtttcactgttcattttctgtgagatgcgtctggtggtcatggttctgctttttcttttttcttgtgtttttggattatttgaatattttctagaactgattttaatgtatctgttgactattaagttattcctctttgcattatgtttttaatagttgctccagggattaaaatacacattcttggcccggcacggtggctcaggccagtaatcccagcactttgggaggcgggtggatcacccaaggtcaggagtttgagaccagcctggccaacatggggaaaccctgtctttactaaaaaataaaataaaaaaattaggcgagtatggtggtgcatgcctataatcccagctactcgggggcctgaggcaggagaatcgcttgaaaccaggaagcagaggttgcagtgagccacaatcacgccactgcattccagcctgagcggcagagcgagactccgtctcaaagaaaagagaaaaaaaagaatacacattcttaaccttgtcttttatcagtacagtctactaagagtcaccatgatgctgcgttgtgtaaactgtgacctctaactgcacaggtgcttttgtcacctccccttcgtcttctgtgctgcagttttcatagactagacatcacatccgcctcctgcagtgtcaggagatttgctttggaaaacatgtgtttgaaagaaattaagaggaaaaatggccttatacttgccatttctggtgctcttcatttcttcttgaagatctgagtgtttggcgtcattcccttcagcgtgaaggatctccttcagcatctcttgctgtgctgcacacattttctccgttttttgaagtctttattttaccttgattcttgaggagtatttttgtggcattaaaaagtctaaggtgacaggtttcttgttcaggatttaaagatgtttaaaatccttctctgcagattttatgatctgttttgtcttggtgttggtttccattgattgtgttttctcttcagcaggggtcacgttttcctgcttatttatgggtcagctgggttcaggttgcatcctggacactgtgagtgatagatttggagactttgggttctgtcctgctcctctggagagtgttggttttctgttgcagcaggcagttcactcgggtgacttcagactgcatgctcccctgcgtctgtgctgggctgcggcatggtgttaattcagttcttgtagctttagccggcttgcttgcttttggagtctgcccctcgtatgtacagatcggggtcagcctgagacgtgggcgggttccttcccaggcgttgcagctctctttcctccctcactctccagttcctctggctcagtgagggatttgggatttctgtgtgtggggcatggacagatactactcttagtgaaaagctggaaaaagagaatggctcagtgctgtttcttccttctgaatgtccagccctctgcagggtctgtctgcttgtggatctctccacagccttcaggtttttttgtacgttctgttcagttcatagtggttgtctctggagggctggtctggcgaggtgcacaggcatcaccagaagtagcaccctaaactttaataacttaatttttaaataaggagttgaggtcaatcttacgtgcctttttttgggttttttgtttgtttctttttgatgagttcagtagtttattgacctacttttttctctttgaaagtcaggaagtcaggcatggtggctcacacctgtaacaatcccagcactttgggaggctgaggctggcggattgcttgagctcaggagttcaagatcagcctgggcaacatgcagaaccctgtctctataaaggattgcttgagcccaggagttcgaggctgcagtgagctgtgattgtgcccctgcactccagcctgggcgacagaccctgtctcaaaaaaaaaaaaaagattaggatatttgccctctgcattctccttcatccccctctgcacaggatccctttacagtgtgccttgcagttcatccaccccttgctcaaggtctttcattgtcctggcgttgaccttgtacagatcgggagcatcgcaccattggctgctcttgcctcctgggcatccgatcatgcttgctgcagtggcccagcgctatctgtggggctggcgttcccctaacagaggcctgcggccgatctgagtcctgccactggtcttggtctgaacaaagaagcctccggctgctgcctttgctcggctgatgtgtgctgccttcggttgttggttgctgtcaaggccacgggctccagagataaagaacagtcggttctcggtgccaggacgtaggaggcattttatttagttttagacttgtccactttaggtttcttccattgtcatcaacatgagaatcattcctgttgctgtgtgcagcgtaatgggtgtgtgtgtggtgaaaattccctgtcttcagaggtgggtttgggttgtctcttctaataatctcttccattagcgtctttcctcctaaatgaaattatgttgtctgtaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagtttgagcttcgagaagctgaaatgaggcagcttcaggaccaacaggcagcccagatcctggatctggagaggtccttgacggagcagcagggccgcctgcagcagctggaacaggacctcacttcagacgacgccctgcattgcagccagtgtgggcgggagccgcccacagcccaggacggggagcttgctgcgctccacgtgaaggaagactgcgccctgcagctgatgctggcccggagcaggtgggtttgcagtgacgccatctgcagtccctgtgaggccagacaccttggagggtagaaggtgggcaggctcctgggaggaggcgctgtgggctccactgggcgaaaaggtctggagggagctggaacaaggtgtggcgctctaggttttcagcctaattgcagtgggacagctttgtgctcggacgggcaggctggcagttgccatcctgaagccccctggccgcagtgggacagctttgtgctcggacaggcaggctagcagtcgccgtcccggagccccctggccgcagtgggacagctttgtgctcggacgggcaggctggcagttgctgtcccgaagcccccaggctgcaatggggacagctttgtgcttggatgggcaggctggcagccgccaccccgaagccccccggccacagtgggacagctttgtgtttggacgggcaggctggcagctgccgccccaaagccccccaagtctgcactccctgggtgggtgtcaggggcggggatcagtcattgtctctgttgttcttcgtgtgttttaagatttgaacagcagaagctaaacctcttttataggtgtcataaggacatggagtttatccactaagcgtttttgtgttttttttaacttaaacaggtgatttttaaaaataagcatgtttttctgaaacatacacactcttctttgaagttttcaagaggtttagaaagtgattgggttctttgcctgttggtgctgaccctttttgcgagcctcagtcccagggctgtgccgttctttctcatctgtctgccccacccagcccttccccagcaaccagggccgcacagggccccgctcagggattggagaaactcacgttcaggtcgctggggctgcatgaacacgagcaggacgctcttctcaccaggctacgacatgcagttcgtggtagagctgaaccaaggaggccctcaagagaggcttccaggcgcagaggtgcctgtgcctcttgccatccgtcctgtgtcgccagtgcccattggaggccttggcattttgcaggaccctccagctccaggctctttggcctcctgatgggagcaggtccttctgtgaggactctccctgcctctgtctttggccctgagtgccgcctgcacctccttaattcactgccacggggttctattcacttccatggggttctattcattcactgccatgggggttctattcattcactgccatggggttctcctcactgccgtggggttctattcactgctgtggggttctgttcactgccgtggggttctattcattcactcccatggagttctgttcactcccatagggttctattcactgccatggggttctattcactgccatggggttctattcactgccatggggttctattcactgccgtggggttctgatcactgccgtggggttctgttcactgccgtggggttctgatcactgccgtggggttctattcactgccgtggggttctgttcactgccgtggggttctgttcactgccgtggggttctgatcactgccgtggggttctgatcactgccatggggttctattcactgccgtggggttctgatcactgccgtggggttctgttcactcccatggggttctgatcactgccatggccttctattcactgccgtggggttctgatcactgccatggggttctattcactgccatgggggttctattcattcactgccatggggttctcctcactgctgtggggttctgttcactgctgtggggttctattcactgccgtggggttctattcattcactcccatggagttctgttcactcccatagggttctattcactgccatggggttctattcactgccgtggggttccgttcactgccacagggttctgttcactgccgtggggttctattcactcactgtcgtggggttctgttcactgccatggggttctattcattcactgctgtggggttctattcactgctgtggggttctgttcactgccatggggttctagtcactgccgtggggttctgttcactgccgtggggttctattcattcactgccttggggttctattcactcactgccttggggttctattcactgccatgaggttctattcattcactgccatggggttcaattcactgccatggggttctcaggcctcgccctccccatgggcccccatgggcagtgccccttccctgttgaggagcagagattaccttgggattcttggttggatgctggctcggacgctgtggtgtgagtaggaggttggttgtgcctgccgtgcgtggctctggcggggatgtgtgtgtgccatctcttgctgagggcgctggttcctacctgtggtctgtgacctggcgactcccatggctttggcctttggcctctgggcttctctggcttcatggggcctcttcactctcccacttactatttctggtggtcgagggaaaagtagtaagagcagttaaaatcccgaaacgatgacctgaacagttgaagtggcatttcctgtgggaaactgacttggcttttgcaagggtcattgcttcctgatgcatgtttaactgtcctgtgttcactttgttgccgcaggtttttagaggaacgtaaagagatcaccgagaaattcagtgcggaacaagatgccttcctgcaggaggcccaggagcagcatgcccgtgagctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagacaaaacacgctgccgacctcggcgctctggagaccagacatctgtccagccttgattctttggaatcctgttacctctctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagtgagcacagagctcgccggaaccgtggctcacgagctgcagggagtgcaccaggtaaggcgccagggccctgccccagcccagggcaggcctctcctcgctgcctgtgtgtttccaccgcgtgtcacatgtctgcgtgcgtgctgtgtgtgcctgtgcgggtgtctgtgtgtctcacaggctgccgagatcagtggggacttctggtctctttgtgaactgggcttttttttttttttttgagccggagtctcactctttcgccaggctggagtgcagtggcgcaatcttggctcactgcaacctccgcctcctgggttcaagtgattcttctgcctcagcctcccaagtagctgggattataggcgcctgccaccatgcgcggctaatttttgtatttttagtagagactgggcttcaccatgttggccaggctggtctcgaactcctgacttcaggcgatccacccgccttgactcccaaagtgctgggattacaggtatgagccaccgcacccggcctgagctgggctttaaaacactgagttgaagggttattttgatcgcaggcaccttgttaaaggctttgctctcgtacgtatgtgggagggcctagaccttggtgggggattttgtgggctttggagtattcctcaaggctgaccagcacctctgcagaagacttggtttccaggctgctgtgggaagatctgatggtcatgttgtgtattcagagccttggtcccctccttttattgatgtttcctgaaataaaacccttttgctacatttcaagagcagtgatgggccaggcacaatggctcacgtctgtaatcacagcagtttaggaggctgaggcagttggattacttgagcccaggagtttgaaaccagcctgtgggctacgaaaattaaaaacaattcaccgggcgtgggggcacgcacctgtagtctcagctactttggaggctgaagcaggaggattgcttgagcccaggaagtcgaggctgcagggtgagctaagactgtgccactgcactccagcctgggctgtaacagagtgagaccctgtctcaaaaaaaaaacaaaaatagctcacacctgtaatcccagcactttgggaggccaaggcgggcagatcacaaggtcaggtgatcgagaccatcctggctaacacggtgaaaccccgtctctactaaaaatccaaaaaaaaattagctgggggtggtggcggacgcctgtagtcccagctacttgggaggctgaggcaggagaatgatgtgaacccgggaggcggagcttgcagtgatccgagatcgcaccagtgcactccagcctgggagacagagcaagactctgtctcaaaaaaaaaaaagcggtgatggttcatttgacaggcacttccaagtttttatcatgaagaagaatttctggcgaagtccctcttgccctgggctggcgcctgactgcagaagctgcagtgcctgtgactcaggaaaggacacgtgttgtcgtatcacacacaccttgtgctttctctgccctcagtgaggtctctgaggttttctcaccttgaaatagatgagtctgctctgttgagcatgtggagccactggggctggcctatctccctgcaggaaggggatgcataggcctggctgcacggtggatggggcatgggctagagctgatgaggcagttagaaatggttgttctggcagatcaataccttgtcagacgtttaagaagtacacgttccaaactataaacgagggaattgccagcttggataaggtggatacgttgatttcctgataccagcatgccacgggagggcttcctccttcctgactgtggggaacagttgtgaggctccaaagcgttggcttattgtttgctttccttcagctctgtgtaagaacaggagaaaagtggaaccttctttaatcgctgtgagggtttcatgttatgtttcaggctgtctgttttgtgtggtctgagcatgtgatcttgggggaattcctagaaagcagaatatgttcaggctccctctgctctcctgagtaaggtgcagtcagttgcctgtctcaggcctctgtgtcctgtccttgtcttcaccacatgtcagggagtcctggggatgtgttttgtttgtttcttttttgttttttaaaagacagggtctccctgtgttgcccaggctagtctcgaactcttgggctcaagagatcctcttgccttggcctcccaggtagttggaattacaggcatgagccactgctcccagcttgggaggtgcctcttgagagaagctggagccatgttgtctttctggacaaaattagacaggggtctgatgctgctgggagctgccctccaggccagtcctcagatgccagcttcagtttcctttcgttcccagttttgatcataggcaaacagatgctttggagaatagcacttgttcccaagctgtggatttaaaattaggttttcttggtttgtttggtttaaagaaaatgaagttctgaaagaatattcagaaaggaggaacttgcatatcacacatgaagtgtgtgtttcaaaccacggcctgatttagtcagaggaagcatgtggagcgtgtgcaccttctgtgccctgtgtggggatgtggcacatctggatgtttcctggacggaaggagctggtcgcagccctgtgcaatcagagacgcctgctggaggcagagaggaccaaagccctggacagggtgggtgccaaggtcctgctcctggagcatcagcaccaagcggccctgcaggaactcagagatgtacgctgccaagatgcaggagcatcaagcagggcaggcggagctggaggagccgggggagccggaggttctgggggtgctgggggagctacaggtgctgcgggaggggctgtgcaggtgagcagctccacgtgtgtggttcccacaggggtgcctccccggcttctctgccctgagtcttcatcagagcgttcaggcacttacggatacacttggagccgctggattgtgcgtgcagtggggtctgtgctcaaagagtgcagcttcgtgggggcagatgtgtcagtgcacctggccagcgaggcagctgcaggggtgggcatccgggggggggtgtctttggttggcctcccctcctgttggggcctccggagggcagggttctggtctggtctgcaggcagtgagtggtctgtggcgcgaccagatctgtcctacaggctacttggcagctggacgaaacacaaagtggaggcgattcagagcctgggaggtgcgggggtcggggaggctggggctcatcctgggtgtcgcgctaggcagctggggggatagtgaggggtgcctgccagctgatgatggcatagggaggggcatggagagcctgggggctgacaggggaagccacgcttagctggaggggtcatcccaggttggactggtgcaggggatgtggcttgtgtagacacagaagcacatttagttgctcttataaatctgcacacgggctgggcttggggctcatgcctgtaatcccagggcttcgggaggccacagtgggatgatctcttgagctcaggagttcgagaccagcctggggaacatagcaagagtccacttctaaaaataaaaatcggccgggcgcggtggctcacgcctgtaatcccagcactttgggaggctaaggcgggcagatcatgaggtcaggagatcaagaccgtcctggctaacacggtggaaccccgtttctactaaaaatacaaaaaattagacaggcatggtggtgggcgcctgtagtcccagctattctggaggttgaagcaggagagtggtgtgaacccgggaggcggaggttgtggtgagctgagatcgcgccattgccctccagcctgggcgacagagcgagactccgtctcaaaaaatatatatatgaaaataaaaataataaataaaaattaaccaggcatggtggtgcaggcctgtagttccagctacttgggaggctgaggagagaaaattgcttgaacctgggaatctgaggctgcaggaaaaaaagaaagaaatctgcacacagtatggtttattttctttctttctttttttttttttttttttaaagacggagtctcaaaaaaagtctagagtgcagtgtcacgatcctggctcactgcaacctctgcctcccaggctcaagcagtcctcccacctcagcctcccaagtagctgggatacaggcacgggccaccacgcctcgctaatttttattgttttgtctcccaggctggtcttgaactcatgggctcaagtgatcctcccgccttggcctccccaaagcactgggattacaggtgtgagcctctgcacctggccagtgtagttacttactttttcagttttttaaaatcttgtgtgtcagaatatgcgtaagcactggtaccaaattgtgtcagaagaagccagactgagtagtcggaatcccccttggattcccaaggtggccgtgaaggggcctggctgaggtcccctgccacctgctgtggtcttgattctctgcacctatgcaggactgcatttaagcagcaaggtctccccacttgtggacccgtgcacctgccccatccaggcgccaccaccccgcctgctggtctgcatgatgagcacacgcacacacagcacatgtgcacacacagcacatgcacacacacatgcagacacagcacatacagcacatgtgcacacagcatgtgtgcacacacacagcacatgcacacacagcacatacacagcacatgtgcgcacacagcacatgcgcatgctcacacagcatgtgcgcacaaacagcacatacatagcacatacacacatgcagcacatgcacacacacacagcacatgcacacacacagcacatacatgcagcactcacagcatatgtgcccatacaaggcacatgcacacagcacatgcgcacacatagcacatgtgcatacacagcacatgcacacatgcagcacactcacagcacatgtgcccatacaaggcacacgcacacacacagcacatgcacacacagcacacacacagagagcacatgcacacagcacatgtgcacacacagcacatgcacatacacagcacatgtgcacgtgtagcacatgcatgcacacagcacatacacatagcagatgtgcacacagcacgcacacacaacacgtgcacacacatgcacacgtgcttacacagcacatgttcatacagcacatgctcatacacgcagcacatgcacacatacacagcacatgcacacatgtcattctgcatgttgtcctgcaggatgaatgcctggggccctcctgcttctgtgttctgggtctgtacgattttctggcctttctgtggggggagggttagagtctggagcacttcagaaataattgataatttatttgaagcattatgtgcaaattttaggtgattatggtacatatggtttcaagggggttttaaacaaggacatgctaagatctcatttctagccataaagtaaggttttgaacctgaaaggtttgcttggtgaagagggactgctcctgagaatgggtgatgcagcgccggattctgaggttagaaatgacttgtttcttcacgtggacagctctgggtgctgcccagtgtggacactggcccctcagtcctgaggcacagccctgagacctgcaccctgctgggtatcgtgtgggtctgtcttctctggaaaagtcagattctgtctcgcttttccagggactcatgctaaagaaattctgtccgttttatctgtgcatagcacaaggaggtgttcgttttctgaaatcgtgtgtcacctgtgtcctttaacctgtacttttgttcttctagggtgactgttgttgttgttgttttggagggaggatcttgctctgtcgcccaggccgaaggtagtgatgcaaccacagctcactgtgaccttgaacgcctggcctcaagtggtcctcctgcctcagcctcttgagtagctgggactacagatgtgcaccaccatgcctggctaatttattttttgtagagatggggtctcactgtgttgcccaggctggtcttaaattcctggcctcaagcaatccttttgtctcagcctcccaaagtgctgggaccataggcgtgagccgcgcctggcctggactattatcggaatactcctagagcgtctttgcagtatttttgtagttgaggtacaggtttgcgcgagtaagttagctttttactttgctgctagggatgtgcatgtcaatactctttttttttttttttttttgagacagagtctcgctctgtctccaggctggagtgcagtggcgtgatcttggctcactgcaacctctgcctccctggttcaagggattctcctgcctcagcctcccaagtagctgggactacaggcatgcgccaccatgcctaatatttgtatttttagtagagatggggtttcaccatgttgcccagggtggtctgatctcttgacctcgtgatccgtccgcctcaccctccctaagtgctgggattacagatgtgagccaccgcgcccagccttagcttttttttttttttttttttgggcggagtctcgctctgtcgccaggctggagtgcagtggcatgatcttggctcactgcaacctccgccccccgggttcaagcgattttcctgcctcagcctcctgagtagctgggattacaggcacataccaccacgcctggctaatttttatattttcagtagaaacagcgtttcaccatgttggccaggctggtctcgaactcctgaccttgtgatctgtccgtcttggcctcccaaagtgctgggattacaggcgtgagccactgcgcccggccgctcagatactcttttatgtgattgttttggtgtagctgatttcacagaagaaaacaattgggctgtggggaggtgggatgtactctttattttatattatgttttttggggcagagggcagcatttgcaggaatagaataactcagcaagcccccggtcccgctggttagtggggtgcacgttcaatacatcagtccccctctcctcctgattgtttagaagcaaatccaagacaccatgtgtctgcgagtgaggtgttttcccccaatacagcataaccatgatccattctcacctaaaacatccacagcgatccctgcatttcatcacaagcccagcccacgtgccagtctcttctggctggctcacatcaggatctatttgttcctgtgatgctggtcactgttccctcgttcctgcaagcgtgttggtagatccacaggcctgtgattggtgagaatgcttcttgtatggtggccactcctctcctggtctcctggtctttcctcaggctttacaccgtgaaaagacataacacaagctggctgcagtggctcacgcctgtaatcccagcactttgggaggccgaggcgggtgcatcacctgaggttgggagttcgagaccagcctgaccaacacagagaaaccctgtctttactaaaaatacaaaactagccagccatggtggcacatacctgtaatcccagctactcgggaggctgaggcaagagaatcgcttgaacctgggaggtggaggttgtggtgagccaagatcgtgccgttgcactccagcctgggcaacaagagcaaaacttcgtctcaaaaaaaaaaaaaaaaaaaaaagttacacagagccctgccaagccctgacgggagtgttttgggtcattgtcccagaatagctgggatgtcctgttcttccccgcggcgatgctttatctgagcctcaaatatctttgcacctgttggaacagcagtcacttgtcagcagtgtgacttgacctacacttgtggggtgattggattactttccgggataccgcccttgagagtttggttgtgaggaaagtcctctgaaaacgtaagcttgatttctttttgatagaagtatgtatcccataagattcccctgccctgccctgccccgcctgtgctggtaacacgacgcagagctgagtgcagaagtgaatcgcatgcggccggtgtgggatgctcaaggcggtgtcatcttttctcggattgaaaacccaaatctattcataggttaattattttaatattaagataatattaacgttggtttagatagcatttgaatgtcctaaatgcgttctcaattgaatgtctttgccttctgacattggtattctctgtgcatgccacttacttatgattaaaacatatgtgatatttttctataattgtgtggattttagaaaaacctgaaaataactttttttgaaacgtcttttttgatactgacctcacagcttagaagaacatggtcaatttaaagagttttattccaggctagagcctctgccagggggttgcaggaagaaaatctcctttgagccggcccggtcagattgagggggtggctgaggacgcacgcttctgctcgacattgtggccgagccgaggccctgggcctgagggatcacatgtggggcactggccgtctcactgctgggcctgcatgcctgtgacctgcccagccctgcccgacgtctcctgggggctgtccccccgcggggagccgcctcatttggcctccaccacctcctacgtcctctgcaggtctgccgaaggcctgagagtgtgcaggcaggacagggccaagcgtggacagttagggtggctcccctgggtgcgaggcggtacctgcgggtggtgctgtgccttgaaacaaagcgaaggtcaagactgcacacatggagcttccagctgccagtgggtggagggagcgccacctctgtctgccatgcccgggcgtcctggtgggctgcgtgcagtgttggcactccctggctggggttctctgtggagcctgccctctaccctctccgtctgcagtgtgtgactctgggatcccggaggccgcggggctagagcgtggcaccagctgtgctcctgagtggggcgtagtttgggacgcctggagcttaggccaggctccgcaggctctgggggtgtccaatgttcttgggctcccgtgttggcctcaaacagaagtttgattttctcattgttacacggtaggcctctatgagagatttttgtccaaagagagtaagtagtctgtggctcagaaagatgttcaaaggaccactgatttcagccttggactcttgccacatcctttgctgggcaccgggagcgcagaggtttgccctcgggccccacaggctgacgctgtggatgccaggagggaagcgcctgatctgtgcctggctgggcctgaggagcccgtccactgtgtctgagcatgagctgttgtgggcaccatggtggcgcctggtcttgaggattaattttcctgttttcccagtcccttggcctctgtcctgccgggtgcattggcatttggggttttgttcttgaattcaccagcgttttgtggttggtgtacactgaaccagcatccctgtttggacctcttactcctggcccgctgccccctccctggctgttggtccggatcaatgcgtctgtcccccaggagacgcactgctgatggttggggtatcagcaaggtaattaaagttctttggaaactttgtagtgtgcacagctcagaagttaatcttaagtccttcctttcaaacagatggaactaaatcaaatccaggagagaaagttgattaaagtgaactgtactcacattccaaatggccttgagaccttgcgagtgacttcagtgttgtgccgtgcgaacccgtttctggtccctgtgactaagatgcagatgcacagcccacctggcacctcagcaagttccaggccggcgcggggggcacccgatcctttatccttttcctccccatggcttatcacacaaaaaaaggtagagaataaaggtcatttctggtgtcagggcttccatgtgtttattgaaactgttgccccagttacttcagaaaaggcactcactcattgttgacgtcttcctcctcctgaagctggtggagccccagccctcagccctcctggccgtgctgggcagggagcgggagccggcaatccaccccagatgttctggagcagcaggtcccggagcagcaggtcccactgctgaggacatgggcttcgtgctgtcctttcctgcctgctaagtagatacaaaaaacttactttatcagttaccttttcacatgccaagtcaaaacacaaaataatttcattgtcttaaaactgagctttttctaggcaacttttgtcaggcctttttatatttaaatctgctgtgtaacacaccttttctaccaagaatctgtcatcacttatcttagagctgagaaaagtttattctaaaatatttcatcacctcaaaaagaaacccccagtggctcgtgcctatagtcccagcaccttgggaggctgaggcaggaggattgctggagcccaggagttcaagaccaaaaataaaaaaatactaaaaataaaaaaattagcctggcatgttggcgtgcccatatagttccagctactcagaggctgaggtgggaggaccactggagcccagaaggttgaagctgtagcaagctgacatcgcaccactgcactccaggctgcatgacagcaaaacgttgtctcaaaagataatcaatgaaaattaaggaagaaaacaagaaactccccattctcccttctcccccatgcctggtgatgtgccgtctgcttgccgtacctgtgggcgtcctacgtacatagactcagcgtgtgccctcggtgtccgcggctttcactttgtgtgtttcccaggttggcgcacgttgtagcatgtgtcaatacttgcttggtatgtgttttctgcatatcttatgccctttttgttctgtattcctccattactgccttttttcactttaatttccttgatgtttcctttaccatacggtggtcgccccttacccacaggggatgcattccaagacccccagtgggtgcctgaaatcgtgaatggttctgaaccccttatatgctgtttttgtctatacatacctgtcatcaacttttaccttaaaggaatcaccctgtggtgtctctggcatatctgaattgctccgtcatcaacttttaactgaaaggcatcactctatggtgtctctggcacgtctgaattgcagcattgcaattgaacggcctctcttgcgctttggggccgttattaaatgaagtaaaggtgacttgaacacaggcactgtgatgctgtgacagttggtctgatcaccgagatgcctgcgtgtgggcaggtagtgcttgccacgtggataacgccggacagaaggatgacccccggcctggcctgcgagatttcctcacaccgttcagcttgggggcaggcagtttaacactcataagagttgtttacttctggaatttttcatacgatattttcaaaatgacgttgaacacaagtaactgaaaccgcagacaaaggggactgatatatattgagttattttcttagcgcttgccctgagcgttacagcaagcaccttctaacaatctggtttggattaataccaacttaattttaaaagtttacaaaaccatttgctaatgtagcatcattccctcgtctgccctttgtgctcatattgtcgtaccaaccacatctttctatctttttgtgctcgttactttatgcacgtgtcttttaaaccaggaggaagaagaattgtaaacaaaagccatgttgttttgtctcctgttttctctgtgtcgttacctgcactactgctgctcgtttcttcctggaaattcaggtctggtgccttatgtttcagcccgaaggacttcctctgggatttcttgaaggacaggtctgctagtgatgaatcctcttagcttttgtttttgtgggaatgtcttaatttctccttcatccttgagagatcatttcctggatgtggacttcaagatccaggcttttccttcagtgctgcgtgggctctccgctgcctcccctgtcatccggggctgcgtgtcgtgagctgcgcccgtcttcctgggctgcgtgtcgtgagccgcgcccgtcttcccgggccgcgtgtcgtgagccgcacccatcttcctggggctacgtgtcttgagcggcacccatatacctgctgtgcactggctggcctcaagctttgtcctgaaccctgctgaggtttggctgtgatgggtgaagtgtgggtctctgtcagtttgtcctacttggagttcattgagcttgtatgtggggattattatttttattattattgttattttcatcaaatttgggaggtttttggccgtcgtgtcttcaagggttcctctgcccttttctctccctctgtctggcttgagggtgccccacaggccttggagactgctgagttttcttcatgtttctttctgttccctgactggatcgtcttaattgacctatcttccagcgtgtgaattctgtcttctgcctgctcgagtctgctgccgaacccctctctagtgaatttttttttctgtgattgtatttttcagctccagatgtcaagggagctctatttcagtctttctctctgctgagggccctgcgtgcattgtgccctcagggctctggcgggcggtggacagcctggccctggccttcacccctgctgtgccaagccacatggtcactgcagccggcccaggacctcttgggcctttccagcgtgggcacagccctgcacgtgttcacaccttgtagagtcccagaagatgtcagagctttccagaggcccctgtggacatcgcattctcaagtgttttcttttgtttttctggcagtcccttattagtcccaactggtttctctactgtgggcagtgcggctattaaacacttgacactgactgtttccaaccggtgccctggggtagattttttttttttttttttttttttttttttttttttttgagacagagtctctgtcgcccaggctagagtgcagtggcgcaatctaggctcactgcaagctctgcctcccaggttcacaccattctcctgcctcagactcccgagtaggtgggactacaggtgcccaccaccacacccagctaatttttgtatttttagtagagatggggtttcaccatgttagccaggatggtctcgatctcctgaccttgtgatctgcccgccttgacttcccaaagtgctgggattacaggcgtgagccaccgcgcccggccaaccctgggtagaatttttgacaccgagagctctgacccagtcacggcagcaaggtgcccggcaggtgggctcgggcagttgtgcatggaaattttggggtgctccaaatccattctgtcccccaccccaccccagcagctactggttttcagggctgttagattggagaggagatatggagtcagggcaaagttaagcacctgaagtttgttcttatggacactcagcctgtgttttccataaacactcttcggatgattgcaaacctgaccagatttccacagctctgaaaacactggttttgatggtttttaccactttttcttttatagaggaacagattttggaggtccttactttgccattctagaagtgctacctctggaagtttaaaaaaataagcttatttcattaatttaattggccgggtgcagtggctcacacctgtaatcccagcacttttggaggccagtgtgggtggatcacttgaggtcaggagtttcagactagcctggccaacaggttttggtagaaaccctatctctactaaaagaaaaattacaaaaattagttgagtgtggtggcaggcgcctataatcccagctactcgggagactgaggcaagagaatcccgtgaacctgggagacagaggttgtagtgagctgagatcacaccactgcattccagcctgggtgacagagaagagtccttccaaaaaaaaaaaaaaaaaatctctgtgtgtgtgtgtgtgtgtgtgtgtgtgtgtgtgtgtgtgtgtgtgtgtatagaattcatctattgaaccttatttaaaaggttttgttatttagaaagaaggtttaatcttttaaaagggaaggaacctaggtttccaaatatcttgggttttcatggctgtaattccttgatggtgaacttcttagtgtgactcttaaagatgttacaggagccatttgggaatggtagtgagcagttgcttatgacacgcagctgtcaccagtgcgaacttgtgtctccttaagtgttttatccccgaaaccaggactttgtgttcccagtgaagtccttgaacccatgttttctttgatgggggctgtggtctggctcatcccggctcttggtgcagagtgggggctccatgcatatctgctgaatgtgctgaattccggctaacagcaaagaaagtatttttctagcttactggtattttttattgttattgatgtgtacagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcaggtgtgtggaatacgctgttcccttgtgataagacgtgtatagcataaaaatcattttcactttatttcagtgcacagttcagtggcaggagtgcactcatggtgttgtgcatttatagtgttgtacattcagtggcggaagcgcattcacagtgttgtagattcagtggcggaagcgcattcacggtgttgtgcattcaatggcggaagcgcattcaccatgttgtatattcagtggcggaagcgcattcatagtgttctgcattcagtggcagaagcacattcacggtgttgtgcattcagtggcggaagcgcattcatagtgtagattcagtggcggaagcgcattcatagtgtagattcagtggcggaagcgcattcatagtgttctgcattcagtggcggaagcccattcacggtgttgtgcattcagtggtggaagcgcattcatggtgttgtgcattcagtggtggaagcgcattcacagtgttgtatattcagtggcggaagcgcaatcacagtgttgtatattcagtgacggaagcgcattcacagtgctgtgcattcagcagcagaagcgcattcacggtgttgtatattcagtggcggaagcgcattcaccatgttgtatattcagtgacggaagcgcattcacggtgttgtgcattcagtggcagaagctcattcacagtgttgtgcatagttcagtggcggaagcacattcacggtgttgtatattcagtggcggaagcgcattcacggtgttgtgcattcagtggcggaagcgcattcacggtgttgtgcgttcagtggcggaagcgcattcacggtgtgcgttcagtggcggaagcgcattcacagtgttgtatattcagtggcggaagcgcattcacagtgctgtgcattcagtggcggaagcgcattcaccgtgttgtatattcagtgacagaagcgcattcacggtgtgcattcagtggcggaagcgcattcacggtgttgtgcgttcagtggcggaagcccattcatggtgttgtgcattcagtggcggaagcgcattcacggtgttgtgcattcagtggcggaagtgcattcacagtgttgtatattcagtgacggaagcgcattcacagtgctgtgcattcagtggcggaagcccattcacggtgttgtgcattcagtggcggaagcccattcacagtgctgcgcattcagcagcggaagcgcattcacagtgttgtatattcagtggcggaagcgcattcacagtgctgtgcattcagtggtggaagcccattcacggtgttgtgcattcagtggcggaagcgcattcacagtgttgtatattcagtggcggaagcacattcaccatgttgtatattcagtggcggaagcgcattcacagtgttgtatattcagtgatggaagcgcattcacagtgctgtgcattcagcagcggaagcgcattcacggtgttgtgcgttcagtggcagaagcacattcacggtgtgcattcagtggcggaagcgcattcaccatgttgtatattcagtgacggaagcgcattcacggtgttgtgcattcagtggcagaagcgcattcacggtgttgtgcgttcagtggcagaagcgcattcacagtgttgtatattcagtggcggaagcgcattcaccatgttgtatattcagtggcggaagcgcattcacagtgttgtatattcagtgatggaagtgcattcacagtgctgtgcattcagcagcggaagcgcattcatggtgtgcgttcagtggcagaagcgcattcacggtgttgtgcattcagtggcggaagcgcattcacagtgttgtgtattcagtggcggaagcgcattcacagtgttgtatattcagtgatggaagcgcattcacagtgctgtgcattcagcagcggaagcgcattcacggtgttgtgcgttcagtggcagaagcgcattcacggtgttgtgcgttcagtggcggaagcgcattcaccatgttgtatattcagtgacggaagcgcattcacggtgttgtgcattcagtggcagaagcgcattcacagtgttgtgcgttcagtggcagaagcgcattcacagtgttgtatattcagtggcggaagcgcattcaccatgttgtatattcagtggcggaagcgcattcacagtgttgtatattcagtgatggaagcacattcacagtgctgtgcattcagcagcggaagcgcattcacagtgttgtatattcagtggcggaagcgcattcacagtgttgtatattcagtgatggaagcacattcacagtgctgtgcattcagcagcggaagcgcattcacggtgttgtgcgttcagtggcagaagcgcattcacggtgttgtgcgttcagtggcggaagcgcattcacagtgttgtatattcagtggcggaagcgcattcacagtgctgtgcattcagtggcggaagcccattcacggtgttgtgcattcagtggcggaagcgcattcacagtgttgtatattcagtgacggaagcgcattcacggtgttgtgcattcagcagcggaagcgcattcaccatgttgtatattcagtgatggaagcgcattcacggtgttgtgcattcagtggcagaagcgcattcacggtgttgtacattcagtgacggaagagcattcacggtgttgtgcgttcagtggcggaagcccattcacggtgttgtgcattcagtggtggaagcccattcacagtgctgtacattcagtggcagaagtgcattcgtggtgtgcattcaggggcggaagtgcattcacggtattgtgcatagttcagtggcagaagcgcattcacggtgttgtgcgttgagcggcggaaacacattcatggtgttgtgcgttgagcggcggaagcgcattcacggtgttgtgcgtagttcagtggcggaagtgcattcatggtgttgtgcgttgagcggcggaagcgcattcacggtgttgtgcgttcagtggcagaagtgcattcacagtgttgtgcatagttcagtggtgcaagtgcattcatggtgttgtgcgtagttcagtggtgcaggcacattcacggtgttgtacattcggtgatggaatcacattcacagtattgtgcagccatcaccaccatccatctccagaagtcttcatcttgcaaaactgaactctgtccccattagactctcactccccatttgccctcccctggcaccatggctcacacctttaatcccagcacttcgggaggctgaggcaggaggaccactccagcccaggaattcgataccagcctgggcaacatagggagaccctgtctctataaaaaattaaaaaaattagccgtgtgtggtggcacgcacctgtagtcccagcttctcagaaagctgaggtgggaggattgtttgtgccctggagtttgaggctacagtgagctgtgattgtgccactgcactccagcctgggcaacagagtgagaccctgtctcagaaagaaagatctttgcctgcctggcaactgacttttgtgaatgaccagatacagtgacttatttcgaattgctgtttgagtggtggatctctgatgaactggccccttccctcccctagcctcaggttccacctggggatgtttgtgtattcttttgtaaatgatgaataatggaggaaaaaccgtatcaataattttcacctttaatcagcacctcgttcacctttgccgtatttttattaaatgtgcaggtgctccttggcctttgctgaggtcacgcctttgaccactgtcagtggaaggcgttgtgagtcgaggaacgtgccgaagtgcctgctccttttgccccatcaccaagctgaaaagtcctaagtcagagactctcaaatactgaaattgtgttgaaagtcccttacagccatttgcttttaaccaaattgttttaacgaaagctttaaccatttttctcgatagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaaggtcagtgtgtcctcggcaccgaggctgccttgtggccgccagcacccgctgggtcatgcagatgccattggtccccacggctcctggccccgtggctgctgccaccatgcacgctggctcctggtggacggggacccggcttccttcttctctcagttagaaagattgtaagcaccgggaagaaatcgcctgctgtgtctcatctcccagcccccgtgccctcctcccaccctgcctgctgtgtctcatttccccatctggccagattaaaaccagccgttatctcccacacagagcccgacccctcccctttagtgtctgcgtccccgcagcgtgtcctcgtccccggcacggggtgcaggcccacatgtctcgtggttcctgtgctttggactgtgtgcaagtgtcgtgcctcatgcatctctctctgtgacgtgtgtttctgagaccggcccaagcaggggccgtagccctgtccgttcctttctccattgggagcctgtgcctgggtagctgcaggcactgggctgagcgcccagccccgagggctctcccagggcggggtgtgggtctgcttaccacgggccgtggggccgccttccctgaacgcatgggtccaggccacatcctgccttggtgcctcctcacctgcagtgatgctgtccagcaggcttgtctgcccttttgtcgcgtgtggggtcttgagaaactttttgctcctctgacaccatggaggtttttcccaggtcacctcacagggttttaagttttgcttttgtgtgactctggggtgagcctgcagagttgttcttgcttgcacctgtctgggcagtggactcggcactgtgttgccaaacgcagcctccccttggtgcgcgtcctccccgtccccttgtgtgggtctttggctgctcccattggcgtgtccccgcccgaggcctctgtgtcctgctgctgctcccatctgtgtgtccccgctgaggcttctgggtccagccactgctcccgtctgtctgtccccgccccaggcctctgagtcctgctgctgctcccgtctttgtgtccccactcgaggcctctgggttgtgctgctgtgtcctgaagctctgaactggtttggctctgctctggagaccacccagggtccggagaccaggtcgggcttatgggaccctctgagctcacagctgtttctggagcattggtgtctgtcatgctgagggtccatccgtgtgtggggggtgtctgtgcaggtctctctttgttcttttcatcaagttttgtgatttttctgtgaggaccttgccttctgtagcacttggctgtgggtgtctcgtagcttggtgctgactctctccagtcacccaggtcagtgggcgagcgagagctctaaaccgaggggcacagcggccagtggggcggtctgtgctcttaactcgaggggtgcagaggtgggtggtgggcggggtagtcccaggctctaaacacaaggggtgcagaggtgagcccacggtccctggacactggagaggctgcctgtcttgaggtggggtggctgcagacgccctgatgcctgcaggagttgggcattttggggggtggaagtgtgctggggagcaggtggcattctctccgtcaagcccctcctcaggactccccctccctgttatttgcccagaatcttcggtttcgcggggcctgcacgacactgcctcccgttgtcacctcacggtccccacgaatgagtcctcatcgtctgctcctcagggttgggctctctggggacagagctgtgagcagagtagagggagggctggctgtgtagtcactgggtcaacgtgcctgtcctcagcggcgtcacagctcctaaatcatagtgcagggagcgagatgtggaggggcctgtggcctcgggagcccctgtgtgtaaaaacagaagcatcccagccgggcgcagtggctcacgcttgtaatcccagcactttgggaggctgaggcgggtggatcatgaggtcaggagatcgagaccatcctggctaacatggtgaaaccccatctctactaaaaatacaaaaaattagccgggcgtggtgacagacgcctgtagtcccagctactcgggaggctgaggcaggagaaaggcgtgaacccgggaggtggagcttgcagtgagccaagatcgtgccactgcactccagcctgggcgacagagcgagactccatctcaaaaaaaaaaaaagacagaagcatcccagaccgcacgtccacgaggcctagcgagaggctgggagacaccatcctcttcctgccacacaactcctgtgaatgtgtggctgaggcgtgacttggtgttggacagacatcttgtgaaatggctggctggtgcaccctgtgctccaggggaggggcggagcctgtgtgctgctcccgggtgattgacgctgtgcggccacatcgcacacctgcgggacgggtttgccgtgttcctaatgtgatgccttttacacatcagaaatggcatcaggaagacctcacctaggaaagcccgtgtccctgagtgggctccacgtggttgtcttgtctgtggcctcagcttcctgtgctcacatgggcatgaggatcatgtcttccggccccgtggggacaggcagccgtgggccgaggtgtgcaaactggtgggcggcccctcagcagcatccagggtgggggttcttatgccgtgaccagcttgcctgatgatgggtgtctcctgtctcagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacaggtgagtgtgccgggaccagctgcccagccctgtgcttgcagcccctctgtggtcctggagctctctgagaggagcctccgtattgggcgatgcccttgggagcactgccgtcctggtttcctgctagtttccgcacttacagaaggccgagaccggggtttgggctaaatttgtcagctcccgtggacgtggcgctgactcatctcggctggggcgacgttctgagttctgtggcttccttgtcgtcttggctgccatggccgcggccggcttgctcactgagccgcgtgtgccggcatctgctcatcttgtagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcaggtgaggcccaggctcccggggtcctgtggagatgtgaacaactgagtagctgatgatgccacacgagcctggtggatgccggtgccaacgacgctcgcacgggtttctccccaaggaggaggcttttctgaaccagatctttgaggaagtgggcttgctacgaatgagagaatctgtttgtttaatttggataataaacaggcccattttctttacttcatgcactgttgcaattccatgtggagtgttttcatatttagagattatcactaagaaaggaaattttttgtaaccgttttagaacattttagacaattaaaaaagacattaagtaggaatacacggaaagcaatcaaagatctttttttcagccaggcacagcggctcactcctgcagtcccagcactttgggaggctaaggtaggaggttcacttcagcctacttcagcccacgagctcatcttgtagctctggcgctggaggagatgtggtctgatgtggccctcccggagttggacagaactttgtctgaatgtgcagagatgtcttccgtggctgaaattagcagccacatgtgtgaaagctttctcatgagcccagaaagtgtacgggagtgtgagcaacccatccggagggtcttccagagcctcagcctggccgtggacggcctcatggagatggccctggactccagcagccagcctgggcaacatagcgagacctcattttaagttagccaggcgtggtggcatgcgtctgcggtcccagctcctcaggaggctgaggcaggaggattgcttgatcctgggaggctgaggctgccgtgagttgtggttgcaccactgcactccagcctgggtgcagagcaagaccctatctcaaaaatgaaaataaaaattcttttttgctaagttttgagttcagaggtaactctgggtctcagcctgtagatggcctgggagccccagactggacacagttgccaggggagtgtctggaggaagggagaggggcccagggctgaactgggaggctgaggaggggtcctcattggagactgtggccacagtgtctcggagggtggctgagatgtgctcaggtcccgtcaccctggcctggccctgcctgggtggtgacggcctgaagggtctgggggtagaagtggcgttctcttggtcttaatgtaggcttcagttatttttgatctggagttttgatttgcaaatgtgttttaacagctggaagaagcacgccaaattcattctcgttttgaaaaagaatttagttttaagaatgaggagacagcacaggttgtcaggaagcaccaggagctgctggagtgtttgaaggaggagagcgcagcaaaggcagagctggcgctggagctgcacaagactcagggtgagcagcatgaggcctcggggcacctggagcacaggcacggggagcaggcctggcctcactgagggaaggaagccttcagaatagggtttttaaagtgaaatgtaaaaacaaagccaacatgggaggcacccatggtttgggaggaatggggtggtcgggagctgctgcggccagcagggctgttggaggcctacacctgggtcctggaagctgctggctcttagctctgctgctctcaggggcagtggccccgtcccttcctccaagcaggctctcctcagttacacccaggactggctttgtcagagcatctgtgtctcccacaaaggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctggtaaggagcgcgggctgtggagggtggtgcgagctgtggggcgcggatacagctgccacggtttccccagctcccaaggacactcagtgtctctagagggtcaagtgtaaaccagcacgcagcttctcctggaacactgggcatgggaagcttgtgcggatcaggtgaggcatccactggctttgctgccctttcagagaaggcgggttgtctgtcggtcctgctggttggagggtccccacctctgtgaggtggaaataagaggggctctgagtccaacagcagcagctggaggcagagccgagtgcggcaaacaagagctactttaaaatttcatttaaaataaccaagtgcctgatattaaccctcattaggaaaacatagtgttaacaatattagtttgtatcttttcagatttttagatattttagtctcaaaggtatttaaaatgaaaactgtcaaaacataagtttaaaatgtcgagcctgcagggagctgcgtcctcagtagctggttcagctcgagcaaaggcttttcacattgcattcgtgcatctcaggcacgtgggaggcagaggggcctgcgcttctctaaaagttccttccaggatggccgtggcctcggggtcatcccttcagaacacagattggagttagaagcttgggcatcgcaggcaccacctcagccaattcagaagtctcatttattattattattatttttttacatttttctctttagaaaacaaccagcttttgatttttgtggccattctcatttgctgtcttctgtcttgctgatttttgcccttgttcgtgtgattccttgttcctatggttttgtttttgtttttgttttttttgagatggagtctcgctgtgtccccaggctggagtgtagtggcgtgatctcagttcactgcaacctccgcctcctgggttcaagtgattctcctgcctcagcctcccaagtagctgggattacaggtgagcaccaccacacctggctaattttttatgtttttggtagagatggggtttcaccatgttagccagcctggtctcgaactcctgacctcaagtgatctgcctgcctcggcctcccatagtgctgggatcgcaggcgtgagccaccatgcccggccagctcctatggtttctcactgccttcgttgggttggacgcttttggacatgtttgctgcctttcacaggatgtggggttcaggtcgtgcctcctcgtggtgccccagcctttccacctgtggtgctcgtgttgacatctgggtcccacaagcttataattctttggcccagggggcgttttccagggtggaagacattggtcccacgggatgttttaaactctgcctatgactgtgcccacactttgtcctctccttttcttggttcatttctgtcattctcgtttatcccgttctattttttatataaatttctgatgctgaaggattagcctggtgtttttcccctcgtgtatcttttcttgtccttttattttaagtcttttttaatactctgttttagttgtgccttgtatggataccatattcatgactgttttttaaaagcctgtctgtgagtatcttcttttagtcatttagccaagttttatttgccgcacctcctggcgttgggcccttgctcgggggtggattttccttggccagctgtgaagtcctcactgcggtgttgcctgctgccgggctcagggcggcgtcatctccccacgggcctctaagccctgttgcccccgcactctgtgtgtccacagggggagtgcgggggaacctccagggccaggagggcctggagtctcttcaggtcccttcctccaccagtgaagtggtgctggagacatgactcgagatcctgtttcttttcctttgacgccctcgttttcctgcatctcctcaggatttttcagggtgttttcaggaacgtctctgacgtcctgcatcgctctcagcatctttgccctggcggtgctgttgcatctgggcgtccgttgtcgctgtttctccgatgctttctctgcttgtcctctgctgtccgggggcagcctcatggtcgggcccctccctgtagactctgctgccccatttccagtgtcttcgcgcccagccagccggcgctgggccacaccccgccgggggagaccacctggtgtttcatcacctcgagcccttggacttcagccagtcacttcgtttgtcaggcctccgggcagataaaggggtgtgtggcctgcattctgttgaacggcccggtgaggccggggccctgtggctagcgcccccgtgtcaggtgcctgtgtcgtgccctgggcctgagcacgtgggtctgagcactgcagggcttcttcccaaggctgtggtggcccgtctgctgccttgcctctggttcatctcctgccacaaagcctggcccaccagggagtgtcgtgacaggtggatgtgggccctgggtgtccatagcctggctgggctccctgcaggccccaggattgaagctgaggcttaccatgggccttgcagtggcaggcgcctggcatgccgggagtggatctcatggagccctttcgcaggctcgggccaactttgtcactgggaaattctcgttgtttctctggggtcctctttgtttgctttcctttcgacatggttaaccctgccctagtttctcactctggtttgttttctttcctttcaccctggctctgcggttgtgtgactctgcgccagctaccggccctgaccactctcccggcagggcctaggctctgacggtggcgtgaacccggccctggtgtgcagcggccctgcctcgccgtgttgcgtgacgcccccttcgctgtgtggtgttttgtggctctcttcaggtgttgccatctgtcccttttgttctctttgtctccttgaaaagttgatgggcctgcagccgcacaggcagttgtgggcatggtgggcgctgagtctggaggttgttcaaggccagcagcgttgcccagagccctgctgctgacgctgccgtcactggttctagctctcacattctcagctgcacgtttctgtttccacctcagtaaacgcaaactcttgttcataggcacagctgtcactgcagcacacaaggactcaggtttgtaaagacaaacgattgatttgtgtgtgacgtgctgtttgtttgcactggattttgcaaattatttactaaagaaaagtacttcagaccttttgtggcaaacaataaatacagcgatactctaatcttcagtattcataaaaatgggtggagttgtcccattttaacgccccagcaaaacaggagcatttctctaacggtctttactacagtgcctaagctacagtttgtgctgcttttcagaaactgatgtcttgtgatagttacagctgttcttgggctgggtcccagctctggtctccagggagggcctgggccccctggatcccctgtgcctgttcagcgtgggtgtcacctgcttcgccagctgggattgcgatcctcgtgtgcctccctgagtctgcgtgcatgtcagcaggcaccctgccccagtgcccctggccctgaagatggtgatgttctgggccaagcacagcccaggtcgtgtccaggcccagggagtgcagtcaggggagcagctgccctcaggcctcgccgcacgtctcaggttgtgaatgttaccgcagcagcatgtttacagcggactcgccgttaactgctgacagtggcatcaacatttattgagaatgttacttgcattggtcatgatagtttgtgataaaagacttaacacttttacaaatcaaaatgattttttggaagctggtgaaatgtcagttaacatgtatgaatttaatattttagtttttgggtggcttaaagacttcaggattcaggccgggagtggtagctcacagctgtaatcccagaaccagactccatctcagaaataattataataaaatagagacttcgggactcagcagcagagactccatctcagaaataatagtaataaaatagagacttcaggactcagcagcagagactccatctcagaaataatagtaataaaatagagacttcaggactcagcagcagagactccatctcagaaataatagtaataaaatagagacttcaggactcagcagcagagactccatctcagaaataataataaaatagagacttcaggactcagcaacagagactccatctcagaaataatagtaataaaatagagacttcaggattcagcagcagacactccatctcagaaataatagtaataaaatagagacttcaggattcggcagcagacactccatctcagaaataatagtaataaaatagagacttcaggattcggcagcagagactccatctcagaaataatagtaataaaatggagacttcaggactcggcagcagagactccatctcagaaataataataataaaatggagacttcaggactcggcagcagagactccatctcagaaataatagtaataaaatagagacttcaggactcagcagcaggcactccatctcagaaataatagtaataaaatagagacttcaggattcagcagcagagactccatctcggaaataatagtaataaaatagagacttcaggattcagcagcagagactccatctcagaaataataataataaaatggaggcttcaggacttagcagcagagagcccctttttccaagacgctttttcatctgcagtttccacttgggccggggcttcgcaccccaggtctcaggctggttttgctgctggaagagaatttttgaggctaggcgatttatcacagacacacgtttgtgacttacagttctggaggctagaaagcctaaggtcagggtgccagcaggtttggtgtctggtgaggtacccatctctgcttctaaggcagagccttgcacactgtatcctccggagtggagggctggatcatcctggggcagaggcagaagggccgagtgggaggaccactcccaaagccgcttattgaggcattaaaactgctgtgagggtggagcccttgcggcctcgtcaccttttcaaggcccttccaataccatcactctggcagttaaatttcaacatgagttttggaggggacagaaatttaaactgtggtacccagttaattttatttatttatttatttatttgaaggagtctcactttgtcacccaggctggagtgcagcaatgcaatctgggctcactgcaacctccatctcccggattcaagtgattctcctgcctcagcctcccgagtagctgggattacaggcacacgccaccatgtccagctaattttgtatttttagtagagacagggttttaccatgatggccaggctggtctcaaactcctgacgtcgagtgatccacccgcctcggcctcccaaagtgctgggattacaggtgtgaaccaccccacccgacctagattcgcttttgatttaccgatggggcgtttgcctttcccctagacacgtcacaaccccaggctctcagcaccgtccgtcgtctgctgggactgggcttagtcgtgtgtttctgtctgggagactgtactgaaggcagaattcctagagaatcacccacatgtcactcagaagtattcttctcaggcttcagaaatttgctttagccaatgttgttttaaaagatgggcgttttaccccgaattgaagtgacttcattttcggtgggttttgactgaatcaccatcaggagatgcacgtgtcatgcaccagcctctgaggtgcgggggtgtccccgtgtctgtcctgtttgcatccttagctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgtaagaattctgaataatacatttttttgcatcactaaaagttgccgttacagcatgaacttctttccagatcgttacgtaagcttctgcagtaggatgttgaagagggcgccccacacctgctgcacaggtgcacccaggtcgctgactcttggtgggtgtcttcttgcccacatgttgtggcgcagccctctgagggccacctcccatggtcttgccatgctccttctcacagtcacggaggcgtcacttggggcccgggctgggcctgtgctgcagctctcactggttcttgtcctcccacccaccagtctcagacgttcctctgtgttccatgcagagagctgtttttctttacttaactccattttacaaagtgactgtgatgaggggggtatttggagtctgagctgctgggcagttgcacttgtacgtgcagtggaagcctgggtggaccttcgctgcaaggggcacgccagccccgttggggtggtcccaacacgctgcctctcctcccaggagcaggcagccgagcgggagcacgagcgcgaggagttccagcaggagattcagaggctggaggggcagctccgccaggcggccaagccgcagccctggggccctcgcgacagccaggtgagtcagtgcagcgtgcagtgctgctggttgctgtctttcactgtgtttttaagctttaactttctttaaatttttgccttccatgtacatgaaatcggcagcaggcgccgctggatggagaggtgaggaggcgtcaacgagatgggcactccctgcgctggcgcccaggctcccctgcgctcgctgggactgtcctgccacccactcgcttttcttgctcttgtttgggctgcagccatctgctttctcttgtctgaggaagctgtagtaggttcgtttatttttttaaaaaattaatggtggattcacacacagttgtaagaggtaagactcggatccctcgtgcctggcacgtggttccccagaggtctcatccacagagccggaatgcagtgtcacagccagtatgggcagggatctggtgacgctgcagtgccttctgccccccacggaccctcgtgtactgggtcacggccatgccgccgtcctttctcgggcaaccactcatctgtcgtctatttctaaaactttaccatcttcctgatgggtgaagcgtgcctgtcatcttgggggattgacaccattcaccgagcctgactctctggagattgatccaggttactgagtgtagccatagtttgttctttatgttgctgagaagtattccattctttttttttctttttctttttttttttttttttgagttggagtctcatgcagttgcccaggctggagtgcagtggcgcgatctcagctcactgcaagctccacctcccgggttcacgccattctcctgcctcagcctcccgagtagctgggactacaggtgcccgccaccacaccccgctaattttttgtatttttagtagagacagggtttcactgtgttagccaggatggtctccatctcctgacctcgtgatctgcctgcctcagcctcccagagtgctgggattacaggcgtgagccaccgcgccggctgtagtattccattcttttctatcagaatagatttcattttcctaacaaattctgtattatagagaatgcctttcttaacacaacatcaccctatacttcctttagatctctgttcagcctctgggtctaggtctccctgtgcagcctgtgggtctgggtctctgttcagcctgtgagtctgggtctcttttcagcctgtgggtctaggtctccctgtgcagcctgtgggtctaggtctctgttcagcctgtgggtctgggtctctctgtgcagcctgtgggtctaggtctccctgtgcagtctttgcgtctgggtctccctgtgcagcctgtgagtctaggtctccctttgggtctaggggagggcatagggcatctattttgtctctgttgttttgggtacttttttgtttggaaaatgggtttttataaaacattctattgtattcctcaagcattttttgttgttttaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggtaaagcgtctccatgttgtggttgggcacgtggtgaggtgtcccgcaggcatggcttcatcgctgagctggcagggagtgggcagggcgtccttcttcactggcagccaccacgtctgcaccagaaacactggcgtcagggagaaacagaagtcattggtgacgggtagcaagagtactttgacctttctggagattgttgattttatttactgtagtaggatttatacaatttctttatgtctcaagaactctgaatttatccttaatatttcataaagtaaacatttaagattttaggtttaaaaaaatcttagcttattaaatactttgatgagagccccttgtaattgtttcaatctttgagctcaggaactcatgtcagctcccagtgaagagatctccagtgatggttttgcattgctggtgtttgccgtgttgtgtgtgttcgtttgtgtctgagagtttaaagaggggctggagcactgagccaggtgggccatctcatggctggagggggcagggctgcctgtctgcatttctgggtagcggctgtgccctccattgtgagcatttagctaaaaggaattcagctgacttctatgaggttaaaaggttacttgaaaagaggctcagtaagaaatttgattttagaattagtagtttggcctcagacacagatgagaggaggagtctttctcaggtgtgtctgattcttttttttttttttttttttttttgagacagagtcttgttctgtcacccaggctggagtgcagtggcgcaatctcggctcacagcaacctcctcctcccgggttcaagcgatctctcctaccttagcttcctgagtagctgggagcacaggcacgcgccaccacgcctggctaatttttgtatttttaatagagatggggtttcaccatgttggccaggctggtctcgaactactgacctcaggtgatctgcccgccttggcctctcaaagtgctggtattacaggcgtgaaccaccacgcccggccaagtgtgtctgattctcgtaagtgctgatgagaattattaaactggggcctttcctcaggccctgacgtgtttccgttccgctgtcgcagggaggaccgctgagcatcacctgcacttggagcggagttgtccccctggccggccactgcacacatttcagtgacagctgctccagggcggcttcaccccttctgccttcactcagcgaacgtttactgagcttagtagatgccagggttagaaaatgtgtttttatcccttcgtgaaatttggactgtgtatgcaattttatatgtcatgctcttgcgcatgtaacgtattgtgaccattttcgtcatattaaatattgtttgaaaaattttttctaggcaggtaatattcattatatgagcataccatcagccattgccctattttttttggcaagttcttgtcagttttgaaaatattggtaatagtttggtgaatattactgtagataaattcctcacagtggactcgggcacaggctgtggctctcagtcacgtcctgcaccaggcaggcctctgctgggaggtggctgggtcctgggtgccagtgttgcctggtgtgtcactgagtgcaggggcgtgcaggtccacctgctctgcttcaggtgcagctaaagatggtctgtgctttaacaggcagcagttgaggtactgaattcccaaatatttgcctaaaatagagttcttttttttttaataggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggtgagtgcagagtggggccatgggactgccagccctgggtcagtgtccagtgggcttctctgtggcagatccgatgtccagataacacaggcgatgggcttgtgaccactgtgtattcttttcttttcttttttttgttgttgtttgagacagagttttgctcttgttgcccaggctggagtgcaatggtgcagtctcggctcactgcaacctccgcctcctgggttcaagcgattctcctgcctcggcctcccgagtagctgggattacaggtgcacccaccgccacgcccggctcagttttggtatttttagtagagacagggtttcaccatgttggccaggctggtttccaactcctgacctcgggtgatctgcctgcttgagcctctcaaagtgctgggattacaggcgtgagcccatgcccagcctgaccactgtgtattctttgcagttttaccatttgtgtgcgggtacaggtacagggtagtaattgctttaggcatgtgcatttaaatatctcaaagctattttaataatgtcttaattattaatattaatagaatattagatgacttttaatacttttcttcttttgttttaatgaaaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtaagctaccaaaggtccacgtgacgcccgagttcatgttgcttatgccggtgccgagcggccaccaagaccctcatcggggaggcgagtctctggtcttcacagacgcccgtggcccccatgtggcagacagtgcagagagcgcccgattctgcctggggacatgtgcatggaagcagctttctagggatcttgagtgaggaaccagcgacccctgccccaaactgctttctgattgcagcactgatagggatctgaggagaggcacttccctagggcagcaccccagggctgtgagaggcgtgaagctattgggctgttggtggcttgctcttctcaaggaggtgacttgagtaagtggctactcactgtttctcttcccactggcatgatgggaaaaaaatcttaagaacaaatttttttttaaatttttgtgagtacatagtaggtgtatattaaaaaatctatttttaaatcttttattttaatgtagccgtgcttttgaagcaaaaaagaaaaccaaaaccaacctgtttatagtagagatgatattcaaaattgcagagcattcataacttcacagatgcccttgaaagaccttgtgtagaatcgtgtgtgtggtgcccacacaacacgtgctcagtgaatgaacacagcgtgggagaattagtgtgtgtggtgcccacgcggcgcgtgctcggtgaatgaacacagcgtgggagaatcgtgtgtgtgtggtgcccacgcggcgcatgctcggtgaatgaacacagcgtgggagaattgtgtgtgtggtgcccacgcagcgcgtgctcggtgaatgaacacagcgtgggagaattgtgtgtgtgtggtgcccacgcggcgcgtgctcggtgaatgaacacagcgtgggagaattgtgtgtgtggtgcccacgcggcgcgtgattggtgaatgaacacagcgtgggagaattgtgtgtgtggtgcccacgcggcacgtgcttggtgaatgaacacagcgtgggagaattgtgtgtgtggtgcccacgcggcgtgtgctcggtgaatgaacacagcgtgggagaattgtgtgtgtgtggtgcccacgtggcacatgctcggtgagtgaacacagcgtgggagaatcgtgtgtgtgtggtgcccacgtggcacatgctcggtgaatgaacacagcgtgggagaatcgtgtgtgtgtggtgcccacgcggcacgtgcttggtgaatgaacacagcgtgggagaatagtgtgtgtttggtgcccacgcggcgcgtgctcggtgaatgaacacagcgtgggagaattgtgtgtgtggtgcccacgcggcacgtgctcggtgaatcaactcagcgtgggagaatcgtgtatgtgtggtgcccacgcggcgtgtgctcggtgaatgaacacagcgtgggagaattgtgtgtgtggtgcccacgcggcgcgtgctcggtgaatgaacacagcgtgggagaattgtgtgtgtggtgcccacgcggcgcgtgctcggtgaatgaacacagcgtgggagaattgtgtgtgtgtggtgcccacgtggcgcgtgctcggtgaatgaacacagcgtgggagaattgtgtgtgtggtgcccacgcggcgcgtgctcggtgaatgaacatagcgtgggagaattgtgtgtgtgtggtgcccacgtggcgcgtgctcggtgaatgaacacagcgtgggaatgctccctgagtgaacacagcgtgggagagtctcaaaaaacaacaacaataacaacaaaaaaaattttcaaattgattttccatttttccaatttaaaactgtaggcttatttaattaggacatttcatatctgtagggtcagtggaatatttccctattaaggttctgtcggctctgttttgatatggttgttgttattaccatttccaccggcatttctgcccaacaaagaagaggagatagtgcgtgtgaacgagcagctctaggcaccgcaggtttacctcggcgaggtacgccactccctggtgctgggggagaaggggctcttctcacgcttctggctacgcctgcgtctcctgtacgaagtcctcatagtttctgggtgtgattgactggggccttggctttccaggatgacagtcttctgtttcctcatacaatatttataatacttttcaaaattaattttatcagttgggcacggtggctcaaacgcctgtattctcagcactttgggagactgaggagggtgggttacttgagctcaggagttcgagaccagcctaaacaacatgggaaaaccccatctctactaaaaatacaaaaattagccaggcatggtgacacaccactccggagactgaggcaggagaatcacttgaacccaggagatggaggatgcagtgagctgtgattgtgccactgcactccagcctgggcaacaaagcaagaccctgtctcaaaaacaaaattaactttatggccgggcacagtggctctcacacctgtaatcccaggagtttgggaacctgaggtgggaggatcgtttgagcccaggaattcgagatcagcctggacaacgtaatgagacccatctctacaaatttttttaaaaaatttagccaggcatacacctatagtaccagctactctgaaggatgagataggaagatcacttgagcctgggaggccaaggccacagtgagctgtgatcatgccactgtaatccagctgtaatgacagaacaggaccctgcctaaaaaaaaataattttggaggggaccatagaagtaaggagaagtttgtctccagtttgtcacttttaatttccctttgacagaggctactgagatgttatctgtcttagtatctgattgtatcttgtatatttggcaaaaatttaaaaatagccttttgggttacattgaagaatgccttttatggccaggagcggtggctcacgcctgtaatcccagcactttgggaggcccaggcgggcagatcacttgagctcaggagttcgagaccagcctggccaacatggtgaaaccccgtctctactaaaaacacaaaagttagctgggcctggtggccggtgcctctaatggttacttgggaggctgaggcagaagaatcacttgaacccagaaggtggaggttggcagtgagccgagattgcgccactgcactgcagcctgggcgacagagcaagactcgtctcaaaaaaaaaagaatgcctttaaaaaccattgattacttttcagaagaagttgtattatttgtctatagtgctctagaacttgacctctaactataatcttatataatgaaaaatatataaaaaatagtttacatgttaaggacagtatttttgttccattaagaattgaaagctttttaaggacaatccccaatattttcttgtgggatttttcttacagatatgtgcaaattcgtacatccttcattttctgtaattctcctaattttttgtaaagatgcggatgctattttgctttatataataaagaaaagtaaaattccatttaaaggtttgactcttgttaggtttccagttatttcaaggaaaccacatttgctgtattctaccctattttatgtcagtgaagatgtttgtcttctagaagcgtcttttacacttgtggggaaacggagctcccgtctccctggcgtggtcgtggttgttgtcacttgttctgtactgccgtcctccggggctccagccatcctaacacctcatcctcaatgtgggccctccctccctgtgtggcttattctaactctggggttagtgatgtttctttaattttaccatttacttctcccttattctacaggttttaataaagaggtctcacgtcttttgttaaatttatccttaaatattttaggttttttgcactattgtaagtgagatttaaaataattatctagttgtttaccgtgaatacacatacaccttttgtatgttaaccttgctgttaccttgcacaatttatgtatattagtagcgttttgtggattcctgaaggctttttatgtataagataacatcatcttcagataaagacagttttatttctttccaatttttgttatttccttcttttattacaatgtctagcactcccagtacaaagttaaaactggctagggcagtcatctttgcccagctccttgtcttacagggaagtggtcagtgttttgccattaagtatattagctttaggtttttcacaggtgcctttttatcagatcaaggaagttctgttatatttctagtttgctttttctggatctattgaaatagtgatgatatttttctcttttattctactaataaggttaactttattgagtgatttatttcttggagattaaactaaccttgcggttctaggataaaccatacctggtagtgatgtactgcccttttcatatgttacagatattactgaatttgatttgctaatattttgttaatggtttttgcatctgtgttcatgagggatgttggtgcataattgtcttttcttgcagtgttccctaaggctttgtatgaaggttatgttagtctcataaaatagattgggaattttttcactttcttttctgaaagaggttatttaacatagctgggatttcttctttgaatgttttcatagcatcaacaatgaagccatttggagttttatatctagagagattgatggtaattaattttctttaacagactgaggtatttggatttctgtttcatgttgtgataagttgtatttttcaaggaacttgtgcatgtcatcaaaattgtcaaatttctttgcataaagaagtttatactttctctttttttttttttttttttgagacggagtcttgctccgtcacccaggctggagtgcaatggcgcgatctcggctccctgcaacctccgcctcccgggttcaagtgagtctcctgcctcagcctcccgagtagctgggactacaggcgcctgccaccaggcccggctaattatttttgtatttttagcacagacggggtttcaccgtgttagccaggatggtctcgatctcctgacctcgtgatccgcccgactcggcctcccaaagtgctgggattacaggcgtgagccaccgcgcccagtctatactttctcattttgtaactgttcaccttattaaccatttccttacttgccattgaatatctgcaggttttatgctgatggccctccttttattcctgatattagtgagttcgtgttttctcttttattcttgagtctgtctagctagtagtttatccatgttgtcagtgttttcaaagaatcagcttttggctctgatacttttctctctttatttctttgatttctcctcttattttcattattggcttccttctatttaccttgggtttattttctcttctttttctagctttttcagatagaaccttaggtcattgattatagatacttatttttcagtataacaatttaagttttttgtttttagacttcgtgcatagtaaaattagttttttttagtatacagttttataaattttgaaaaaaggatttagtcctgtaataatcaccacaatctcatcactcaaaaaattttctttgtgctgtttctttgtggccacccatcaggcctgctgtcttcctgtctggaattctgtttcgagtcaggtgttgtaatgcactggaaattgatgcatgctgtcgcctgtgtctgttcctttagttgctgagtactgttgtctggatggaccacagtttgttgatccattcacccatcgagggacatttggatagtttctaggttttggcagtgatgaatcgagccaccataaactttcatgcatagctttttgggagaaaataaatgttcacttctttcggttcagtacttaaactgaatgcatggctgattcatgtgtaagtatatatttaaccttaaaagaaactgtcaaactgttttctatagttgcactaccgttttacattccaccagcaatagatgagtgttccgggtaaccacgttctcatcaacatttggtaaggtcagtctttttttctagacattctggtagatatgtagtggtatatcctagagttttgtatttccttaatgactagtgatcttgagcatctttttctatgctatttgccatccatattgtgggggaaatgtttgcttaagtctttcagaaagtttttttttttttttttttttgagacagagtctcattctgtggcccaggctgcagtgcagcgggaacgtgtcagctcactgcaacctccacctcctgggttcaagcaattctcctgcctcaacctcctgagtagctgggattacaggcgccgccaccacacccagctaattttttaatgtttttagtagagacggggtttcatcacgttggccaggctggtctcgaactcttgacctctggtgacccacctgcctcggcttcccaaagtactgggattacaggcatgagccaccgtgccccacctcagaaagttttaaaaagttggattgttcggtttcttattgttttgggaattctttatatcttttgaacgcttttttttgatacatgatttgcaggtattttctcccaatgtatggctggtcttttcattctcttaacagtatgttttgcagagcaaaactttttacttttttttttttttttttgacagagtctctctctgttgcccaggctagagttcagtagcgcatttttggcttgctgcaacctccgcctcccaggctcaagcagtcctcctgtctcagcctcctgagtagctgggattacaggcacctgccactatgcccagctaatttttgtatttttagtagagacggggtttctccatgttggtcaggctggtctcgaacgcctaactcagaagatccgcctgccttggcctcccaaagtgttgggattacaggcgtgagccactgtgccccgccagattatacttttgaagttctgagagctctttccctagcccaattttcctgagaaatttcatagttttactttgcattcaggtctccttgaatatgcttgcatacgctttttgctttttatttttcttttttgacactatcttgctctgtcgcccaggctgcggtgcagtggcgcagtctcggcttaccgcaacctctgcctccagagtttaagtgattctcccacctcagcctcctgagtaggtggaactacaggtgcccacgcccggctaatttttgtatttttactagagaccagggtgcaccgtgtcggccaggctgatcttgaactcctgtgctcaagtgatctgcctgcctcagcctcccaaagtgctggggttacagacgtgagccaccgcgcccggcctcagttcactgatttcaggttttggtgttttacatttagagctaccttcgtatgctggctccagtattttaacgtgatatatgcgttgtgattatgaccgtcttcagtgcgcaccccttgattccagtttatttagtgcatttagggaatgagcagaagctgcgtataatcagaattgtcctcgaaattccttcgcgtgcctgtagagtacagagacaacggccggtgccgcacacagtaaggcacgcgacggggagcagaatgtgcagcgggcattcctagcccgcagctgggaggctgcttttgctaaatgcatggtgttgttcatcggtggtaaatgcataggaaggtgttgttgacagcgtccaaaccaaagccacaggttcatccggttcctttgttttttttctgtaggccagatttgcatttgagtccagagtaattgtgaggtagttccagagaaacctggagttgttatgaaaccctcagttttttggaagaacatattagtctataacaaatagttttaaaattgttagagcacaaatggattagaatttttctattttttgtcattaccaggaatgttatcttaagagaatagagtttggagctatattgacatacatctcaatcctaattttccacttactgtttttatgggtttagaaagatgtttaatatctcagtttcaattttcctgtctttaaagtggaaacaatcgtatttccttacatggctgaggattatgtttcatggcacaagtaaactcacttcgatgcctggtgtcaccgagtggcagtggcagagacgcctcatcaccagcgtcaccacgagcagtgttgggatggaaggggagcgtgcccggctcaccgctttgttggtgcagattctctgcctaggtttcttactttcctcctggagtcagaatgacacctaaaatctaatgcaccttcaggaaaatcaaacaaatcaaagttgtttaaatattaacaaaataacatttaaagggtggtgaaagcatcattctgtagatgtccttgcatggaaaatgactgcattagagcttcgtcccacgatcagacgtggagcacaaggtgtgcaccagggcccagtggcagccaaggtgggtgtggagtgcatccggcaccagcagtttgcttctatggctgctttgtttttcacgctatggagtcttcactccaagaatgcattcaggatgtaacgtgccctgaagtagggacattcggaagtggatacatttaatttgcctctgaaatgtcctctctcttcaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacaggtgggctccccccgcgggccatggcagggtatttttttttactctccttttctcctttgatgtcaatgacttctctctgcgctgggcactgggggctgcagttgtcatggtggctcatgacacagcggagaaagggggcctgaagctcgggccagcctgggcctgttccgtgtcagtacgcagtgaagctgggctgaggatttcactgttttgtaccattttaagcttatcgttttaagcttttaaaaacaattctttctttcacataatagggactgtccagtgaaacggagctcactatgtgaggagggtccgcttaagctgcttctctggtttctaaccaaatggtttgtctgtcgatgagcagtgcctgtgtgagatgtggcgagcgagctcttcttttggagctggaggccctgtagggagtcgtcttttaaggcttccacttgtatttgagcagaaccttgggaacttggtgcctaccacccccacaccagctgggtctttgtagagtggctcccactctcagatgccccagtccaccttgctctgtggggtcgtcctgggtcggggcagctttctgctgggtcctcagccccgttcccatgtggcctgctgtggaccaaggtgctcggctgtggatgtcactgccacctccctctggcatccctgctggctgccgtactggttcccagctccaggccacctgaggggcagccccagcaacagcctcctgcatgctcagctttcctctgtctcctctgtcaagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaaggtgtggggaggggggaaggcgcgaggtccccccgggagaggctggacacgcggcagcaaggtgtggggagcggggaaggcacgaggcccacccgggagaggctggacacgcggcagcaaggtgtggggagcggggaaggcacgaggcccacccgggagaggctggacacgcggcagcaaggtgtggggagcggggaaggcacgaggcccacccgggagaggctggacacgcagcagcaaggtgtggggagggggaaggcgtgaggcccccctgggagaggctggacacgcggcagcaaggtgtggggaacggggaaggcacgaggcccacccgggagaggctggacacgcggcagcaaggtgtggggaggggggaaggcgtgaggcccccctgggagaggctgggtgcagaacatgtgggtcttgccctgggcagaggcgggtattctgctgaggtgaggagcacagtccgtgcctgcagtgacatgttctctgaatcctttctgttctgtaacgagctgtccataactgttgtgaaatttcgtacgtgcttcatttaagccactctgtagaaacaatcagttgggtttttttcttgtaattgatccaaatggatttaactgtgctcgagggttagtcctggtttgtcttttcatgggaggaccacatcgcccccgtgggcctcacctcagctcaggactttgatggccagcgtctgttttactttgaaaggcctcagatttattcttgtaatctgttcacctcactccatattgtcacttgaaaaaaagctggcacttcttttccccggggaaggaggttgcaccttgaccatctcaaattgtagcagggtggagatttagcgagaaaagcgggtgctggtgcttctcccacccagtgcaccaggggcaggtccccagtgcccctaggaaacacctgcgcaggagctgccctctcctcaggccgcatcaggtgcagatggcacctttattttttttctctctttttttttttttttgagacagagtcttgctctgtcgcccaggctggagtgcagtggcacgatctcagctcactgcaacctctgcctcccgagttcaagtgattctgcagcctcagcctcccgagtagctgggactgcaggcatgcgccaccacacccagctgatttttgtatttttagtagagacggggtttcaccatgttggccaggctggtcttgaactcttgaccttaggtgatccaccctcctcagcctcccgaagtgctgggattacaggcgtgagccaccacgcccagccttagatggcaccttttgatgcactgtctgcacctcgcctcctccagtccaaggcccagcgcagcctccctggacacacagccacccacccttctcctccttctcctctgggacacacatctgtccaccctcctcctcctcctcctcctggacacagtcgcccaccctcctcctcctggacacacagccgcccactctcctcttcctcctccttctcgacacacaaccacccaccctgctcctcctcctcctcctcctggacatgcagccgcccaccctcctcctcctggacacgcagccgcccaccctgctcctcctcctcctcctggacacacagccgcccactctcctcctcctggacatgcagccacccaccctgctcctcctcctcctcctggacacacagctgcccacactcctcctcctggacacacagctgcccaccctcctcctcctggacacgcagccgcccaccctcctcctggacacacagccgcccactctcctcctcctggacatgcagccgcccaccctgctcctcctcctcctggacacacagacacctaccctcctcctgctggacacacagccacccaccctgctcttcctcctccccctcctccctgctgtttgctaaatgtgccccaactactcctccaggctctgaaacccagaggctctaacaccagaagtgctgggcaggtgttttatggtctctagggtggcacggaagcatgcttggtgctgaagcctgctgagacctgggctcacccgagcccctcgcagccctcgtgagtgtcccgcacgtcgctgggacgtttcttgcatgagtgcaggtgccgcctgttcctgggtccacactgcgtgcacctcattggcgtttagagcctgaaagattcttaattccacagaaatcagggaaggatgggcctaggcccgcagttctgaggagacccatgaacctggttcgtgtgcttgtcatgtgctctcgggaaatacatcctgtgtggagagcccttcgcatctcctgcggcaaacagtcttggggccctcatgacaggaacgtttctttgaattttttttttttttttttttttttttttttgagacagagtctcgctctgtcgcccaggctggagtgcagtggcgagatcttgagatcttggctcactgcaacctccacctcctgggttcaagcaattcactgcctcagcctcccgagtagctaggattacaggcacccgccaccatgcctggctaatttttgtatttttagtagagacagggtttcaccattttggccagggtggtctcgaactcctgacctcgtgatccacctgtctcagcctcccaaaatgctaggattacaggcgtgagccactgcacccggcccaattttttgaattcttaagagaaagctcagccctgcctgccaaattcttagaagttacacacacagaaactccaaattcatcacataaaccacaattttgtgttttcggtgctcagatatagaaccttcccatcctttttcccttgtatgaagcttgtgtcctcaatcaccgcagaaataggttatgacagttgccttttaagcaaggagatgtaagccttggttctgtttctcatagaattaaataaacttgaaatgtgcagggctcattgtggaatcacccgagtgctccgaaactccctgaaatccactcattaacaccagacaggtgcgactcctggtgagccaggtattccaccgtgcacctgttctgtttcacctgcagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggtaggtgcctgctctgctcccaggcctgctgttcccgtgggaatgtggtctgcccggcgccacggcagctgccattgtttgttcacctcctgacagcacacacctcgcagtgctgtgtggggccagctctgcaggactggcatcatgggcgcatttagattatttcagttgttcaggtatttttaaaatgcctgagatgcatttgcctgcctcagacataccctgggcatgcttctccactgacgctgactccaacgggcatagcccagacacgtcttcgtgtgtgatgggcatagggttctttgtccagaatggttttttagatttatttttaggaatgcttcctttttttttttttttttttttttttgtgagatggagtctcgctctgtcacccaggctagagtgcagtgacgcaatctcggctcactgcagcctccgcctccccaggttcaagcaaatctcctgcctcagcctccctagtagctgggactacaggcacacgccaccacacccggctaatttttgtagtttagtagagacggggttttaccttattggtcaggctggtctcgaactcctgacctcatgatccacccacctcagcctcccaaagtgctgggcttacaggcgtgagccaccatgctcagccagaaatgcttcatatttttaacaggtttcacatatgctaattaattttaatttatgagttagatcgtattatttctaacataatcattttgggattttgtgtatcttgagtaagataaaattaaaaatcaggtatggttgggctcatgcttgtagtctcagcactttgggaggctgaggcgggaggattgcttgagcccaggaatttgagaccaggctgggtaacacggtgagaccctgtctctacaaaaaaaacacaaaaaattagctgggcgtgctggtgccgcccatggtccctgctcttcaggaggctgaggcaggaggatcacttgaccttgggaggttgaggatgcagtgagccaagattgaaccactgcactccagcctgggtgacagagtgagaccctccctcaaaaaataataatttagcagatacatattatctgaaacatccatatactatcatttcatgcaaaacaatttaaatctgaaatatttactattggctacattaaaatattcctaaagagctgtgggtgaatctgattaaattgttggaagcattcgacctgtgtgttcaccagttttgagttgtttcatctggggtctatgtgggaagataaattcaggcctttgaaagttttcacctggcaaagtcagcgctatgatgtaattactcattattttatgaccatttaaaaatctcttaacaggagaaagatgtcgaagattttatcacaacatcctttgattctcaagaaacattaagttcacctcctcctggattagaaggaaaagctgatagaagtgagaaaagtgagttggttatctttcatttttaattttttatttcagtggtttcctagcacagaatagtcaaaagaattcctgcatcctttgcctggttctgcgtctgccccccgctgacctccaccccggctctgcgctttgtcgggcgtgcacctggggcctcttgacttctgaaaacacgcctgtacctttcacagagccaaggttgctggcccgggccacgctccaccctggaatgttcaccctgatccaaggctggcatctcagctacagctacagaccttgctcagattcacccattgtcccagtagtgtcctttatggaaaagacaccccagctcacaggctgtgttcaggtgtctttggcaggatggagactggggcggtgcacgccatgtttccaggctctgctgccttgcctgcccaccctgcctttccctccccttggggtggacgtccctctctctgctgtgggtttcggggcaccggccctggagaggagccgaggggccgctgactgtggcgtgtcctcgcgatggtgcgtggggggctgcgtctccccggacctcgtggcgggaggtgcgtgggcttgacttgggcctttgtctgtgatggtgcctgccaggtttcctccacctccttctgtgggagatgcggagactgagtattctcttccctctcatgctcacgcccactggtctcagcctcccttggttgccctggcccgcatcagttgttgtggcggttacctgccacaccgtcctttttttcatttcataactttttctataattgttgtctttttacaagtcagtcaccttttgaggtgctctaactttttaaaaaatctgttggatttttcagcgatttagtgttttttgagaacatggtcacaatttaattagaaattttagtatttgcagagtagggccagcagctttttaattttgtttttatttatttgatgaatagtgagcacgcagggtgacagttatgggtgctgaggggaccgtttcctgagcagcctgtgtcccagctccccactcaggactgcagctccctggggatgccacattcaactctcagaaatgtcttctcgtatttgctttattttcaaactctatttgctgtttaaagtggcatcttcagccctcctagcccctcgccacacgccccttgctacacgaggtgcagtctgcacgccctgtgctgtcacagccaaggtttgcccttaaaggacgcgccccgtgttccagcagagccgctgggagcgtgcgtccccctcgagccacttttgtttttcttggctcagtttctcctgtgtgcttcactgctgtcctcgcacacagtgtccaggtgaatgtcatccaagccttccaagcacagcaggtgcttccccaacaactctcaggggctcccaggcggccccttgcccctcctcaacggtctcttatttaccgagacagggtcttgctctctcacgcaggctggagtgcagtggcgtagtctcgactcactgcagcctccacctcccgtactcaagtcatcctcccaccttagcctcccaaagtgctgggattacaggcatgagccactgcgcctggccagccccctcttttttaaggaaacatgtccccagaagcctctgtagaaaaggtgtctggtaggtgcttgtttttgagaacttcctcgtctccctggtggttgtcggttggttggctgggtgcagacacttgggttggaaggtatcgcgtgcctgtccactgcctctgtgcccgcgccctccagtgacgcacaacctttgaggggcctgcgcggtcagggtgtccgccgcctctgtgcctgcgccctccagtgacacgcgaccttggaggcctgcgcggtcggggtggaggatttcctcctcgttcgtccttcctccattcacgtatcctatgattttctctcttctttttgtaattcctgttattcaactatatcaggcctccaagattgattgtcaaattttctttccttatttctacttcttttatttttgttctcatttctaagaggttttctttagaactttatttttcaacatttgtgctgagtgttctgtttctgtgctcatattttaaatttctcagaaatctttcttatcctaactgttcctctctcctttagctttagctccttggtttctttcttttttggagggcgttcttgagtttattttgggcacagccaggtgagaggtccctgcacctgaaggaaggtgttgggctccgaggtgaagcatggtttgtgctgaaggcacagggtccagtgggacaatggggaatgtggtcttggacttgtggagctctgaccacccgctggcggcacctgctggctgtgatctcctctggatggagtgggctggggcatggtgctgggcacccatgtctcggtggcactgggtgacagtgtccgcagcagtcacatcccagagttcctggtacacgctgtgggagccgcagctcaggcagatgcaacatccttcaccctcagagatttctcaaacacctgaagtagatgatttccccaaagatttcttcgttgtcatctttagctgagatacacagggcagaagtaggacttggcaccattattagacacaaagatttgcaggcggtgggtggcctgaggcattttgaggggtacaggcagcaacccagcaccctgcacccttgcactgctcctgaggccttcatgctgctctctcggcacttgccgccactcacaaaaagcactttgttggttcattttgtgaatgacgtgcccgttatttctctgagggggtcatcgtcatcctctgaggttgtactctgcctgcatcgttggcctctactcctccccagtgtgccctctgctcagcaggctgtgccggggcatcatcccccaggtgcccaagtgctgcagcctccgctccccagggagctttgtccacacgggggccccgtctcgctggcatcctcatcctcctgttttgaagtctaacaccctttttccagggcgcctcctcctcgtctgggtctcgtgtcccttacacgatcctgcctcagtttccaaagcgcccccctccctgtgggctggcgcagctgcaggtctctgggatggaccagggccctgggaggttttgaattttcctccttgagaccccatgcccacctgacacaggagctgcaccgcagggaccccatggcaggcacggtcagcgtttcctgagcagtcattggatgcccgtccgctgcctgccttatctccgtggctggcgtggagggtgcaggccccgcacgtcccgctgctcttgagcttgcccaggccatctgggttttgtggagtctttgggggccacgtctggagaagtgagcagaggtcccctaagattggcgctggaatcagggactcaggtgatgttctcaacctgtgaagttgcgttttcttacttgacgtgcgtctttctcaccagggttatgtttttatgaagcatttttggggccatcagtgttttctccgtgagcagaatcacggtgtggttgtcgctggggactgcgggccgatcacccctgtcctgcctctgcagtgcgtcccctggggaaccccctggagagctgtgggtgggaccctgaccctgtggtgtttttaggtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggtatggctggcaggggcggccctcacagcttcacatgtgcagcctcggggcatcccccaagccctgtgtcctgccttgccggggagagccttggagggccagcttttcctgggtgcctctgagcacctgcattttaatgactcacgggaggcagccccacggtggccccggaagccgcccacccagccctgcactggccccttaggtggccgcctcccatctgggcagggagggtcctgtgagcccgtgggcaggtggtgttgccccgagtcgcagagccggcctgtgcctctctcccgcctgtgcctccctcctgcctgtgccctgtagagaagccgaggcaccagacgccgcagtgctctaggactgagccgagttctcttcagacgatgggagagaagccactcagcctccttggaatcaaccttgaaggcagaattttgtggaacttttcataggttttctttcctctcccagtttagcagatcattttatggcaaaaccattgacaaaaacttggctaaacaagtgagtgatagaatgatgccactacaggagcttagtcaagtggtaaacatattcccaaacaaaacagtcttcacatcagtgaaacctcttctgagactgcgcagtaagtcctcacttagcgttgccccgaggttcctggaaactgaccttgtaggaaggacactcctgtgctgctggccgcagctcccgttgtctcagagggccctgagggtgcctttgttacatgcgtttaaaagtcgcggtttccaaaacccatccatgacgttaagtgaggacttactgcattcagaataaaacttgttttactttatttggctgggcacggtggctcatgcctatgatcccagcacttcgggaggctgagacaggaggatcgttggagcccaggagttcaagaccagcctgggcaacatagtaagacccctctctgtcagaactgagtcagttaaacctctttttttcattaaaataaaaaaacttattttactttcttaaacatggaaattggagattttttttttaatcagttttttatatcttctttgcatttcctttttttttttttggtgagacagagtctcactctgtcacccagcagtgcagtcacagctcactgcaacctctgcctcctgggctcaaacgatcctcccacctcagcctcccaagcagcttggattacaggcgtgagccaccacacccagctaatttttgtattttctgtaaagatggagtgttgccatgttacccaggctggtcttgagctcctgagctcaagtaatctgcccacctcagcctcccaaggtgctgggattacagtgtgagccacagcgcctggcctcaaatttttatacaatataaaacgtcaaggagatgtttctgttagtgtttcctatggaaaacaacctaatattagaattcctgatttttaaggaataaatttgattaatgttaactcttcatacttaggtttcataatttaaaaagaaaagcacaaaaggcaggaaaggcctcctgtagcccttgaggcagcagctgcgaagcagaggaggagggggagaggaggaggaagagaaggggagggggaggggaagaggggaggaggaggaagagaagggagggggatgaggagggggaggggaggaggaagagaagggggagtgggaggggaggagggggagggggaggggagaggggaggaggaggaagaggaggaactgctgtccagggagcacctccagctttgaaaggtcccaagtccagttgaaaatcacaaggagtttttttcatggatgtctcagactgtttcaaactcagggttttcctttattgtcttaatttctggcctgtgttttagagtgtggagccctggggttgtgcccacactgacgccgcagtggggaactgagtggagctgggtgcttgccccacttggaggtggctccaggcgcgtgggggacacccactgctcagatgcagccacagacgccaagagtgtggtcgacgctctaatagcccctgtggtccctatgctgaggaggctgagaggtcctgagcacgggtggggccccggccactcttggccacctctggccgtgcctggaattgagccataagtgggcagggtaggtgctggagctcaggaaatgaggactcccctgcctccgccgctgccaccaccaccactgctgacaggcagagccgcctggtcctgagtgtggagatggcagaaccttctcagccctagtgattgtgtctgtgggaccccccaggctgcctcacaggccatgttctaaggtacccactggtctctgccccacttcccggcctcacgggaacccacctgcaagggccccgtgtcacctggcgggaagctgtggcccagggcctctgcatctcttctttgtaagagatgttttttaaaatgcattttctcctctatacagaatctagaaaagcatattaaaaagaaggaaatggcctgtcctctgcagctggaagagaggggccaagcagcttcagggcctgcccgccgccctgctcccccggccctgctcccactgcgccccccccaaccctgctcccccagccacggccttgctccccccgtctccgctcctccccgcaccaccccgctcccctcaaccccaccctgctctgccgcagacctcagtttgcatccatcctgtgccacatacgttatgtttaaagtaaaagtgttttcagttgttagagatgaacatagtgtgcaatttggtttcacactttagtgttaatatttgaccttttttggcatatcgttaaaattacaggaaagcctattttcagtcagtcacacccgtcgtaggcttcatcattgcctcattttgcatttccctctttttggactttattagattatttttctcttcaggtttttatgcagacgtgtcctgtgcttgggtgtgtgctcatgtggtggtgaccgcgctgagcctctgggctctgggctctaggctggtcgtgacaccagcttctccatagggccgtctgcttacccctcagcctctctggcgagacagtcaagtgtgtgtccggacaccagctgctgcgtaatcggtgggataaagcagccgcctcgtgttcacagacctgtgggcagggcctgctggggatggttttctctgctccccgtgcccagcacaggcagcttcaccccacgctggtggtcggcactggcctcagccggaccacgcacagaggcctcctgggtggccatcgtgtggccttctcgtagcgtcccaggtgggcagggagtgtgtgatatgtttgtgatctcgctgtggacattggcctaaagccctgccctgagctttgtccaggcttaggcgggggacggtgtccccctcagggagcaggtggagtggaggaagtggcggggccatctttggagtggcttatagagaaattcactccaagcctggcttccgtgttgtctctctgaaggtcgggagaggtgggcttgaaaaccttgtagcttgagaagtgggtgccgcctgtacgaagccgaggcggtgccctccctctccacagctgcccgcccttcacagagtcctggcggcagctcggggccgcaggtggtgtagagcgtggctgtgtggggtggcaggcaactcccttctgacgcgctttcccgccacaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggtttattttgcccttcacacacttcttttccaaaggatttaaggagcttgtggtaatggccgcgtccttagggccacgtggacactaggatttctttctttttttttttttttttttttttttttgagactcggctcactgcaacctccaccaccccgggtcaagcagttctctgcctcagcctcccgagtagctgggattacaggtgcatgccaccatgcccagctaatttttgtatttttagtagagacgggctttcaccatcttagctaggctggtcttgaactccagaccttgtgatccacccgcctcagcctcccaaagtgctgggattacaggcatgagccaccgtgcctggcctaggattttttttagcacggccaaaaagactgaggtccaagaaccctggggaggccttcccatctcccacagccagcgcaggctctcggggcaggttccctgcgggacgtggaggtgtgtggggggcagaagggctcagggctttcaggcctgtgccctgtgtgagcctgcggggaggctgagagtggtccctcctggccatgtggccctgcggactcggcccattccagcacttgtcccccagggcctctcctcctgccactcgggtgacttgccctccggcctcattcctccccttgggtctctcctacctccccctccacaccccaagccccagcaactggacctcagggcctcacctctgtgctgtcgaccccgcaccccacttttccccaagtcctccccatctccctgcctgtctgcttccatcaccagggcttgtggaggttgtggagtgggtgccaactcccatcacgctccctcccatctccgtgcccaccctgtcctgcccctgtgcctgcctctgactgggatcaaagctttgtgagggagggaagggctttctccctgtgcctggaacgcacagggtgtgctggtgccatggagagccggtgggagggtcagccccacccgcctccgctcgcccctccagcaggccctggttgtgtgcgagcggcagcctggctggcattcaggaggctcattggtgctgcacgctgcccctggggaccagcgggtagccccttgcagccttaggtcccctccaggccctgggccttgaaggcacagcagcaggaaaagagggaaggagctttgctgacattttcctgaccttactttatcgtctttttcagtctcttctgtgctcatgatggcagcctttgcttctcgtgccttgaatggccctgggcagtgtgtgtcttctcttctgtcagggtcatttctgtttgaacggctgtcagtctgctcagctgccgtaacagaacaccccagaccagggggcttaaacagcagacattgatttcacctgttgtggcatcagggtgcccacagggttggattctggtgtaggcgcccttcctggtttgcggacagcgtctccgtgctgtgtcctcatatgatggagacagcgagtgagctctggtgtctcttcctcttcttaagaggcctcatttaccctgaatcacctcccgcaggccccatctccaaacgcagtcacactgcgaactttagggcacaaggatgcaggtgcatttgtgaggacgccacgtttcttccttcttcctttaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcaggtgagtgtcagctctgccaccaggcctcagtttgccccaggggtccagccctggcagagagggtgacacagactgttttgtgtgtgaatttcggtttgtgtgtttctctcgaccgctggaatgtggctgtcacttacccaggtgttgacgctcagtccatgcaggatgctgcacttttccacctgcagctgtaacaggacaggtgtgctcgagatgcaccctcaggcctcactcttttctgagataggtggctaaagaaacgttctccattccaagtagcccctcctaggttgagaggtgctctgtgtgcagggctgggtggcgttggtgccgtggggacactggaaatcctgttcctgccagcatacacgaggaaacctagtgttgagagtaactggcttgcaggcctcacgcagggtagtgcagcccagccctgacgcctgcaggccccagagctgaggcccagcagatactgtgcacccatcccagactcagcaggcttgtcccggcggagctggttttgagggcgggcagcagggaaggccggggcatggggtggctgcccaatgctcaggctgcttgtcccattgtgcccccagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcgcagaggcgcgcgggagccagcaggagcaccagctgcgcaggcagggtgggtgtcactgtctacactgcctggggcccggcctctgcacctgcccgcccgacactcacctgtgtggccttgggagcagagggtggtgacagggcatcatctagtcaagcccctgagtgttgccatggttgtcagctgataggactgagcagaaaggaccctggagacaggcagcgctgggtggggctggcacggaggcctcactcttgggcctgatgtgggcaagaggggcctgggttgggctctgagtgctggcagattcttgggagctcatgctagagttcaggaatgtctcgtaggtttctacatttaatttagcttcttcgggagtttttatgtagatgctcaggtcatctgtgggtaagtaacgattttttgtttcttgcccgtgttctctcacgtgctgtgccgtcagctgtgtgggcagatgccattccctgctcttagttttgggggcaggagctggtctcgtaccatcgcatgtggggtcaggcgcccttggtcagcttgggcaagtgccctctgttcctagttttggattccgtcaaggggaacggccttgcagttcagcccacggcccttgtcccggcgcccatgccctttgtgctctctggggctgggggccggcgctgtgcacatgctcgtgaggggcatgggtggggctggcgctgtgcaagcgcttgtcaggggcatgggcggggggtgccggcgctgtgcgagcgctcgtgagaggcatgggggggctggcgctgtgcacgtgctcgtgaggggcacgggcagggggtgccggcgctgtgcgagcgctcgtgaggggcatgggggggctggcgctgtgcacgtgctcgtgaggggcacaggggggccggcactgtgcgatcgctcgtgaggggcatgggggtggtgggccggtgctgtctgagtgctcgtgaggggcactggtctgttttctgttgtgcctttttggtcttggtgctgggtagcgccagccccacggggtgcgggaagtatttgggaagtagcccctccgccctccgttgtctagaattggggttatttcttccttaagttttgggagaattttccagtaaagccacctgggcctggagttccctctgttggaggcagtttagggtgtgagtgggggtgaggtggcatttttaggatggccccagggctatatcactcctggactctgtgtctcccggccaggtgggtgggccctggaaggaaatgggcccagagggcagaattgagcatcctggttccacccgcagtgaaagcttctagtccacagaacctcctttcttcccgaagcacatacacctcacgcccccacgagtctgtctctaacctggtgtcacttgtgcagcacgaggagctcatgggggcctgttactgttcttttgtctttctcagttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgaggtgcgcctgatcccccttcctgggacactggcgggagtccccccgttgtgccatgttttcttggtgatgaagggagacagaacctctggtgggccgcagttgggcagccccaggggcaccgcgccctgctgtccctgggttgataatcctgtggtggggggtgaagcacacgtgtgggacctggcagggctctgcctcccctcctggagctcccagcccccgggaacacactctggcccacgtggtcagattgttctgcgatgtctccacgcagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggtaacagggtgtcagggcaaggcagccggcatgggctgtgtgcactggaagcctgaagccatgctcctctttcatccttcttttcctgttcttcatggcagtgcacccagttgacagcagtgtgacgtagcaggatagggctgtgtttgcaggtaaaattgcaccttggtgtagtggcagccaccacagggcgaagagtgcgatgacccgtggtggcacgatacccctgctcggagcccccccccgtccctgagcacttgctgtggagatggacacagcctcctcgctggcatccagacagagcacagcctcagaggtctgtgcacaaggcaggctggtggtggggcctctgctttgcatggcggaggcccagcaggcctgctgtggcttctgagcaagtctgtgccagttccatgggttatggctttcaacagcatggaagtggtggttcctagcaagctgggtgtgtatctctgagcctctggtggagtgattttctgaagagggggcaggagcctctggtggagtgattttctgaagagggggcaggagcctctggtggagtgattttctggagagggggcgggcaggggacatctctgaatcattttctggagagggacagactgggaacatctctgaacccaggactcaacaccatttccgaaaaaagtatgtcatctccgcagtctgggttttttgttacttgatgaactaacaaaaaaatgttgtccctacatgtggctaatagggtgcatttcaaaaggtagaattgctgggctaaagtatataaacaaatgtggacaggaaaaccatgtagacacttttcctcttgattcagtgtctcccatcgtatgtgtttgctgtctaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctggtgagagccgcctgccggcggacgtccacacctaaaaacgataagcaattggagttaggatggttcacgtgggggacgcgagatttatgtctggccctctgacctggtctgctctggtctgtgtgccctgacgctggcaccacactgctgttactgtagctttctagaaagtattgaaatcaggaagtgtgagttctccaacttcgttcttcctcttcaagatagtttcagctctgtggggcttcttgctattccacaggaatttgaggattggtgtttgtatttctgcagaacctgccactgggattttcttagggatggcattaaatgtgctgattgctctgggtagtattgacatctggacagtgtgaggtcttttgatccacgattacagaatgtgtctcttcatttaattaggatttttttgagatagggtctggctctgtcacccaggctggagtgcagtgatgtgatctcagctcactgcagtcgccgcctcctgggttcaagcaattcttctgcctcagcctcccacgtagctgggactgcaggcacatgccaccacgcctggctaatttttggattagtagagacagggttttccatgttggccaggctggtctcaaacttctgacctcaggtgatccgcccgcctgggcctctcagactgctgggattacaggcgtcagccaccacactcggctgtttacttaggccttctttagtttctttcagtagtgtttcattgctttcaaaatataagttttatacttttgttaaatttatttacttatttattttttgagatggagtctcattccgtcactcaggctggagtgcagtggcacgaactcaacaatgttgaatagaagggatgagagcaggccgggcacggtggccgatgcctgtaatcccagcactttgggaggccaaggcaggcagatcatttgaggtcaggagttcaagaccagcctggccaacaaggcgaaagcccatttctactaaaaatacaaaaaattagccgggcatggtagtgtgcacctgtaatcccagctattcgggaggctggggcaggagaattgcttgaacccgcaaggcggaggttgcagtgagccgggattgcaccgctgcacttcagcctgggcaacaagagcgagactccatctcaaaaaaacaaaaacactctttggaatagtcgtagttttttttatctccagaagccttggagagtagggaggtggtttggtggtacagacagtgtggccaagcatggcaggggcgtctacacaggaccccagctgagggtgagacgtggtgtgtgtgtttgcctttctcctgggcaagagctcatcctttgatggaatgctcaaaggagtctttactttttgagaacttcctgaaaccacgcctgaagttgccagccaaaacctttaattttgattgtttcttaaaaaaaatagtaacatgagtgcttagaaaatattttctaagttgcttgcttcaggatgcatcttgacctgtattttgagtgaggtggcccttccagagtgatttatttattaattttttttttgaggtagagtctcgctctgtcttccaagctggagtgcaatggcacgatcttggctcactgcaacctccacctcccgggttcaagtgattctcctgcctcagcctcctgagtagctgggattacaggtgcatgtcaccacgcccagcccagctaatttttgtatttttagtagagacggggttttaccacattggtcaggctggtcttgaactcctgaccttgtgattgatccgcccaccttggcctcccaaagtgctggattacaggcgtgagccactgtgcccggcctccagagtgttttttactgaggatagtgaatttgatctggattatagaacccttctctagctgtagccatggaagcctcccaagatagtggcatgctggatacaattccatcttttctaaataatacaatctcattagttcctctgtatcttactttccttactagaaaatagaaaagatactcattcctgtttaagaggcccgagcattgagtgaggcgctgtcaggagggtagagtctgagctgcaccctggtcaccgcagtggcaggggcgctggtgccacacagtgcaggctcagctgtgggtcctctgggctgggaaggcctcagctcagtgctggggttccctccctgacacggcaagccgcctctgtgtgtctgcatcttgggcctcttcccgctggatctgtctttgtgttgtcacaaggaagccccagcggcgctgctgggaatcagaggcccttcagaggctgcttcgtccttccttgccccatcgtgcagtagaccttctgtcccctgcctggtgggagtcgggccctgggcaggggctcaggcgcttgctgacacgcttctcccgggcaccagacatggcctgtgcccccgtcctgcagaaggaaaggctgctgctccttgaggtctggcttaggagctcaggcccacgtggccacccaggctcagccccagggctgcactcaggctcatacgtgtgtgcatgttcacatgcacaaatgtgcctgtctgtgtctatgttggtatgagcgtctgggcgtgtgcgtgtacatatgtggatgagtgggaccagggcacagggaagcgtcatccggtctgttctgtttcagcttctcaggctcctctcctttggaccccgcgtgcttgccctgggc

SEQ ID NO: 818 - DNA, 40230 bp, Homo sapiens
ctgttctctctttcaagccagttccaggcctacttttttctaggtctccccctagaaaagcggccccacctcccctgcatctctgccactcggatgcatctttggtgagtgccgtgggagcaaacctccaggcatcccagaatttcaggtcctcctggaattgggcccttactcaacatttccagtcctgatggaaacctgcacccaggcaggtctctaagctaacagtgtccttgctggggcctggccctgagagtctggaaaggtcttccctaatactccccgacctggtgccttaaggctgagcagctatctctgctacagtgagctcagccaggttcgctcagagggtgcagggcctacccggagtctctgcagaaggtccctccttctcttcagagcagtctgcagggcatcgtccggccggtcctcatttcctggagggaagaacctgcttgcttaccaaggaacgcgtagaggctgtcgctgcaagcactcggactggatggtactgcacccatgtcggaaggccctgcctcacccacactcccaggatgggggaggcctgggaggatcctggtcttaggttatcccagataaagagggaccagtgttgggtaaggagggcaaggggcagcatcaggggaggggtaatccagggaactcagtgctggaggatggtcatctcattcctggaagggaggctgaaatgacgcgaccaggttcctcctgagtgcatttcatacagagtgccctgggctccaggaggtcaagggctctacagggctggctgcagcctgaccttggccacctggagccaccctctggccccaagtggtctagagtctggtctgatccccaagtatctgcacatccctcaagtctgccccctagtccgggcgtggtggctcatgcctgtcatctcaacagtgggaggttgcactgggaggattgcttgatcccaggaggtcgggggtgcagtgaattgtgatcaggccactgcactccatcctgggcaacagagcgagaccaaccctgtctcaggaataaaaaaaaaaaatctggccaggtgcagtgagtcacacctataatctcagcactttaggaggccgaggtgggtggattacttcaggccgggagtttgagacgagcctggcgaacatggcaaaaccccttctctactaaaaatacaaaagttggccaggcatggtggagcgcacctgtaatctcagctactcgggaggctgaggcacaagaattgtttgaacctcagaggcggaggttgcagtgatctgagattgcaccactgcactccagcctgggcaatagagtgagactccatctcaaaaaaaagaaaaagtctacattccttgggggagggtctacactcaagagaaggctccggaaggtggggggcagggttctggcctcctttcccttaggcacaggggtcctgcccctcacccagcatcacactggagaggggccgttgggaaccctagccagcccttgggggggtccccaaaccctctgccccaggcactggtagccattctattccctcgcactggctctgcagtcaggggacctggtttgggattttctctctgtatttgagactgggctctgcccttggcagctgagcccccacagctcacagcttgccccacgttccaaagaacaagaaatgctcctctggcctcctcagcttctccctggacgtccccgggtaacagtgaggacagcagctcctccccaaccaatggacaagctcagggtctggaaccagagcaactgggtctgatctgggtgcgaccactgccagggtgagcaacctctctgcctccattttctcatctgcaaaatgggaacaatgaaggtgcccctttttggggtttgcagactaaaggtgataaggaatgggggtgtcttcaactctgaatgtaaaggaaaagcgttgaggacaatctcgccggtaccaggagtgggggtgattcccagagttgctgtccccacctccccctggaggtggctccccctggagtggctacacttgcgtctgtctgtgctggttccaagcagcccaggggctctcacctggctcgaggtggaggccctcaggtcccccttccacgttctgccgttcttgctccagcttctgtgaggaagagagaccgtgacagagacggtggctccacgcaaaggccctgtgtgctccaggaatgactaagaggctttctgagtgaaaagaatggtacgtcaggagtaacccagcctctccagggccaacaggcgggagtcaagcccctccgaggatctccctgagctgcctctgtaagcctgacctctagcaaattcatgtgttccatccacaagtctaggggcggatgctctgagtggtcccttcaggcagatttctgaagagcaaccctgggagacacctcactggtgaggcctccaggcttcccagccagtgcatgcctagatcaccccccacctgaaccctgagctgagcagctacctgctgggtgtgtccaggggtgagtccctctcatggcggcctgtgggccaggatgcagggctggcgaaaggtgggcagcaggtccctcaggcagcaggagagggaacaatgcaggcagggggtgcagaggtgcccccaggcaccgaggctccccagaccctgtgctcagtggcctgcgaggacaggcaggtcggtcatgggccacccagaccctcagagaatgtgaagactaagtctgaggatgggtccgctgggctgccagccccaggcctagcccttggggccctgcattctgcacctgcagggctgtctcgaagagtccctccaacgccacagcctgcgagttgttaaaaacaggagcatcccgggctctgcctcacctgtcccaagagcttcagcgtcagtcgggtcacttgctctgctgctgatgagtccagcatggtgggagctgcaggagacgactgtaggggcaggggaggccacagcccacctccctccctggttctgttactcgcaggaaagaactgctcagcaggagcccaagcaccggtgttgcctgcagggcgggccttacctcctggagaccagcctgagggaagagaagagccctgtgggaagatagccacaccctccctggactgcagtgccccagaagccagcgctgggcgccgcgtgacagttgccaggctgccagacacagggaggccccaggttgccaggtttccactgtgcgtcctcaggctaccggtaaacactcatccccaggtgtggccagctgggcttcatgggaaggcaaaaaagtgggcagcagctgaggcagaggggcagaaccctcagacctgggggaagggcagtcgtgaccccctatgcaccaccagcctcaggacccagtccagaagaacctgtgtgtcaggggagggcgccccacctgtgtactgcctccagggtgttaatacctccctcctagggaccctcagagcaagcagggaagacagggtggggagacactgggaggacagggtgaggagactgcctaccaaggagttcaggaaattgcaggcagcagaaggggtaggacagaggaggggttgtgacctgcagaggggctgggctttagcaggaccagagggggtgcccaggggatatgtcccaccttggggctgggggcactgggcagggagtcaagtttgcaggaagcttcgcagagggtgacgcaaaacaggagcgtggtctgcacttggttgggcattaaactccacgttgatgagttagtcaatcccactagcaggcagactgacatgtgggggatgtcagcagcaggggcccagacctgtggacccgaggggcagaggtcagcaccctcctcggtgcagctaacccaggaacttgcctcagtggccaaaattgctctcttgccctcagttctgtaaatggcccatgtccatcagtatctatggttgtgtgcctgtcctgtcttccaacccacatccatgtagggaccctgaagctggaccagtgagtgattgggtgaaggctggctagcccgtaggaggtcaggctcacagaggcagctcatggagatccttggaggggcgcaccttactcctgctggccctggaggggctggattactcctgacgtagagttcaactcaccttaccctggaggccatccaaccagaaatgaagtcagcatgaaaccaggccttaccctccctccagatctgtggagggtgtgggctagggtcacatgacctgcctggtgccacacattcccagatggcagtcaggggtcctcgctggtgctgctggacatgagcagactctggccccatgtttaagatcccagtgccattgggcgttggctcacgcctgtaatctcagtgctttgggaggccaaggcagaaggatcacttgagtccacgagttggagaccagccggcacaacacaacaagaccccatctctataaaaaataataaaaaagggccaggtgcggtggctcatgcctgtaatcccagcacttagggaggctgaggcaggcagatcacgaggtcaggaggtcgagacaacctggccaacatggtgaaaccccgtctctactaaaaatacaaaaaattagccaggcgtcgtggtaggcgcctgtaatcccagctactcgggaggctgaggcaggagaattgcttgaaatcggaaggcagagtttgcagtgacccaagattgcgccacagcactccagcctgggcaacaagagcaaaacctccgtctggaaaaaaaataaaaaaaataaaaaaataaataaacaagataataaaagaacctggctcttgtccacagtcattaacagtgacagtcttgggagacatttaaacagctctgagtgtgcacagaacaaaaaccaggttaatttagttaagcaactgtatagagcacccttgatataagtgacctcatctgagaaaaggactccatcttatgtatttttttttgagatggagttttgctcgttgcccaggctggagtgcagaggtggagccatctcagctcactgcaacctccgcctcccgggttcaagtgattctcctgcctcagcctcccgagtagctgggagtacaggtgcacgccaccacgcccagttaatctttgtatttttggtagagatggggtttcaccatgttggccagactggtctcgaactcctgacctcaagtgatctgccgtcttggcctcccaaagtgctaggattagaggtgtgagccatagcacctggcccctgatgccttttaaattataagatagggccaggcaggcggaagttgcagtgagccaaggtggcaccactactgcactccatcctgggcaacaagagtgtaactccacctcaaaaaaaaaaaaaaaaaaaaaaaaagggtatcaggccaacagggaccagatgtttcctcatcagtagatactgcacccacccagataaagacataaacaagacactcttactatcagtccttaccagagtactctatggccatgaaaagagcagaacaccaccaggtcaaagtggccgttttacagacagtcttgctgtcacttgtgagaagccctccacatctgctgctgcaggctctgcccacatcagagatgcttccttgccagattctccttttcgttgaactggttaactttttttcctctcctctttctcttgatgtggaatgtttataacatttatgcagtggtcaagtatactattatgtatggtttgtaatactgactgacttaaggagagacttgagcctgtgtgcccacagctgtgactgccaagtgaatgggaagcactaagaattgcctcctcgggatctctagtagtatacataacatgctccagagggcatggatttgtcagactttttttttaaatagggtttttaagaacagttttagatttagagtaattgagaagatagtacatggagatcccacataccacatgtgtggcttcccctcttattaacatcttaccttagtgtgctacatatgttatatatatatatattttttttgagacagagtctcgctgcgacgcccaggctagagtgcaatggtgcaatcttggctcactgcaacctctgcttcccagtttcaagcgattcttctgcctcagcctctcgagtagctgggactacaggtacgtgccatcatgcccagctaatttttgagtgaaagccagtgcacctggcccatttgttatgattaatgaaccaatattgagacacaagtaactgaagtccacactttgacagtttccttaggtttgcctcatgtccctaatgtggtatccatcagaacaccccattacattgagttatgtgtctttaggctccttctcagactttcctcgtttttgatgaccttgacagtttcgaagagtactgggcagatattttgaagaatgtccctcaattaaaatgtgtctattatctcctggttagactgggactgcaggttacagaaaggaagcatctaggggtgaagtgccactgtcaccccatcacatcagggacacacactgtcacctcgactataactgtgaggctgacctgcgtcacttggctgaggtggagtctgccagttttctccacaataaagtggctctttccctccttttctttattgcactctttgggaggaagtggctatgtgtggtctacacttaaggagaggggagttacgtttccctccttgagggtgagtatctacaaaatttatctgggcagcttttttttttttttttttttgagttagggtctcagtctgtcacccaggttggagtgcagtggttgcctggccttgacagctttttaatagtttaaaatgaattgaggctgggcgaggttgctcatgcctgtaactccagcactttgagaggccaaggcaggtggatcacttgagcccaggagttcaagaccagcctgggcaacacagtgagaccctgtgtctactaaaaatacaaaaattagctgggcatggtggtgtgcctgtaattccagctgctcaggaggctgacatggagaatcacctgagcccggggaagttgaggctgcaatgagcggtggtctcaccactgcactctagcctgtgtgacagactgagaccctgcctataaaaaagaaaagaaaaaagaactgaaataagacccaagtccaacattagcagaacctctctaggatgtccacagaaacgactctggggttctgaggaacacagtctaggcaaacctgggcacatcccctcagtcccacagttgtaaatgtattgtaacacgtaacagttgtgagattcaggcgcggtctgggtctctgttcctggaaagtgtgatcctgtgggtgcagcccctgctcgcttggctgtgttgcctgcctggcccctgctctaatgagcccactgcccagagtttgctcaaaccacccaattccgagtctgggaaccaggagaccgctggacaccccgctcaccacacagaagactgtggcctgagtcaggagaaggaagtttctggcggtcgagcttccacggcttcctgagggaggttgcagggagccgagatcgcgccattgcgctatagcctgggcgtcgcagcgagactgtctcaaaaaaagaaaaaaaattctgagcgagattccagggcttcctgagggcgcgtttaagttgcagttgctgaggaggctgcaaggtgagcttgcgtcagcgaggagccactccagcacgctcgggaagggcatcgttactgctgcaaacaagcacacggccctccacgacgaaccttttgcaagtgaaggcgcacgaacaggcccggaggactacaaagaaacccagaaaccagacttggacacatgaaataaaggggttagctgaaggaatactccacagttaaggacggcctgcgcgaggtcaccggccctgtcttggttttttgccacttcgctccagttagtttcccaagttccacctacgcgcgcgccagctgagaaaacgcccaccccggcggtcccgccacaggtcacaggcggtgcggaccccgggactgtgtccgggcttcggtgtccagagagctccaagacacccaaaccttccgtggtttccacctctgcaagcttatgttccgctgagctcaagctgagggacgacgacctcatgcgacgtcagtttccccctgggaccacgaacccacggccccatttctcttctgtctactaaaaaccttttcttttcttttttttttgagacctaagacatcagtgagacacacgagcagacacgggctcggtcgggaaaggcgggagctccaagcggcggggcctgcaggtccaggcggttcgcgggctttctgaccgcattcggccgagttcttctctgaagacccaggacccccggccgagggggcgcattcggcgggctggtggcgtaggattttgtttcgggttcccagggtcccggcaagggtgagggagcccttgcggatcccctgagatccacctcagcagcctcctccgtggtaggcctcaacttcccgcggcggcccacagccaacgactaatgcctgagcgggagaaaacggcctggccctgtccgggtggttgctgagcaccgttcggcgccgcccgcgcctgcagggagcccggcccgctgtcctggtggacacaaagcccaggggccgcccgcgcgggaccagcagcgcgaactttttgccgctcggccagcctggcaggggattttaaaatcggccaatcacagcgggcgccaggcctccgctttccgcttactggtcctgccgtaggaggcgggtacgtgagcgcaccaatctgtggccggcgagcgtaaagggcggggctccgcccaggctgcaccgcccagagcgcgcgtgcgcgagaccggaaacgcagccccctgattggcggcgcgtgtcgggggcggggccgcggctgcgtgacagttgtcgcggggggagggcgagcccaagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaaggtaaacattaggggcttcttctctagctgctctggcgtgaagtcctaagggcggctccggtgcccgccaccgccccctgccaggagaggacgcggtccggcggaagccgccgcggaggtctcgctttttcccgccggctccgctggaagccgcctcctggccgccgccatcttgaatccgccgctctccgccaggtcccgcccccgccgcggccacagccaatcagcggccgggacgcgcggcgcctctcgggcgggccggggcggggctgcgcctgcgtcggggggggtggggcgcgggctgggcgcggtgcacgccggggcggggtgtggctgcagggcggggctacaggggcgtggcgtggctgcacggagggggtggggcgcggcaggcgctggaccccaggctggatcttccagtggctcccgcgtcctccgggaccgggtggcctggggcgggcggccggtattcgggtggctgcttggtctagggccagtttcctgcgcggccggggccgggggcgtggcgcgggtggcctgcagcgcctccccagggtgcgccttcgcctcgtccgtcggagatgctttccccgcgcgtttctcgcggcgttgcagtccttactgtgtgaaaggcccccgcggcgctcccggccgccgtcttcttcccgcgcccttgggctcgcgtcctgcccgtccgggcctggcgtacgctgccgggaacccacgcggcgctggcgccgggcgccttcaagggacgcgctcccgtctttctcccgccccgggtttctccgtgaaaaagcgctcggtttgatggccactgtcctaggtttcgtgggaataaagcgcgcagagcccatgactcgggggcaggagaaagggagtcccgaaagcgcgaggcggaaccgcgggagcaggccggcctctgcgaggtgcgcgccgctcccccccaggatgttctggctggggtgctggggaagagcggggctcccgggcacggcggacaggggacgcggggctaggccggggaagggctgaggcgggcaggaggggaaggggagcccggagcctgcagggagctgcgaacaggagcagagctcccaggagggtggaggggggagggagggacaagacgccgcctgtagggcgacgcaggccgcagaccaggtctgtgctatatcccgacatggataggtgtggtggaggaggacatgaaaataaacgacatgaggttgactttgaaggaaatatttccttgagagaccattttcttgtgtaaatggccttgtgtaatttttctgggtccatgagcttgtgtacttgtgttatcatttacacaaatgtgtgttccatgcgtttgtttttgtggccacagttgtcttttgagggaacagatgtctccccgtgaaaggctgatgtgggatcgatcgcatacctcttgagtaagacgttagcgggagatgaggctcgcacatagtctcaaactctcggatttgaggactgagcagagctaggctgtgccttctgatgggcgatgctctgtggatgtccctggtgctttggtgagctgtgtcatgaaaaatagaacatctgattccataaaggaagatgtgagattgacctggcttaattaattttttgctatttctgtatcttgtctcagaatctatggctaggaagttttggctgggctatatatttcttcagttgggggaaaattggggcaagaagggagagatttagcttttatatcattttaaaacttaaatatgccttgattaagctatcaatcttttatacaaattttttttaaagttttatttttctgtaaactgccaagggctaggaaagctattctgccaatcagccgtatggttttctttaccaggcataattagcagtcctcattgttagaccccttggatatagatattgatgaaggcagtgtttgtggagagccatctgttggccaggtgtggcagagtagactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcaggtagatttgctcaatgttgtatttgaacatttcgcttatcttctagtgatttctagtgtgatttactaaagatggtctttggtctgtttttgcctttcaaaagtgaggaaagagggtgttattttagtttataaaaagtgagggccgggtgcagtggcttacgcctgtaatccccgcactttgggaggccgaggcaggcggatcacctgaggtcaggagttccagaccagcctggccaacatggagaaaccctgtctatactaaaaatacaaaaattagccggacatctggcgcacacctgtaatcccagctactcgggaggttgagggaggagaatagcttcaacttgtgaggcagaggttgcattgagccgagatcacgccaatgcactccagactgggtgacagagcgagactctctctcaaaaaaaaaaaaacagtgagtaaatttttatggttttattctttttattttattttttatttttttgagatggattctcgctctgtctcccaggctggagtgcagtggcgcgatctcggctcactgcaagctccgcctcccgggttcatgccattctcctgcctcagcctcccaagtagctgggactacaggcgcccgccaccacgcccggctagtttttgtatttttaatagaggtggggtttcactgtgttagccaggatggtctcaatctcctgacctcgtgatctgcccgcctcggcctcccaaagtgctgggattataggcatgagccaccgtgcccggcctatggttttattcttaataaatttgggttttctttttctttttttttcttttgtttgttccagacagtgttttgctgtgttgcccagcctggagtgcagtggtgtgatcacaggtcactgcagcctcaaacccctgggctcaagtgatcctccctcctcagcctcttaaagtgttgggattataggcatgagccactgcgcctggccctgttttatctttattatgtaattttgagaagttttggattaactacttgaagacaagtgtcagttgtttgctttgtaatggaagactgggagttcttcgtgtgtggtcgtgtcagcccctttgatgggtgtttcttgggacatttaaaacataatattccttcacatagttgtaaatgcacctgcttgtcacatttgtcttttacctttttactaaacgtgagatgaagagggaaggggtgaaggtgttgcagacatggtgtgttgctggaggagactgggtctgctgcttgaggccttgtgagctgcaggggcacccccatgggcaggtgtggcaggtgagtgcacactgagtcctgaaggggctggccttccgggctccttgggggcctacaaacctgcctggaggcgggctgtccttgggccttttgtatgaattatgaacgagggccttaggtgttgagtgtccctgctgctgcagcagaatgggtgcaggctttgatgtttgctaggatttgctggaaaactggtggccaaaggcagaatctggctcaaggtcataatgtatgtatcctgctttacttaaaaaattgagttgttggcaacagttaaaatttgtgttattctacctacaaatcctgaattttgctttttatctcttgagtgtttttggttgttgggttggtgtgttttttttttttttcccgttttctttttaagatacagtctctctgttgcccaggctggagcgcagtgacgcgaactctgctcagtgcaacctctgcctcccaggctgaagcgatcttcctgcctcaggctcccaaagtgccaggattacaggatttctgccaccttgctgggcagaaagttacttttgatatattctggttgcatatgttttttggttttttttgaaatggagtctcactcttttgcccaggctggagtgcagtggtgcagtcctggctcactgtaacctctgcctcctgggttcaagcgattttcctgcgtcagcctcccgtgtagctgggattgcaggcgcctgccaccaaacccagctaatttttgtatttttagtagagacagggtttcaccatgttggtcaggctggtcttcaactcctgacctcaagcaatccacccaccttggcctcccaaagtgctgggattacaggcgtgagccactgcacccggccctctggttgcacatactttttttttttctttaaggcgaagtctcactctgtcatccaggctggagtgcagcggcacgccctctgcttcctgcaacctctgcctcccgatttcaagcgtttctcctgcatcagcctcccgagtagctgggattacaagtgggcaccaccatggccggctaatttttgtatttgtttggttgagatggggtttcaccacattggccaggctggtctcgaactcctgacctcgtgatccacctgcctcggcctcccaaagtgtggggattacaggcgtgagccactgtgcctggcctgcatagacgttttaaaagtagtaagctgataaatatatgtgggaatctcaggatcctatcagaaaaccattccaaacttagcacattttgtggtaaattgtatttggagactgatgggtcgttaacattagaaggcatggtatagactcctgattaaacactcatactttgctgtttcatcaggtagagactctcttagtttctaactctgctatttgatgcatgccttcattcaggaagatgatctgatgaaaagcattttgatttttgttttcaaaaccagaagggcatataccagaaaattaacagtggtggtcagaaaggaatagagttgttggttttttcgttgttatggtttttggtatttcctacaataaacacattaggttacttatataacattttttttcattttagaattaactataccactaataaaacatgtattttggacatcttaaagcaatctataaataacaggcccattactggtccccttgacttagagatgcacacgcacactcactgcacttgctgcattttgtgtcacctcctcgtgaccacagtggacaggacacttcaccctcaagcgtggggtggtgtggcagatgtgaggagaggtctgctttcacaaaacttggtgaaacaatggcaagatggccaaggtaaagcattctgttacttataactgttgctgtgagtagtaacttaactgtttaaagcagtattttaaaaaccaaaagctggtaaaatgtaaggatactttctctaggaaaagtatgtgctcctgcagccaggattcttcatggaatgaaggcatggcagggcctgactgattttcatctcacatcgtcatcctgaactcctctgcacagttacagcttgacatcagcagagacatacctcctcttcctgtccattggctctaaaatggtgggcaaaggtcaggtaccagtcagctttttccacagaattcctgacattttaataagctaaacatgcagtcatcaggtattaacccctattggatcttggacatcagctttttcccccttttttttgagatagggtcttgttttcttgaccaggctggagtgcagtggcgcaatcatggctcattccagccttgacctcctggcctcaagtgaccctcctgcctcagcctccctagtacctgggactacaggcatgtgccaccatacctggctaacttaaaaaaaaatttgtagagacagtgttacactgtgttgtcagggctggtctcaaactcctgtgctcaagtaattctcccacctcggcctcccaaagtgctggaattataggtgtgagccatcccacctggctaaaatttattttctttatacatgtataggtaaactaagtagtatgtgtagaatagagccattgtctttctgctgtacactaagttaggaatcaaatttcttaagccattttgtcaattatgtatataaaaaccattggtgctttagaagcagatatttcattaacttttttctgattatatcattgtacatcatcagttcagtctaaaaaggagtttttttcatatgtattataaaatatttcatgatatttgagtttagtatgcctttaatccagttgtagatgttaaaataggagtaattttgtgttcaaaataatgatcttctgaaaagtgaaattctaggaaagagtccactgtttaaagctagcagctggtggccgtgtggccgaataatgtcccaggccagggcactcccctctcagatggttggtcatgctgcgtcggagatcaggaatcctcaaggaacctttatgttatagttgtaccagtgctttaaacataatgaaaggtgcatttgttttattttacccatctataaattgtgagaggtttggctatggagagtctagtgagcttattgaacagcataagaagataagtgtgtgtgtttgtgtgtgtgtgagagtgtgtgtatgtgtgtgtgagggggagggagaagttattgtgctttccaacatataataaattgcttactttgatcactaactgttaggtaaatactgatgatttctagcataagtcttttttcttttttttggagacaggtcctccctctggcgcccaggctggagtgcagtggcccaatcagcttacttcagccttgacctccctgactcaggtgatcctcccacctcggcctcccaaagtgctgggattacaggcataagccgctgtgcccagctgatataagacatatttttaaccaactttaagatcttagttttttttcaggatggttataagcgaaggtagaattgcagaaagactttgtggtaaatattcaggattcggctctgttgccttacaatttgttaagtgcatgatggaaaaatagttgaaacaatgcaacagctgtctcagttctgaaagttaactcagaaatggcagaaagcaaggtcaggcatggtggctccgagcactttgggaggccaacgtgggaggatggttgaaactctgtctctatgaaaaatataaaaattagctgggcatgacagtgcacacgtgtagtcccagttactcaggaggctgagttgggaggatcacctgcgcccaggagtttgaggctacagtgagctatggtggcaccactgcacgccagcctgggcggcagagcaaggccttgtctcaaaaaaaaaaaaatcataaaaataaagcaatggtagaaagcagaatttgacctttcagttacagatgaggaacaaagtgaggagaggccattttttggtaaaagaaccatctggcgggacgcattggctcatgcctgtaatcccagcactttgggaggccaaggcaggaagatcacctgaggtcaggagttcgagaccagcctggccaacgtggtgaaaccccatctctactaaaaatacaaaaattagccgggtctcatggcaggcgcctgtaatcccaggtactcgggaggctgaggcaggagaatcacttgaacccgggaggcagaggttgcactgagccgagatcgcgccattgcactccagcctggaggacaagagcgagactttatctccaaaaaaaagagaaccatccaaaaattgctcagaggtcaagaatttcagaagaaaatacaaaaactttggctgaagaagatttaactagtgctatagaaggcttaagaagtgtggttctagcacttttccaactcatatttgtatcaaataccaggaaaaatagttatcaccatttatcatctagatttctgggccgttttactgttttgtcattttaagttgttttacacgtaatttacagaagtaagaataaagcaataatttaaaacaactttataagaaatttgatccaacctctttgtatcaagtaagttttgacacacaaacattagaagtgtcctcttaaggaagtggatggtccaggttcctttgaagtgtgatcattcatgtgagcgggcagctgattgagactactgtgtccccttttcgtccctcacttcctcttgattctgagaagattgatctagggtattgtcaaatgaagacttgtctgagattttattttcacgtcagttttgccatcatcattggccatgggtgctctctctctgcattcatcttgtgactcatctaatgatcccgaaaagtcgacactgtcatgtttctttgctattttgggaagaaattgaaatgttcttagtgaatcatcttgttaaagcaagctaatctgggcactgtggctcatgcctgtattgccagcattttgggatgctgaggtgggaggattgcttgagcccaggattttgaggccagctttggaacataatgaacagagaccctgtctctacaaaaaaataaaaaataagctgggcacagtggcgcatgccagtagttccagctactcaggtggctgaggcaggaggatcacttgagcccaggaggttaaggttgcagtgagctgggattgcaccactgcacgccagcctgggtgacagagcaagaccttgtctcaaaaaattaattaaatttcttttttaaagtagaattcatggccgggcgcagtgactcacacctgtaatcccagcactttgggaggccgagttgggcagatcacaaggtcaagagattgagaccatcctggtcaacatggtgaaaccccgattctactaaaaatacaaaaattagctgggcatggtggcacgcgcctgtagtcccagctactcaggaggctgaggcaggagaatggcgtgaacccgggaggcagagcttacagtgagctgagattgtgccactgcactccagcctgggtgacagagtgagacttcgtctcaaaaaagacaaaaaagaaaaaaaaaattagccgggcgtggtggcatgcgcctgtagtcccagctactcgggaggctgaggcaggagaattgtttgaacccggaggcggaggttgcagtgagccgaggtcatgccaccagcctgggcgacggagtgaaactttgtctcaaaaaaaaaaaaaaattacaggctgggcacggttactcacacctgtaatcccagcacttggggaggccgaggcgggtggatcacctgaggtcaggagttcaagaccagtctggccaacatggtgaaacccccgggaggttgagacaggagaatcacttgaacccaggaggtggaggtttcagtgagccgagttcgtgcaactgcattgcagcctggcaacagagcaagactccgtctcaaaaaaaaaaaaaaaagtagaattcattaagaagaggggcaggaacatcattagggaaattacttgcattataaaaatgtttagagctggccaggtgtggtggctcatgcctgtaatcccagcactttgggaggccaaggcgggcggatcacgaggtcaggagatcaagaccatcttggctaacatggtgaaaccctgtctctactaaaaatacaaaaattagctgggcgtggtggcgggcacccatagtcccagctactagggaggctgaggcaggggaatggcgtgaacccaggaggcggagattgcagtgagctgagattgtgccactgcactccagcctgggcgacagagcaagactccgtctcaaaaaaaaaaaaaaaaatgtttagagcttgggaattgttaatgcggaaggtgcacgttctgaacaggtggaagtgagctctacttgttaaatgaagtcagcacaggcctgcagatagaggagctgggaagggcctgaggctgcagccctagaccttgctttaaatgcttctttctggtcctccccttcttagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacagtcagtgaccacccaccagaacagcatgggatgttcacagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggtattctttaagttctctgttaaggtgtattctttgtcaaaagatttctttatgttgtagaaatccaaaccagtgagaggaccttccatctctgcagggcctctctttagaagtggaaactggaagcatagagagctggaggcagaggctcaccctgtaggccccacgtgctgccgcctgcacgttcttagtgttgcctgtgaatgggaagcctctcttcatacccttctccctgagctcaaatctgcctcccttgtgatcttccttttttgtttttcccatgggacattgaagagaagccacccttcataagtttgaggaatgtcatgaattccctttattctagttgcccttgtcgattgactcacctgtctgttcagcctgtttcttaggcctggtacctcgtttctcacatcatcagtttgtgactggaagtcctgtgccagttgagagcctggcagggcagggaggctgtggtcagtctgcatgtccctggtttctgccacgttcctggtgggatgaattccatacgtgttgagttgattacctttattttattgacatgttttttgttagcatgtggaggaaaacattaagtttggaattgactacttttgaagtgttatgttaaaagcatatattttaggctgggcacggtggctcacgcctgtaatcccagcactttgggaggccgaggtgggcggatcacgaggtcaggaattttagaccagcctggccaatatggtgaaacccctctctactaaaaatacaaaattagctgggtgccactgcacttcagcctgggagacagaccgagattccatctcacaaaaaaaaaagcctctattttagccatttgattctagctagactcagttcacactgctttaggcaagtttggttgttttttggtttttggggttttttttttttttttaaatagagacggagtcttgctctattgcccaggctggtggtgcgatcttggcttactgtaacctccgcctcctgggttcaagcgattctcctgcctcagcctcccaagtagctgtgattataagcacccaccaccatgcctggctaattattgtatttttagtagagacagggtttcctcatgttggtcaggctggtgctgacctcaagtgatctgctcgtctcagcctcctgaagtgttgggattacaggcgtaagccactgcacttggccggcaaattgtttgttttttgagatggagttttgctcttgcccaggctggagtgcagtggcgcgatctcggctcactgcaacctccgcctcccaggttcaagtggttcttctgcctcagcctcccaagtagctgggattacaggagcatgccaccacgcctggctaatttttatatttttagtagagaaggggtttcatcatattggtcagactggtctcgaactcctgacctcaggtgatcctcctgccttggcctccccaagtgctgggattacaggcgtgagccactatgcaggccaagtttagtttttaatctgcattattgcaggaaagatctaactcctaggtgaggcctggaagcacagtctctggtgggttctataaaacccactcttcatttatttattgacttcttgggaccgggtctcattctgtcccctgggctggagtatggtggtgccatcacagcttagtgtagcctcaacattttgattcttaagttgttgcagctctgtccgtggggagccccttcaggtggctcctgtgtcatgtgtttgaagcacatcctggcttgtgacactgcaagttggtgccgcaggctcatcgtgtaggccctgtctccgttctgagtccgctgtttctccaaggagtcttggtgccttttactagattatggtgttgagaccaagacctgggctctaggtgtgctcactcctgctgggatgttgctgctgcttctgggctctctccgtggacagagtgaggaagggtgtgcctgggagctagtctgtgtgtacactcatagctgtatttatgttcatttgtatttatagacatatatgttaaataggaatacatactgatacctcagagcctaatccagcaccacagagttcattctgccctcccccccaggtttatttgcagtttccttctcggatagtgagaagcctggctctcacttctgccatttatttactttaaaaaaaaaaattagaaggttgttttttttgtttgtttgtttgtttgtttgtttttttgagacagtctcgctctgttgcccaggctggagtgcagtggcaggatctcggcttgctgcagcctctgcctcctgggctcaagtgattctcctgcctcagcctctctagtagctgcgattacaagtgctgccaccatgcctggctaattggggtttcaccatgttggtcaggctggtctccaactcctgacctcagatgatccacccgcctcaaccccccaaagtgctgggattacaggtgtgggccaccacgcccggccccatttatttacttatttgttcaactctcctgtaagtgtataatagtttcagaattagcaacccacatcatataagaaacaaatttaccaagtggatttaagtgtttgtttacagctcctttgtctccattttcagtttccagtcacaactgttttccaaggttactcaggtcactcctctcttccccagcccttcactaaggttgtgtcttcactggtgagtatgtagtcaggttcattggtcactggctacttcctatcctgggatcccacaacatcctggtcaattttttaaagttgcatactgttttgttttgttttttgagatggagtttcgctcttgttgcccaggctggagtgcagtggcgcgatctcggctctccgcaatctccgcttcccggattcaagcgattctcctacctcagcctcccgagttgctgggattacaggcatgcgccaccacgcctggctagttttgtatttttagtagagatggggtttcaccatgttggtcaggctgatcttgaactcccaacctcaggtgatccgcccccacctcggcctcccaaagtgctaggattacaggcatgagccaccgcgcagactgttttttttgagacagtgtcttgctctgttgtccaggctgtagtgcagcggtacaatcttggctcactacagccttgaactcctaggcttaggcagtcctcccacctcagcctcccaagtagctgggattacaggcacgttccaccacacctggctaagttttgtttttatttttttgtagagacagggtctcactgtgttgacaggactggtcttgaactcttgggctcaagtgatcctcctgcctcggcctccaaaatgctgggattacaggtgtgagccacctcgcccaccctaaaatttgcatgcttctaagttcattctttgtgatgcacaattgtgtagagtcatattcaccacccagttaccctcgagaacaaccccagcccccaagagggcccgtgtcctctttctaaccagccgctctctccttccccagcctctggcaaccagtggtctgttttttgttctatggttttgccttttccagaatgttctacagatggaattctataatatgtaggcttttgggtccaggtttttaaatcacttagcaaaatgagttgaagattcatccaagctttagattgatcagtagctcattcctttttgatgctggttagtacttcattgtgtgcatggtacacagtttgtttatccactcacctggtgagggacatctttcttctagcttttttgtgaatatgaataatgaatgtgtctttttttttttttttttgagacggagttttgctcttgcactcttgtcgcccaggctggagcggtgatctcggctcactataacctctgcctcctgggctcaagcgattctcctgcttcagcctcccgagtagctgggattacaggtgtgcaccaccatgcctggctaatttttgtatttatttatttatttattttgagacagggtctctcactcgcccagcctagagtgcagtggcccattctcagctcactgcaacctctgcctcccaggctcaaggggttctcccgcctcagcctcccgagtacctgggattacaggtgcatgccactatcacttggctaatttttgtatttctagtagagacggggtttcaccatgttggccaggctggtctcgaactcctgacctcaaatgatccacccgcctcggcctcccaaagtgctgggattacaggcgtgagccaccgcacccggcctaatttttgtatttttagtagggatagttttaccatgttggccaggctgatctcgaactcatgatctcaggtgatctgctcacctcggcctcccaaagtgctgggattactggtgtgaacaactgtgcctggcctgtttttatttcccttcttgaaagcctggctggcgtagacatatagttggcagttggtgtcttgcttgccggtggtttcgctctgcccctctctagcttgtgttcactgccgtggccaccctgaaggcttttgtctttggtgttctgcagttttgattttatgtgttctttagagggacagaactaaaaggatagatagacatataaaggggagtttattaaggagcatcgagtcacataatcacaaggtgaggtcccacagtaagccatctgcaggctgaggagcaaggaagccagtctgagtccgaaagctgaagaacttggagtctgatgtttgagggcaggaagcatccagcatgggagaaagatggaggccagagggctaaccagtctagtctagtccttccacgctcttctgcctggttttattttggccacactggcagctgattagatggtggcaacccagattgagggtggatctgcctttcccagtccattgactcaaattttaatctcctttggcaacaccctcacagacacattcagggacaatactttgtatccttcaatccaatcaagttgacaatgttaactatcacaccaggtatggctttttatgatgtctttgattctgcttgggatctagggttttcttcaatgtgtggatgatgcttttctcatctgttgcctcaaatcctaaccagtatctccatcataccttctacctgttctttctctccattaagttttagagttctcttgcataccgtatttgtccattctcatgctgctaataaaggcatacccaagactgggtaattaaggaagagaggtttaatggactcacagttccacgtggctggggaggcctcacagtcatggtggaaggcaaggaggaccaagtcacatcttaggtggatggtggaaggcaaagagagagaacttgtgcagaggaactcctctttataaaaccatcggatctagtgagacttattcactctcaggagacaagcacgggaaagacccgcccccatgattcagttacctcccactgggcccctcccatgacacgtgggaattgtgggagctacaagtcaagatgagatttgggtggggacacagcccaatcatatcacatacgtatagctcagcccacttttgtgcttgccttctttttgctcttggccgtaggctggatcgttttatctgtgttatctcccatttttctaaacctctgttcatctgtatataatctgctgttaaatacgtccagagttgttaattttgttcttgctgtttttagttctatttggattctttaaaattggttgttattctgcataattttttgtttcctagagatattttcaaacttattttaactgtacatctttttttgtgagtgaattggtctccactttggcctggtatttggaggtgcagtgagcctatccactttgttttttattgagatggagtctttctctgttgcccagactggagtgtaatggtgtgatctcggctcactgcaaccttcacctcccaggttcaagtgattctcctacctcagcctcccaagtagctgggattacaggtgcccgccaccatgctgggctaatttttgtatttttttttagtagagacggggttttgccatgttggccaggctggtctcgaactcttgagacgaagtctcactctgtagcccaggctggagtgcagtggtgccatctcagctcactgcaacctctgcctcccaggttcaagagattctcatgcctcagcctcctgagtagctggaattacagacgtgtgccaccatatccggctgatttttgtatttttagtagagatgggtttccccatgttggccaggctggtcttgagctcctgacctcaagtgatctgcccaccttggcctcccaaagtgagggggttacaggcatgagtcaccgcgcctggccagcccatccactttgaatggaatgtgttgctcgggttgatttggatcactattattttgggtctgccgtgggtgccacttctcaggatctttttttggttccttgaatgttttctgttttccatatgtccgttattccgcttggagtagcacattgtctggtcttttttagtgaggtgtttgtgttacttttgtgagaagtctgtgttatggctcgtgggagtcccttcaagttcagtgccacattttcatctgatcagtcttccaaaaatatccctttccctagacacgttttaatataatttttattttttattttattttttctcacgtctagtaaggcagggaatatttttaaatttttttgtagagatgggatctcactatattgaccagggtaggctctaactgctggtctcaagccattctcctgcctcggcctcccaaagtgctgggattataggtatgagcctccacacctggcctcctggacgtgttttgttttgttttttaattttgagacggggtcttaccctgttgcccatgctgcagtaagtggcacaatcgtagcttactgcactctccacccctgggctcaagcagtctttctactcagcctcctgagtagctgggaacacaggcatgcaccaccatgcctggcaaatttttaaatattttgtagagatggagtcttgttacattcactaggctggtctcaaacttctggcctcaagtgatgctcctgctttacatgctttttacttatttttttttttttgagatggagtcccgctctgttgcccagcctcgagtgtggtgatgcaaattcggctcattgcaacctctgcctcccaggttcaagtgattctcatgcctcagcctcctgaggagctgggattataggcatgcaccgccatgcctgactaattttttatttttagtagagatggggttttgccatgttggccaggctggagtgcaatggtgcaatcttggctcactgcaacctctgcctcctaggcttaagtgattctcctgcctcagcctcctaagtagctgggattacaggcgtgcacaactgcggccagctaatttttgtatttttagtagagacagggtttcaccatgtcgcccaggctggtcttgaactcctgacctcaggtgatctgcccccctcgccctcccaaagtgctgtgattacaggcgtgagccactgtgcctggtctccatactgtatttttatagtgattgtactagtttacgttcccaccagcagtgcaaaggttttctgttttcactgcatccataccaacctggatgtgttttttatctgtttgtgtcatcaattctttcttttttttttttcttttttttttgagacggagttttgctcttgttgcccaggctggaatgcaatggcatgatctcggctcactgcaacctccgcctcccgggttcaagtgattcttctacctcagcttccagagtagttgggaatacaggcatgtgccaccacgcccagctaatttttgtatttttagtagagacggagtttcagcagatggtctcaatctcttgacctcgtgatccgcctgcctcggcctcccaaagtgctgggattgcaggtgtgagccaccgtgcgcagccagcgatttctttcagcagtgttttgtggtttcccttgtagagatttttcgcctccttggttaggaatattcctaagtattttattttattttttgcagccatcgtaaaaggtgttgagttcttcatttggttctcagcttggtcacttttggggtatagcagtgctactgatttgtgtatgttgatttcgtgtcctgaaactttactgaattcatcgatcagatgtaggagctttctggatgagtctccagggttttgtaggtaaacgatcctgtcatcagcagacagggactgtttttcctctttactgatttggatgccctctatttcttctcttgtctgattgctctggctaggactccagagcagtggtgaaagtgagcatccttgtctttttccagttctaaaatgccttcaacttctcccttttcagtataatgttggctgtgggtttgtcatgaatggcttttattgtcccttctatgccgattttgctgagggttttaatcgtaaagggatcctggattttgtcaaatgcttcttctgcatctattgagatgatcatatgatttttctttttaatgctgtttatggggtatatcacatttgttaacttgtgtgtgttgaaccttcatccctggtatgaaacccaagtgtattatcttttttatgtgctgttggattccgttagctagtattttgttgaagatttttgcatctatgttcatcagggatattggtctgtagttttctttttttgttatgtcctttcctggttttggtattagggtgatactgacttcatagaatgatttaggaaggattctttctttctctatcttttggaatagtttcagtaggattagtaccaattcttctttgaatgtctgatagaattcagctgtgaatccctctggtcctggacaatttttgttggcaatttttaaattactgtttcagtcttgctgcttgttactggtctgttcagaatttctgtttcttcctggtctaatctcgaagggatgtatatttccaggaatttatccatcgcctccaggttttctagtttgtgcacataaaggtgttcatagtggccttgagtgatctttggtatttctgtggtattggttgtaatgtctcccatttagtttccaattgagcttatttggatcttctctcttcctttcctggttaatctcactaatgatctatcagttttgtttatcttttcttttcttttctttttttttttttgagatggagtatcgctctgtcacccaggctggagtgcagtggcgcgatctctgttcactgcaagctctgccgggtctgcctcccgggttcatgccattctcctgcctcagcctcccgagtagctgggactacaggcgcctgccaccacgcccagctaatttttttgtatttttggtagagagagggtttcaccatgttggccaggatgttctcaatctcctgacctcatgatccacctgcctcagcctcccaaagtgctgggattccaggtgtgaaccaccgcgcccggcccgagctcctgacattgaagggagatgttgctgcactcatgtggccgcccaccctggggacgagtccccgcacaggcagcccttgtggagcccaccatgccgcccttccctgtccagttcctccgggggcctttctagcttttgcaactgtatcaagcctgtatctctccatccctagccagttccccagttggggcagaaaaatttagtttgggtcattttttaatcggaagtactctgtgagcaagtgggtcacctggagcccagaaaggtgcctggctgatgcaggggaagccagagaatggtcgcttccacaggcaggggatacgtcccaggcgccagtcgaggggcaggagcctgcagggagggccacagtgacggtgggctcaggatccgtgccgacgggccccctgcagcttttcttttccctttgggttattgctgctgaaaaggtttccagaggtgggaatgttgagacagggaaaggctttctgtggctcgacctgtgttgccaaaatggctgctgagaaaaaagttgaagcaactgattctgatgttggtagcatttgggtgcatttgtttcttgtgactgtggtggcactgaggattcgtaatattcttcccaacttttgctgatttagtggccatacaaggatctttaaagtttgtgtctctagattggtttacctttcatcggtacccactttttccaggcattttatgcacattttctctctgtaggcgtcatttccgcctttttcctgagagcaggttgtttgttcctcccgtggcagcactgctgtggcgtggggagagtccacagcttctgtttctgggactttattttgtttatttatttttttgaggtggagtctcgctctgttgcccaggatggagtgcagtggtgtgatctcagctcactgcaacctctgccttccaggttcaagtgatcctcctgcctcagcctcccaagtagctgggactacaggtgcccgccaccacgcctggctaatttttgtatttttagtagagatggggtttcaccatgttggccaggctggtctcgaactcctgacctcaggtaatctgcctgcctcggcctcccaaattctgggattataggcgtgagccaccatgcctggcctgtttctgggactttgactttacattgtgatttaagcgagtttaatatttttccttcttctttttttaatgagatacaattaacaagcatacgattcaccattttaaagtacagacctcagtggcacttagtacactcacagcatgtgtgagcaccatctccagtggctccagacatcatcatcaccccagaaggaagcccggtgctcgcggcagccaccccgctctcctccctcagctcctcgcagcctccaggctgctccatgtctacggatttgcagatcctgaacacttgatgtaaacggaacctcaccatacgtggccttctgtgtctgctctgtcactcagcctcacgtcttcagggctcctctgtgttgcagcctgagttggggcttcgttccttcttgtggctgaatggcagcccacgtttgttcaaccattcatccctcaggaggcatttgggttgctcccaccttctggccgttgcgagtggtgctgctgtgaacagctgcgaacggggttttgtgaggacgtgcgtcgtcagttcttgagcacatcactgtggcttctcatgtgaattctggacctacattctttgccttttttccccaggagtgtgaacaagaatgtgaacttgccattactgacctggagagcggccgtgaagatgaggctggcctgcatcagagtcaggtgacccggcggggcctgcacaggctcacagcatgggctctgttatccccacagggcacagtgggcatccgggtgggggtggggtgggcgctgccatctcctttctctgagttgtctgtttccacgttctgtgtgtggggccatcagcagggccggtggaggagacacacgtggatgctgggggtcagggggcttggtcaggtgcaggccacatgaatgacacactgacctcaggccggttgctctccctgtcagctgcgaagccccctccaggtacacacagtgccgtcatacagcgagggaattcggggtgctggtgctcagggcagtgatgcgctgtggggtcactggcagaggagctgggtggcatctcagtggcatccgggcctctgtgtcctgcccctgcttccacgggatgtctgctgtttcattttctgtgtcttccttactcattctcattcatgcttctgtgtctccctgatgcgccctggttctgaccatgggcccttatcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcaggtactgcatggctaggcgggcacgggcagcgtgtgggctcggtgtgggcattctagtgcctgttccctcttggggttgggagctggggcgccctagcaccgtctccccatctctgttctcagcaccttgcctggtgtctggcaccatgagaggggtgaacaaagggggcccttgggtttttgtggccaggagattattagagcaggtttccaggtggtctgtgataggtgcgacccagggctgaccttcacctcctctcttagatcgtcctgtgtgtctggaagtcacggtgtcctcagtttgttattaaagccaagcatcatcacagacacatcctgctagcccgtgaatgctggcacgtgtccagtgggtgccagagcctggtcgtttcctgggcagttgggtcactgaaaaggttgagatggagtggcctgagctgctttttgtttttcttgcagctgagctgaaggagaagttacaatcagaaatggagaaaaacgcccagatagtaaaggtacccgggatcgattctaaaatgcacgcctctgtgtatgttgtttttcctttctcgccaggtcccatgagaacgctcctcaccttgattcagacagaagccagtcgaggctttattagaatatgctggttgaaagtgtattgcgttctttgtttatttatatcatttgtatttgtcagaaaacttgttttgttgtttcacattgacttgcataacacaaaggcactgctcggcccctccatgctgtcttctgagtggcccccatggcctgcccctgagctgtgttctgggacacagcctctgccctcgtggatgtggcagttccctgcagtgcatggggtgtgggtgctggggtgccggggagaataccacacagggaggaggttttgggtggggtgggttgcacctgctgtgggtggcctcactggggaccacaggtagcagtgccccgtcattgccaggccctccgctagagggctgagctgtcagccatgctgagtgtggaggcccttcctgagtcaggcatctgggcagctctcaggcccttggcagacgatgggtgttagtccaggcttggggttgtgttccggtcacctgctcctctgacgcaggcagtgagacccatttctcagaacacttgggacagagcccagcccttgggtggaggttggcaaagttgccattggcccctgggacttatagggagatgtattactaacgctttgagggtgactgtgtggattaggccttgcgtgcagaggctcgtctgtttcggggtgggtggtccttgtgcagaggctggtctgtttcagggtaggtggtcctctcgctttgtgcagatgcaggtctgttttggggtggatggtccctgtgcagaggctggtctgtttcagggtgggttgtccctgtgcagaggctggtctgtttcagggtgggtggtcctcgtgtgcagatggcagtctgttttgtggtgggtggtccttgctcacttttcctcaactgcttgcctcctggatgcttctgcttttctgtcctgccagcattcaggggagagactgggtgtaaggcctgtcaggacagtttagttgggggccatgactgcccattcttttttttctttgagacagggtctcattctgcctcccaggctggagtgcagtggcacaatcacagctcactgcagtcttgacctcctgggctcaattgatcctcctgcctcagcctcccgagtagctgggactatagttgcatgccaccacatcccactaatttttgtatttttttttttgtagagatggggtctcactatgttgcccgggctggtctgtaaccctaactcctgggctcaggcgatctgcctgcctcagcctctcaaagtgctgggattagaggcatgagccacgttgcctggcctgctcagaggttttgactgtgtgatttaaatttctttagcacagataatcaactattgagtttaatttttttttcttttaaattagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgtaagtaatgaaaatgagcaagtttggagtgggactgaattttcctaggtagtactggaaggaatgtcgttcatgtcaccatgcgtcattgcgcacgtttcctaccttctaaatgctggatggccccatgcacgtgtgacacgctggtggccgtcatgggtcacaggtctctcagggtccttaaaccttcctgatctttgtttcagagatttttcttggcatgttcagttgctaaattattacaaagcagcagctttgtggttgttcacttttcatactccagggttgtgtgttccagcttgaccctcatggtgggtggcatgggtaggcgatgtcccctggtgctatcaggcatgtgaggctcaaacgaggggcccgggggcgcccaggatggggctctgggtggcagcgctctgggtgcaccattattgtcactgaggtcgctgttgaggagagtgatgtcttgtaaaccaagtgccattgctttacctttctaggggcccttaggaacctggagagtcatcatcaagcagccattgagaagttacgtgaagacctgcagtccgagcacggccggtgtttagaagacttggagttcaagttcaaagagagcgagaaagaaaaacagctggaggtgggcagcagcttcgttatttaattacttggtatattagggaagttttaacagattttggaattgggctatttcgtattgtgttatttgctaaaacttaagttctaaatttaaagagactggctgggaacagtggttcacgcctgtaactctatcactttgggaggccaaggtgggcagatcatgagctcaggagtttgagacaaaaattagccaggcatggtggtgggcatctgtaatcccagctactcgggaggctgaggcacgagaatcgcttgaacctaggaggtggaggttgcagtgagctgagatctcaccactgcactccatcctgggcaacagcgagcctccgtctcaaaagcaaataaataaaataaaatgaaataaaaaaataaatagagtgttagtggtgaataaaagtgtaaggatatagtctctgagactgatttaataattacgttcaatcttgtacttaggaatgcatgttctttgcaggcgtccctgagacagttacacaaatcgcagacactaggtaggagtgtaaggccacatcctctaaccgtgatccagtacacacgagattcctaggaaaagttaacaagcatttctttctgctgtgtgtattcaagatgcttctctaatgaagcactacaatcaaaatgttgatgtggccaggtcctcattggaggcctgacaaacctgagactcaaactgagtatcccaagaatcagttgaagaaattaaagcataaatcagagatagggttaatcgtggtgtgtgaaagatttacaaacatgagaatatggaagtagttggggtctagggtcttagggaggcctgtcctgggccccttgtgtctcccagcgggactctggtgcccacacaccctcctctcctgcagagagtccaggccggggctcactccacacccccagtctctccctggtcccttccaggctctccctccgagatgggaaagagggggctggtagcatcttctggtcctgatgcccatgattgggaaaggtaggaggagccgtttccatgaggaggacaggccagccccaggtgcagcgttgcccaggaggaaatcacgccatgctgcgctgggctgggctcttgctgattgtacagaaaagtttagtgtcacggtgtaagaggtacctgcttccttaatgtagaagtattgaaactgagagacctcctatttgggagtcttgggtactgtgggctagtaagactccctaaattccattcagcagtctgtatgtatgaccctaaaccgaagcagggaggtgcacaagatgaaactgcaccgctgcggccggcatggaacctggccgtgccacctcctcagctgagacagacctggaagttcctgagattctgaaagtgcctggccttgtggggtcagcgctgaccgatccctcttgtcacggacagagctctctcggtctctgctgtggctggctttctccgagctgcaggtttgggatgtgagcttttacccttaggatcgcagtggcagggataaaaccgcacacgtcactgctggggtgggggccttgagctcattagggtttcacctggacactttgctttttccagttagagaatcttcaagcatcatatgaagacctgaaggcacaatcacaagaagagatcaggcgcttgtggtcccagcttgattctgccaggaccagtagacaggaattgagtggtgaggaattgtattggaaaattcagatcctcaaaagctgaagctgtgtgtttttcattgttgtaacaccaagccagaatttaacaattctagcaaacacaaaaaagtggatttacctgtttgacatcctgaaggttgaggtgtctggtttgaaagtggaggtttgctttgtgggagagagccctggttttatgctaagcaagtcagtgcagcagtgacgtgcacctgtgtgtccctcaaggccaagagcaacacttgcagggggtgccttcatgtctaaggaaagcttaccagtggtgctgagcgtttgcctcggaaggacggttgagtgctgtccaagtgcgggctcacctggtgtctggggtcacagggcagtgccccacatcctgctgccaggctcctgtggccccagctctccaggccacttgctgaaggcagctctgctccaggtgtccccttatagctgagcacctctggagaccccgaccccaggccccccattccgtgtcagagaggtctttgtgcagcaggcttggatggtgcctgagggcaggggctggccaagcccaattcaggcaccggcgcccaggtccacaggacaggagggtgagccactgcgtgtctcctggcattcatgtgccgacagagccttttggcccaacttgtccttgtgggtggtgggatttgaagcaaagagcacttaggagaaagaactggagacactgccactgtcaccagggcaccaggcctggctccgcctcccagccctgcgccctgccgggaccaggtgcagctgagagcatgtcgatttatcttcctctgggggtctgtctgtcgctggaggctggagaagagagaagctgagggggccacaggcacagctgctccccgcgggctccggctctggcttggtcctctgcttgtctctgtcctgcctctcgggacccatgcagagaaccccgatttgccctctctggggtgcccgttgctggctgtcagctgctgtagagcagcgggctgtattctgaccatagtagccatggagacaagttcttttagggtccgtgttgcttctctgctgctgtgtaacaaattatcacaaacttggtggcctaaaacaacacagttgtcagcttacagaaagtccaagatggtacagctgggttttctgtccagggtcccccatagcccacatccaggtgtcagctgtcgtgtgccaacctgatgagcctgcttctgggctcgaggttggtctggatccagtttcctggggctgcaggaccatcgtctgtctccttgctggctgtgccccccacatccctgccacttcgagtgctgcttttgctcccagccctgtggctcttgccaccgcttggagagagctctccacattcaggggcgtacgagagtctaagccgtaggggtccctcatccctctccggttctgggatgggcccttttccgagttctgcccccaccacaggtaaccaggctcttgcctctcgcctggcttgttgtgggtgtcccattttaagacgattgcctgactccgttatgttgcagagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggtaagcaaagcagttccagcctcagtgagtttctgccatacaggggccaggctctgagttcaggggtagttttgttggtgatttcatgctagtaggcaccaatggccttttatacaaacacattttatggtccagatttaaaagatgacacaggcacgggcacccgagagtggcctgcatgtgtgtgtgcgagccattggtggccacactctgtccaggcctgcgtgcacatgttggtggtggacacgctcgtgtaggccagcatgtgtgtgtgtgtgcatgagtcagtgggcacgctcttgtccaggcctgcgtgtgtgtgtgttggtggcaggggcgctctcctccaggcatgtgtgtgtgttggtggcaggggcactctcctccaggtgtgtgtgtgtgtgtgtgtgtgtgtgtgtgtgtgtgagagagacagagagagagtcagtggcgggcacactttcttccagacctgcatgtccctgtgccgtgtctctggctttgtgactgccacggctccccgcacatggacattgcccgtccttgactggaagcacgaggaggcgcctctgctgtgagcagtcggtcctggggagggaatggcgcacacatggaaaaggggtacgtgtgtaaagcttttataaaatgttttcccttcaggttgtcctgtgtgggtttagaagagaaacctgagaaaggaagaaaagatcacgttgatgaactcgagcctgagcgacataaggtaattggccgcgcgctgagaagtgggggagtcctgtgctcttgaccttccagccctgcgtcttccacattatagagcctgtgtttccgtccttcccaccttgtccaggggaggaaggctgcttgcggatgctgccccgacctcactgctgctccgcggtgggcctcaccatgcactgtttgatcaggaaagggggtggccgggggagccggagcccctccctcagccctgggatgccctggctgtgggcaaggcctccaccctgcagtggggctgcattcgtcagacttgacagtggcagttcaaagggtgtgaaattgtgtctttgctttgagtccacacggagcgtctgctggcttttgtgtttcttccttgagttgcttccgtgctgcgacttctgtcacctttaacttctgtggggcaaactgtccaaacggagcttctgggatgtagactgttctgggtctgtgctgccagtgtggtgcccagcagtatgtgtggctgtggagcacttgatgtgcagcatgagcaagcccggtgtcgggctccgggggacacacgggagggcagggaggagacgcaggggcagcaccgcgtggcttgttgcacggtggaaccagtggaggggaactcggggcatctgggctcagcggccaggagccctcactctggagcagggtccctgggcctgctggaggccacagggtgtccaggcagggtggcagcgggctgtgtgccagtttgagttccctgcaaagcggaccccaacacagaatttgctgcacaagaggctatgggggaaatgccagagaagggcaagggcccggctggaacaggcagccaggaccttcccacgagcaggccttgcaccagagagaacccaggaagggctggggtgggtagccccaccaggcattcgtgtatcacctgagagccaacccctgcctctgcgcgtgggtgtgacgaggacccagctgttagtgggcagtggtcacaggaggctggccttgagagcccagccctgagatgtgaggccaccaggggagacgcgaggggcacgtgccctaccgaccttgctgctgagagaattgaggagaggtctgcccggtccagggccctgccgccctgaggagcaccagtccctgtcagtgccaccaattcttgtatgtcttccggaggcctgactgagagacgggtgtgggcgggagagcatgtgagcacgccagtgggctggcggggttcaccagggcgcagcgtgtggtctcatgaacc

SEQ ID NO: 819 - DNA, 16423 bp, Homo sapiens
aaacaatcagttgggtttttttcttgtaattgatccaaatggatttaactgtgctcgagggttagtcctggtttgtcttttcatgggaggaccacatcgcccccgtgggcctcacctcagctcaggactttgatggccagcgtctgttttactttgaaaggcctcagatttattcttgtaatctgttcacctcactccatattgtcacttgaaaaaaagctggcacttcttttccccggggaaggaggttgcaccttgaccatctcaaattgtagcagggtggagatttagcgagaaaagcgggtgctggtgcttctcccacccagtgcaccaggggcaggtccccagtgcccctaggaaacacctgcgcaggagctgccctctcctcaggccgcatcaggtgcagatggcacctttattttttttctctctttttttttttttttgagacagagtcttgctctgtcgcccaggctggagtgcagtggcacgatctcagctcactgcaacctctgcctcccgagttcaagtgattctgcagcctcagcctcccgagtagctgggactgcaggcatgcgccaccacacccagctgatttttgtatttttagtagagacggggtttcaccatgttggccaggctggtcttgaactcttgaccttaggtgatccaccctcctcagcctcccgaagtgctgggattacaggcgtgagccaccacgcccagccttagatggcaccttttgatgcactgtctgcacctcgcctcctccagtccaaggcccagcgcagcctccctggacacacagccacccacccttctcctccttctcctctgggacacacatctgtccaccctcctcctcctcctcctcctggacacagtcgcccaccctcctcctcctggacacacagccgcccactctcctcttcctcctccttctcgacacacaaccacccaccctgctcctcctcctcctcctcctggacatgcagccgcccaccctcctcctcctggacacgcagccgcccaccctgctcctcctcctcctcctggacacacagccgcccactctcctcctcctggacatgcagccacccaccctgctcctcctcctcctcctggacacacagctgcccacactcctcctcctggacacacagctgcccaccctcctcctcctggacacgcagccgcccaccctcctcctggacacacagccgcccactctcctcctcctggacatgcagccgcccaccctgctcctcctcctcctggacacacagacacctaccctcctcctgctggacacacagccacccaccctgctcttcctcctccccctcctccctgctgtttgctaaatgtgccccaactactcctccaggctctgaaacccagaggctctaacaccagaagtgctgggcaggtgttttatggtctctagggtggcacggaagcatgcttggtgctgaagcctgctgagacctgggctcacccgagcccctcgcagccctcgtgagtgtcccgcacgtcgctgggacgtttcttgcatgagtgcaggtgccgcctgttcctgggtccacactgcgtgcacctcattggcgtttagagcctgaaagattcttaattccacagaaatcagggaaggatgggcctaggcccgcagttctgaggagacccatgaacctggttcgtgtgcttgtcatgtgctctcgggaaatacatcctgtgtggagagcccttcgcatctcctgcggcaaacagtcttggggccctcatgacaggaacgtttctttgaattttttttttttttttttttttttttttttgagacagagtctcgctctgtcgcccaggctggagtgcagtggcgagatcttgagatcttggctcactgcaacctccacctcctgggttcaagcaattcactgcctcagcctcccgagtagctaggattacaggcacccgccaccatgcctggctaatttttgtatttttagtagagacagggtttcaccattttggccagggtggtctcgaactcctgacctcgtgatccacctgtctcagcctcccaaaatgctaggattacaggcgtgagccactgcacccggcccaattttttgaattcttaagagaaagctcagccctgcctgccaaattcttagaagttacacacacagaaactccaaattcatcacataaaccacaattttgtgttttcggtgctcagatatagaaccttcccatcctttttcccttgtatgaagcttgtgtcctcaatcaccgcagaaataggttatgacagttgccttttaagcaaggagatgtaagccttggttctgtttctcatagaattaaataaacttgaaatgtgcagggctcattgtggaatcacccgagtgctccgaaactccctgaaatccactcattaacaccagacaggtgcgactcctggtgagccaggtattccaccgtgcacctgttctgtttcacctgcagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggtaggtgcctgctctgctcccaggcctgctgttcccgtgggaatgtggtctgcccggcgccacggcagctgccattgtttgttcacctcctgacagcacacacctcgcagtgctgtgtggggccagctctgcaggactggcatcatgggcgcatttagattatttcagttgttcaggtatttttaaaatgcctgagatgcatttgcctgcctcagacataccctgggcatgcttctccactgacgctgactccaacgggcatagcccagacacgtcttcgtgtgtgatgggcatagggttctttgtccagaatggttttttagatttatttttaggaatgcttcctttttttttttttttttttttttttgtgagatggagtctcgctctgtcacccaggctagagtgcagtgacgcaatctcggctcactgcagcctccgcctccccaggttcaagcaaatctcctgcctcagcctccctagtagctgggactacaggcacacgccaccacacccggctaatttttgtagtttagtagagacggggttttaccttattggtcaggctggtctcgaactcctgacctcatgatccacccacctcagcctcccaaagtgctgggcttacaggcgtgagccaccatgctcagccagaaatgcttcatatttttaacaggtttcacatatgctaattaattttaatttatgagttagatcgtattatttctaacataatcattttgggattttgtgtatcttgagtaagataaaattaaaaatcaggtatggttgggctcatgcttgtagtctcagcactttgggaggctgaggcgggaggattgcttgagcccaggaatttgagaccaggctgggtaacacggtgagaccctgtctctacaaaaaaaacacaaaaaattagctgggcgtgctggtgccgcccatggtccctgctcttcaggaggctgaggcaggaggatcacttgaccttgggaggttgaggatgcagtgagccaagattgaaccactgcactccagcctgggtgacagagtgagaccctccctcaaaaaataataatttagcagatacatattatctgaaacatccatatactatcatttcatgcaaaacaatttaaatctgaaatatttactattggctacattaaaatattcctaaagagctgtgggtgaatctgattaaattgttggaagcattcgacctgtgtgttcaccagttttgagttgtttcatctggggtctatgtgggaagataaattcaggcctttgaaagttttcacctggcaaagtcagcgctatgatgtaattactcattattttatgaccatttaaaaatctcttaacaggagaaagatgtcgaagattttatcacaacatcctttgattctcaagaaacattaagttcacctcctcctggattagaaggaaaagctgatagaagtgagaaaagtgagttggttatctttcatttttaattttttatttcagtggtttcctagcacagaatagtcaaaagaattcctgcatcctttgcctggttctgcgtctgccccccgctgacctccaccccggctctgcgctttgtcgggcgtgcacctggggcctcttgacttctgaaaacacgcctgtacctttcacagagccaaggttgctggcccgggccacgctccaccctggaatgttcaccctgatccaaggctggcatctcagctacagctacagaccttgctcagattcacccattgtcccagtagtgtcctttatggaaaagacaccccagctcacaggctgtgttcaggtgtctttggcaggatggagactggggcggtgcacgccatgtttccaggctctgctgccttgcctgcccaccctgcctttccctccccttggggtggacgtccctctctctgctgtgggtttcggggcaccggccctggagaggagccgaggggccgctgactgtggcgtgtcctcgcgatggtgcgtggggggctgcgtctccccggacctcgtggcgggaggtgcgtgggcttgacttgggcctttgtctgtgatggtgcctgccaggtttcctccacctccttctgtgggagatgcggagactgagtattctcttccctctcatgctcacgcccactggtctcagcctcccttggttgccctggcccgcatcagttgttgtggcggttacctgccacaccgtcctttttttcatttcataactttttctataattgttgtctttttacaagtcagtcaccttttgaggtgctctaactttttaaaaaatctgttggatttttcagcgatttagtgttttttgagaacatggtcacaatttaattagaaattttagtatttgcagagtagggccagcagctttttaattttgtttttatttatttgatgaatagtgagcacgcagggtgacagttatgggtgctgaggggaccgtttcctgagcagcctgtgtcccagctccccactcaggactgcagctccctggggatgccacattcaactctcagaaatgtcttctcgtatttgctttattttcaaactctatttgctgtttaaagtggcatcttcagccctcctagcccctcgccacacgccccttgctacacgaggtgcagtctgcacgccctgtgctgtcacagccaaggtttgcccttaaaggacgcgccccgtgttccagcagagccgctgggagcgtgcgtccccctcgagccacttttgtttttcttggctcagtttctcctgtgtgcttcactgctgtcctcgcacacagtgtccaggtgaatgtcatccaagccttccaagcacagcaggtgcttccccaacaactctcaggggctcccaggcggccccttgcccctcctcaacggtctcttatttaccgagacagggtcttgctctctcacgcaggctggagtgcagtggcgtagtctcgactcactgcagcctccacctcccgtactcaagtcatcctcccaccttagcctcccaaagtgctgggattacaggcatgagccactgcgcctggccagccccctcttttttaaggaaacatgtccccagaagcctctgtagaaaaggtgtctggtaggtgcttgtttttgagaacttcctcgtctccctggtggttgtcggttggttggctgggtgcagacacttgggttggaaggtatcgcgtgcctgtccactgcctctgtgcccgcgccctccagtgacgcacaacctttgaggggcctgcgcggtcagggtgtccgccgcctctgtgcctgcgccctccagtgacacgcgaccttggaggcctgcgcggtcggggtggaggatttcctcctcgttcgtccttcctccattcacgtatcctatgattttctctcttctttttgtaattcctgttattcaactatatcaggcctccaagattgattgtcaaattttctttccttatttctacttcttttatttttgttctcatttctaagaggttttctttagaactttatttttcaacatttgtgctgagtgttctgtttctgtgctcatattttaaatttctcagaaatctttcttatcctaactgttcctctctcctttagctttagctccttggtttctttcttttttggagggcgttcttgagtttattttgggcacagccaggtgagaggtccctgcacctgaaggaaggtgttgggctccgaggtgaagcatggtttgtgctgaaggcacagggtccagtgggacaatggggaatgtggtcttggacttgtggagctctgaccacccgctggcggcacctgctggctgtgatctcctctggatggagtgggctggggcatggtgctgggcacccatgtctcggtggcactgggtgacagtgtccgcagcagtcacatcccagagttcctggtacacgctgtgggagccgcagctcaggcagatgcaacatccttcaccctcagagatttctcaaacacctgaagtagatgatttccccaaagatttcttcgttgtcatctttagctgagatacacagggcagaagtaggacttggcaccattattagacacaaagatttgcaggcggtgggtggcctgaggcattttgaggggtacaggcagcaacccagcaccctgcacccttgcactgctcctgaggccttcatgctgctctctcggcacttgccgccactcacaaaaagcactttgttggttcattttgtgaatgacgtgcccgttatttctctgagggggtcatcgtcatcctctgaggttgtactctgcctgcatcgttggcctctactcctccccagtgtgccctctgctcagcaggctgtgccggggcatcatcccccaggtgcccaagtgctgcagcctccgctccccagggagctttgtccacacgggggccccgtctcgctggcatcctcatcctcctgttttgaagtctaacaccctttttccagggcgcctcctcctcgtctgggtctcgtgtcccttacacgatcctgcctcagtttccaaagcgcccccctccctgtgggctggcgcagctgcaggtctctgggatggaccagggccctgggaggttttgaattttcctccttgagaccccatgcccacctgacacaggagctgcaccgcagggaccccatggcaggcacggtcagcgtttcctgagcagtcattggatgcccgtccgctgcctgccttatctccgtggctggcgtggagggtgcaggccccgcacgtcccgctgctcttgagcttgcccaggccatctgggttttgtggagtctttgggggccacgtctggagaagtgagcagaggtcccctaagattggcgctggaatcagggactcaggtgatgttctcaacctgtgaagttgcgttttcttacttgacgtgcgtctttctcaccagggttatgtttttatgaagcatttttggggccatcagtgttttctccgtgagcagaatcacggtgtggttgtcgctggggactgcgggccgatcacccctgtcctgcctctgcagtgcgtcccctggggaaccccctggagagctgtgggtgggaccctgaccctgtggtgtttttaggtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggtatggctggcaggggcggccctcacagcttcacatgtgcagcctcggggcatcccccaagccctgtgtcctgccttgccggggagagccttggagggccagcttttcctgggtgcctctgagcacctgcattttaatgactcacgggaggcagccccacggtggccccggaagccgcccacccagccctgcactggccccttaggtggccgcctcccatctgggcagggagggtcctgtgagcccgtgggcaggtggtgttgccccgagtcgcagagccggcctgtgcctctctcccgcctgtgcctccctcctgcctgtgccctgtagagaagccgaggcaccagacgccgcagtgctctaggactgagccgagttctcttcagacgatgggagagaagccactcagcctccttggaatcaaccttgaaggcagaattttgtggaacttttcataggttttctttcctctcccagtttagcagatcattttatggcaaaaccattgacaaaaacttggctaaacaagtgagtgatagaatgatgccactacaggagcttagtcaagtggtaaacatattcccaaacaaaacagtcttcacatcagtgaaacctcttctgagactgcgcagtaagtcctcacttagcgttgccccgaggttcctggaaactgaccttgtaggaaggacactcctgtgctgctggccgcagctcccgttgtctcagagggccctgagggtgcctttgttacatgcgtttaaaagtcgcggtttccaaaacccatccatgacgttaagtgaggacttactgcattcagaataaaacttgttttactttatttggctgggcacggtggctcatgcctatgatcccagcacttcgggaggctgagacaggaggatcgttggagcccaggagttcaagaccagcctgggcaacatagtaagacccctctctgtcagaactgagtcagttaaacctctttttttcattaaaataaaaaaacttattttactttcttaaacatggaaattggagattttttttttaatcagttttttatatcttctttgcatttcctttttttttttttggtgagacagagtctcactctgtcacccagcagtgcagtcacagctcactgcaacctctgcctcctgggctcaaacgatcctcccacctcagcctcccaagcagcttggattacaggcgtgagccaccacacccagctaatttttgtattttctgtaaagatggagtgttgccatgttacccaggctggtcttgagctcctgagctcaagtaatctgcccacctcagcctcccaaggtgctgggattacagtgtgagccacagcgcctggcctcaaatttttatacaatataaaacgtcaaggagatgtttctgttagtgtttcctatggaaaacaacctaatattagaattcctgatttttaaggaataaatttgattaatgttaactcttcatacttaggtttcataatttaaaaagaaaagcacaaaaggcaggaaaggcctcctgtagcccttgaggcagcagctgcgaagcagaggaggagggggagaggaggaggaagagaaggggagggggaggggaagaggggaggaggaggaagagaagggagggggatgaggagggggaggggaggaggaagagaagggggagtgggaggggaggagggggagggggaggggagaggggaggaggaggaagaggaggaactgctgtccagggagcacctccagctttgaaaggtcccaagtccagttgaaaatcacaaggagtttttttcatggatgtctcagactgtttcaaactcagggttttcctttattgtcttaatttctggcctgtgttttagagtgtggagccctggggttgtgcccacactgacgccgcagtggggaactgagtggagctgggtgcttgccccacttggaggtggctccaggcgcgtgggggacacccactgctcagatgcagccacagacgccaagagtgtggtcgacgctctaatagcccctgtggtccctatgctgaggaggctgagaggtcctgagcacgggtggggccccggccactcttggccacctctggccgtgcctggaattgagccataagtgggcagggtaggtgctggagctcaggaaatgaggactcccctgcctccgccgctgccaccaccaccactgctgacaggcagagccgcctggtcctgagtgtggagatggcagaaccttctcagccctagtgattgtgtctgtgggaccccccaggctgcctcacaggccatgttctaaggtacccactggtctctgccccacttcccggcctcacgggaacccacctgcaagggccccgtgtcacctggcgggaagctgtggcccagggcctctgcatctcttctttgtaagagatgttttttaaaatgcattttctcctctatacagaatctagaaaagcatattaaaaagaaggaaatggcctgtcctctgcagctggaagagaggggccaagcagcttcagggcctgcccgccgccctgctcccccggccctgctcccactgcgccccccccaaccctgctcccccagccacggccttgctccccccgtctccgctcctccccgcaccaccccgctcccctcaaccccaccctgctctgccgcagacctcagtttgcatccatcctgtgccacatacgttatgtttaaagtaaaagtgttttcagttgttagagatgaacatagtgtgcaatttggtttcacactttagtgttaatatttgaccttttttggcatatcgttaaaattacaggaaagcctattttcagtcagtcacacccgtcgtaggcttcatcattgcctcattttgcatttccctctttttggactttattagattatttttctcttcaggtttttatgcagacgtgtcctgtgcttgggtgtgtgctcatgtggtggtgaccgcgctgagcctctgggctctgggctctaggctggtcgtgacaccagcttctccatagggccgtctgcttacccctcagcctctctggcgagacagtcaagtgtgtgtccggacaccagctgctgcgtaatcggtgggataaagcagccgcctcgtgttcacagacctgtgggcagggcctgctggggatggttttctctgctccccgtgcccagcacaggcagcttcaccccacgctggtggtcggcactggcctcagccggaccacgcacagaggcctcctgggtggccatcgtgtggccttctcgtagcgtcccaggtgggcagggagtgtgtgatatgtttgtgatctcgctgtggacattggcctaaagccctgccctgagctttgtccaggcttaggcgggggacggtgtccccctcagggagcaggtggagtggaggaagtggcggggccatctttggagtggcttatagagaaattcactccaagcctggcttccgtgttgtctctctgaaggtcgggagaggtgggcttgaaaaccttgtagcttgagaagtgggtgccgcctgtacgaagccgaggcggtgccctccctctccacagctgcccgcccttcacagagtcctggcggcagctcggggccgcaggtggtgtagagcgtggctgtgtggggtggcaggcaactcccttctgacgcgctttcccgccacaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggtttattttgcccttcacacacttcttttccaaaggatttaaggagcttgtggtaatggccgcgtccttagggccacgtggacactaggatttctttctttttttttttttttttttttttttttgagactcggctcactgcaacctccaccaccccgggtcaagcagttctctgcctcagcctcccgagtagctgggattacaggtgcatgccaccatgcccagctaatttttgtatttttagtagagacgggctttcaccatcttagctaggctggtcttgaactccagaccttgtgatccacccgcctcagcctcccaaagtgctgggattacaggcatgagccaccgtgcctggcctaggattttttttagcacggccaaaaagactgaggtccaagaaccctggggaggccttcccatctcccacagccagcgcaggctctcggggcaggttccctgcgggacgtggaggtgtgtggggggcagaagggctcagggctttcaggcctgtgccctgtgtgagcctgcggggaggctgagagtggtccctcctggccatgtggccctgcggactcggcccattccagcacttgtcccccagggcctctcctcctgccactcgggtgacttgccctccggcctcattcctccccttgggtctctcctacctccccctccacaccccaagccccagcaactggacctcagggcctcacctctgtgctgtcgaccccgcaccccacttttccccaagtcctccccatctccctgcctgtctgcttccatcaccagggcttgtggaggttgtggagtgggtgccaactcccatcacgctccctcccatctccgtgcccaccctgtcctgcccctgtgcctgcctctgactgggatcaaagctttgtgagggagggaagggctttctccctgtgcctggaacgcacagggtgtgctggtgccatggagagccggtgggagggtcagccccacccgcctccgctcgcccctccagcaggccctggttgtgtgcgagcggcagcctggctggcattcaggaggctcattggtgctgcacgctgcccctggggaccagcgggtagccccttgcagccttaggtcccctccaggccctgggccttgaaggcacagcagcaggaaaagagggaaggagctttgctgacattttcctgaccttactttatcgtctttttcagtctcttctgtgctcatgatggcagcctttgcttctcgtgccttgaatggccctgggcagtgtgtgtcttctcttctgtcagggtcatttctgtttgaacggctgtcagtctgctcagctgccgtaacagaacaccccagaccagggggcttaaacagcagacattgatttcacctgttgtggcatcagggtgcccacagggttggattctggtgtaggcgcccttcctggtttgcggacagcgtctccgtgctgtgtcctcatatgatggagacagcgagtgagctctggtgtctcttcctcttcttaagaggcctcatttaccctgaatcacctcccgcaggccccatctccaaacgcagtcacactgcgaactttagggcacaaggatgcaggtgcatttgtgaggacgccacgtttcttccttcttcctttaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcaggtgagtgtcagctctgccaccaggcctcagtttgccccaggggtccagccctggcagagagggtgacacagactgttttgtgtgtgaatttcggtttgtgtgtttctctcgaccgctggaatgtggctgtcacttacccaggtgttgacgctcagtccatgcaggatgctgcacttttccacctgcagctgtaacaggacaggtgtgctcgagatgcaccctcaggcctcactcttttctgagataggtggctaaagaaacgttctccattccaagtagcccctcctaggttgagaggtgctctgtgtgcagggctgggtggcgttggtgccgtggggacactggaaatcctgttcctgccagcatacacgaggaaacctagtgttgagagtaactggcttgcaggcctcacgcagggtagtgcagcccagccctgacgcctgcaggccccagagctgaggcccagcagatactgtgcacccatcccagactcagcaggcttgtcccggcggagctggttttgagggcgggcagcagggaaggccggggcatggggtggctgcccaatgctcaggctgcttgtcccattgtgcccccagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcgcagaggcgcgcgggagccagcaggagcaccagctgcgcaggcagggtgggtgtcactgtctacactgcctggggcccggcctctgcacctgcccgcccgacactcacctgtgtggccttgggagcagagggtggtgacagggcatcatctagtcaagcccctgagtgttgccatggttgtcagctgataggactgagcagaaaggaccctggagacaggcagcgctgggtggggctggcacggaggcctcactcttgggcctgatgtgggcaagaggggcctgggttgggctctgagtgctggcagattcttgggagctcatgctagagttcaggaatgtctcgtaggtttctacatttaatttagcttcttcgggagtttttatgtagatgctcaggtcatctgtgggtaagtaacgattttttgtttcttgcccgtgttctctcacgtgctgtgccgtcagctgtgtgggcagatgccattccctgctcttagttttgggggcaggagctggtctcgtaccatcgcatgtggggtcaggcgcccttggtcagcttgggcaagtgccctctgttcctagttttggattccgtcaaggggaacggccttgcagttcagcccacggcccttgtcccggcgcccatgccctttgtgctctctggggctgggggccggcgctgtgcacatgctcgtgaggggcatgggtggggctggcgctgtgcaagcgcttgtcaggggcatgggcggggggtgccggcgctgtgcgagcgctcgtgagaggcatgggggggctggcgctgtgcacgtgctcgtgaggggcacgggcagggggtgccggcgctgtgcgagcgctcgtgaggggcatgggggggctggcgctgtgcacgtgctcgtgaggggcacaggggggccggcactgtgcgatcgctcgtgaggggcatgggggtggtgggccggtgctgtctgagtgctcgtgaggggcactggtctgttttctgttgtgcctttttggtcttggtgctgggtagcgccagccccacggggtgcgggaagtatttgggaagtagcccctccgccctccgttgtctagaattggggttatttcttccttaagttttgggagaattttccagtaaagccacctgggcctggagttccctctgttggaggcagtttagggtgtgagtgggggtgaggtggcatttttaggatggccccagggctatatcactcctggactctgtgtctcccggccaggtgggtgggccctggaaggaaatgggcccagagggcagaattgagcatcctggttccacccgcagtgaaagcttctagtccacagaacctcctttcttcccgaagcacatacacctcacgcccccacgagtctgtctctaacctggtgtcacttgtgcagcacgaggagctcatgggggcctgt

SEQ ID NO: 820 - DNA, 1856 bp, Homo sapiens
cagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaaga

SEQ ID NO: 821 - DNA, 717704 bp, Homo sapiens
ataatgcgtgcagtcacatagataaaggctcgaggctgacaagtggaaagcaggtcagtggtcgcccctttatctctgtttctaacactgtctccttctgtgtgtgtgtgtgtgtgtgtgtgtgtctccctatactactgtctgtctttctgtctttccctccccctctcttccttttcctccctccgaggggtcaagggaggacacaggacacagccaactttggctttgtgaggccccaacttgcagacgtagggcaggccgggggtggggggaaacctggctgcccaccagcccacctcctgagacaggcccttccctctggtcaggcccctatctcccctactcaccgccctgaatagcctccactcaggtgtgtcccgagcaactgggagccctgggccatgcctgctgaggacaaggacactgggtccctcctgggagagcacggaggggtcatctcccttaggagccaccctcacagcttcccggggctggggctggggcccgattcagaggagctcctgaatcagccctgtcacttgtggttcctctgccccatctttcttcctggaggtggaaacctacatggaaacctccacacagcactcaggaacactccccggctgcagacagcagctcctggagcctggaatggcaagggctgctgttttacaacaaaccacacacacacaccacagacacacacacacacacacagatacacagacacacacacacagacacacacacagacatatacacagacacacaaacacatatacagacagacacacatgcaggtacacacacacagacacatagacacacacttcatttttagggcaaagggtgcctatgccatgcatactttttggcgctaaatttttttcaaacagcgcaaagggattcataatgaaaactaataccttaggcccaggtgggcagatcacttgaggtcaggatttggagaccagcctggtcaacatggtgaaaccctgtctctactaaaaatacaaaaattagcccggcacagtggcgtgcccctgtagtcccagctactcaggaggctgaggcaggagaattgcttgaacttgggagacagaggttgcagtgagccgagattgtgccactgcagtccagcctgggtgacagagcaagacttcaactcaagaagaaaaaaaaaaaacaaacctaacaccctcggtccctcagttcacctttctgaaggcagtcagtttcttgtgaatccttccagagaaagtgaatgcataattcaaatattaatattgatgagtatatattcctgcaattttcccctaaatggcagcatcctttacttacagctatactaactttcttcatttaacaggtgatcttggaaactagttccatatcaaaacacttagctctgcctcatctttatgtacatataattcacatgtcaaaacatttaccctttaatgtgtacaattcagtggtttttagtatagtcagagctgtgcaactgtcaccactacctgattgcaggacactttcatcaccctaaaaagaaatcccacacccatgagtggacacccccgcatcccttgccctcagtccctggcaaccgctaatctgtcttctgtgtctatggatttgcctagtgtgggtttctcttataaatacaatatatggcctttcatgtctggcttctttcacttcacgtaatgtttccaagtttcctccatgttgtagctttgtatcagtgctttgttcctttatttatggtgaatattctattgtacacatatactacattttgtttagcccctctttctttttaacagcaatgtagtattccactgatggatgttatttaattttttttttttttattagacagtagtctcactctgtcactcaggctggagtgcagtgttgcaatcatagctcactgcagccccgaccgcctgggctcaagcaatcctcccacctcagccccccgagtagctgggactacaggcacgtgccaccatgcccagctaatttttgtattttttgtagagatgggatctcgctatgttgcccaggctgatgtaccttaattcacccatctcctgcaatgggcgtttaggttgcttccagtcttttgctactgcagatattgctgcagttaatttccttgtgttctttgcaaatatacctgtaagaaacttcctcgatgtaaaattgctgggtcaaaagggtatacatctttcagttttatatatttaccaactgtgctccaaagagggcacatacgaaggcgacattttccccatacccttgccaacccattttatcaaaaatgttaagtccttaccatcagctttgcattgtgattttcatttgaattctttttttttctcttactctttcttcttcttcttttttttaagaaacgatcttgctcaggtgtgcaccatcacaaccagctaatttttaaattttttgtagagataggggtcttgctatcttgcccaggctggtcttgaactcctggtctcaagtaatcatcctgccatggcctgccaaagtgctgggatcataagtgtgagccaccacacgtaagcacattgcttttcttttgagtgaagccttttcattctgagttagtcgtctgttcacaaattttattcatttattaagtcattgatcaaatgttattgatttgtaaaagctctttatatgtggagaaaattagcctttttatctaatttagacattgcaaaaatttccacaattaatcatattacagttggcatttgaacaatatggggattaaggcactgatccccctcatgcacactcaaaaatgtgcacataacttttgactcccgaaaaactttaccactaacagcgtactgctgaccgggagcttactgatcacataaacagtccataaggctgggcgctgtggctcacacctgtaatcccagcactttgggaggccgaggcaggtggatcacctgaggtcgggagttcaagatcagcctgaccaacatggagaaaccctgtctctactaaaaatacaaaattagctgggtgtggtggcacatgcctgtaatcccagctacttgggaggctgaggcaggagaattgcttgaacctgggaggcagaagttgcagtgagccaagatcacgccattacactccagctggggcaacaagagtgaaactctatctcaaaaaaaaaaaaaattaacacatattttatatgttattatatactgtattctcacaataaagtaggctagaggaaagaaaatgtgggtaggtgtggtggctcctgcctgtaatcctagcactttgggaggctgaggtggaaggatcatttgagtccaggagttcaagaccagcctgggcaacatagcgagaccccaactcttaaaaatatgaaaaaaaaattttaaaaagaatgttattaagaaaatcataaagaagaaaaaatatatttgctatttattaagtggaagtggatcatcataaaggtcttcatccttgtcttcatgatgagtaggctgaggaggaggaagaggaagaggagtgggtggtcttgctatctcaggggtgacggggctgaagaaaatccgcatataaagggatccatcagtttaaacccatgttgttcaagagtcagctgtgtttttgttctatacagaaattgtggcctggcacagtggctcacagtgtaatcccagcactttggtaagccgaggtgggtgaatcacctgaggtcaggagttcaagactggcctggccaacatggcgaaaccctgtctctactaaaaatacaaaaattagccaggcgtggtcatgcatgtctgtaatcccagctactcaggaggctgagtcaggagaatcgcttgaacccaggaggtggaggttgcagtgagccaagattatgccactgtcctccagcactccaacctgggtgacagagaaagactttgtctcaaaaacaacaacaacaacaaaaacagaaattgttacgcacccagatgtatcttgtacagcttctggagttgtatgtgccctagaactcttagaaaggttataaaaagggctcagcatctgtgcctatttatgatccatcaggggaaccacacaaatcaacagatgtccccagcccagaacgctgtgagtggtgaaccccagtggacacatgacccagtgttgggggtgtgaaacatccttctaggggtggagtgggggtgatgtctgagctgagactggatggtgagctcaggcagggtgagtgggtattggcaggcagagggacagggcaggaaaacccgcagacagacggagagcacaggatgggctagggaactgagacatcccctagcccaccctgggtgtgggggtctgtcccagggtctggggacagtgggaggacaagcaagctgggccaccttcagttctcagcctgagggggacagggagactggaaggttttcttcgcagggttgcttggctccatttgcctttgggaagattctgcaggactgaaagtatcagaggagacaagaggccatcgaggagaccgatgccacatcccataagggggtggaggctggatgggatggagccaaggaatggacacagggaaagaggacccagacttagccctgcaaggctgaccggatggtggggcagggacaatctatagtcaggtccccctccccctatatagctgtccatccacctaagactcccaggaccaagcctcaggtgaggaatccattccccctgggcccaagggctctgtctaatggggcttcccaagcatgatgtattccagccccaagcagcccagagcccacaggcagccattaccagatgcatgggtgggtgatggaggaaggagaggcttcccacccttggcatgggatgggggtctgagggaggccagagtctgtgaggtgctgagaacaaatgaggctcaggatggtgggggggtggtgccccggtcctgccccctctgccaggctcctatgggagccgagaccaaccacctaggaccctcttccaaaagagtccctctttctaagtctgtctgtctctttttctgtctctctgtctttccatctgtctccttctatgaaagatgaagacatctctctagatcactttgtctccctctctctctggctacctggcacactctcctgagagtcactcactatatctctctgtctctgtctctgacttctcctctgtccccaccactctcattctcctcctgcttctcagcaccaccactacctccccattcatcctggagctgtcaggtggggcgggcccacatgctcatgacccggcaggtgccacccgggactggcagggctggtgggctgctccagggcctctgctctgaggggcttctctggtctgcccttccctcctgccagatccgtccaaccacatggactcacagctgccacttcagatgcatccagccgggagtgggcttcacctcgctggggtgggagatggacagcttcccatacagaaggtcttaggccacgttcctaggctgtggtcaccaaacatttccctcaccagcctagaagttccactaccaacgatttagggtttaaatggcaggaagccctgttaactccccctcctcccaacattaaacattaaacacatcagtcattcacactctagtaggaatgagccaagagctcttccctctaccccctagttgggtggatgctgcatatggagatactgttcatccatttttgcaagaggagatgaaagagaagcagaggaagggacctgagagaaggcaagtagggcagaggtggggggtcagaaaggggaggatttaggagaaattgccagaggaggggaagggggaacaaacgttgctaaggagaaagcctctcatttgtccattcctgcagtcaacaaagcacagttgcaggaaagtccccgagtcctcacacccccattttccagatgcagaaaccgaagctcggagagaagggactctctagatcacatagaacatccaggtctcctcactccaacaagaggtaccctgtcctgccatgctcgcttatgtccggccctgtcattctgttgtcgtccccctgtacccccctcaaagatgcaaaacgggagattccagaggacaggaaggccctcccaagccctaatttatgattttctgacagcttccttcctcccactactcccttccagccccagtcccagctctctggggaaagaatgagctgggtgaatgagaagggcagctccatggagcataaataactcggctgggcagctgcaggctgcctaggtctcccagcgccccgaccctggccctgcagggtgcttccatctctgagagccagggacaggagggccaaaccccctgatcaaaagtgcagagagcagccattgctcttgggccctgtcctttgtctggtcagcagcttttaaggctgtggcttacacggtcccttccctttcatggtgtccaggcactgcttggcaattaggcctgggcccctgggggctgcggccatgggctctgggcaccccttgggctgcttcctcacctatggaacaggcacgatatgggaagagtgcctgggctcacacgagctaatgtgtgcacagggctgatatgacggggcacacccaagctggagagacagtcctgtaggacacagcgggaggaaagagtcccttagctacggcccccagagacttcacaggggaaggaggctgccgcccaggttgtttgttaagaggataaaacatttcctgtttggactaggccagggtggatgcgtcagtgaatctgccccagaggggctgtgtttcccggatcccatggcctgccctgggagggtgtctgtgtgtgtccctgtgtggtccatctgggtgtgggtccaggtctgggtatgtgtccacacattctctctggcctcatcagccccaagatgggactccaaatgtgagccaagttatctcttaccccaaagaagacctgcttcagggctcagccagtgggtggcagtgtggtctggtgggtaaactcatagacagctgcccatcactcactagccgtgagccccacacctggggacaataaggcttcctcctgggtggcagagaggatcgcagcagacaatacaagcaaaacgcttagcacagcgcctggcgcacagtcagcatggggaacggaagctgctgtcgttactggcggttgtggtctcgtcttggcagtggaaaggaccaggcccccaggggggaggccccgcccgcagggacaggccctgagacctcaagctagccggcccctctcctctcagtttcagcaaacattgaaacctcaaataatcaaaaccccaggcccccacggcatttcctgcctttccactcaactaggaaagaggaccagaaagccggctgtcatccaacaggaaagtgagcccttaaacgggggcttcagctgtgccccagggccactgaaggggagacctgacgttttcacactttcccagaagctcagactcttgagccagagggaccttaaaagtcctatgtgggagggttgcttgaagccaggagttcgagaccagcctgagcaacagagcaagaccctgtgtctacaaaaaatattaaaaatgagccagatgtgctgtcatacacctgtagtcctagctaatcaggaggctgaggcaggagaatcgcttgagcccaggaggttgaggctgcagtgagcggaaatggcaccactgcactccagcctgggtgacagtgtgagaccctgtctcaaaaaaaaaaaaaaaaaaaaaaaaagaagatcccatggcttgttttttcaggcaaagaaatgaagctcagagaggggaagtgacttgtcttgggtcacacagctcccagaggttgctctggaattgacaccctggcctatgggtcacatggcttgtggggtgtatccatcaggccacacagccacaaggtgataaatagtgataaataaatctatatttatttatccgggtctacagtgataaataaataccctggacccgggaatcccagcctcagtaaggacaggcccctctctgatgtgaaaatgttgataacagcttttaccaggagagtctcttgctggggaaattctgcagcggcctgagtctgccacaagtttgatggcattggttaagaaatgtggatgccattaatcgcaggagcatctcagacatgttgcaaacagacctagtagtgcctcctcattctgtggcacccatctgacaccctagacacctctcagtccctccaaggcattatccagtgcttctccttcctaaacagctgcatgtttgagcttcctaaacagctcaaagcacccctggggtgatgggtttttatctgggccgcttgattggggtttcagacaggcctggcatcctcttgggggcatggctcctcaggagtgacgaattatccagggtgttaagtcactgatctagctgtgtcaaaaacaagggctaaccagagaggtacaaagctgcatttcttggaggtcagagagatggcacaggagatgtgccaaaatttcacgtgaaaaggagggcaacagctccccaagggggcaacattggcaccatggtgatgtcgctggagggagagggagcccttgggggactatgtgaagtaggggagagtgggtgacaggccattaccatgatatctcaatccttcccacactcctgtaacgaatgtacaactgtcctccctgcaaaagaaacactgaggctgcgagaggggcaagacttgcctgagctaactggagcagaagtagcagaggcagggtttgaacccagctctcactacctgtcccttgggacagggcaacagctttctctatgtggacacactggtgatggatcccccgtcctgcctgcctgcctgcctatggtggcctatgctgcctgcccctggtgagtccaggaggggcaatccagtgactggcagatcctttctggggagtgtttctagaagggaccgtgggtctggacaagccataacaggaagtagccaagctgggcaagggcttccccagcccaggcctaactactgcccatcgatccaggcagaaggcggggttagagactgccctgggagattgggggtctgggtcccctctgatgagagctctggtctctccctataaacacacactcctatcacagacacacacataacacacatgcacataaatccacatcaagcatgcacacacatccatcatacacacatacgacacacacatgcacccctgcacacacacactacgcttacatatacctttgtgggatgtagagccattcctccagaagcccatccatgtaccccagatgaaaccacccaacaccaattcttaccttgttacatatggtgaaatcaaggcatagaccgaagtgctgtggttaagagctgttactctccgaagtcaggcgatctgggtacaaatcctggctctgccaaacccctgccacggtgctttaggtaaatgacagctcctttctgtggcttagtttctccacctgtaaaatgagaataagaacagactctgcacttatggggtcagcccagatctcctcctagggagactgcgagtgcctgggcctcagttttctcttctgtaaaatggggatattgtgcccagttcgagcagagtggcttgaagagtcacctgagataggatgtgaagtggccgcggtgaggtgcccaatacacgtggcgcgcactgctcaggaagctttccttggagggctggatcccgcaaaggtgtcgaaaaaggatgagtcccggatatcattcgctcaggtgaggtgggttcgggtcccggctgcgtctgggaccgtggcccgggcctcagtttcccagtctacagcccgtgggaggacacctcggagctggcaccccgcccccaaaagggccccgcggcgcagggcgtggggctcaggtggacacctggcgggcctcctggcgggggcgccctggccgcccgggcccctccgggctccttccgggttggcagcggcggcgcagggggcggggggcagcgcagaggggccgggcgaggccgggagcgcgcgcccccgcccccgcccgcccgcctcctgcccgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggtaagagctcccggcgcctttgcaccccgctggccgagggtcccggcgcgcacacgcccccacctccaggaagggctgggattggagggcgatccagtccccagcccgggtgagggcagggacacggccatcccgcggtccggctgaggctcccgcgagtgcggggtcccctactccatgtgtcggagctggctgcctcccctactccctccctttcaacccaggagctcgagaggagggggaaggggcgcaacgagggcgaagccctggcccttctgttcccctgtccctagggcccctccccctgcacttgggaaaggcctatgacaccccctagccgactcttctcggaccctctctccccttttccctgttcctgtttttttgctttgttttgttttttgtttgtttgttttgtacccaggctatttatctccctcggaggagggactggggtggagtctcacagcccagtgggtcagtgtcggagataccccagggacctggcattttggacagagaaaagagggagcacagtcttccttctgctctcctagcggcggggaacctcctccctgctggcctttacggaggagctcccagaacctgacatggtggggcccattattatatatagtgtcctcatcaatccttgaaggaccgaatgaggtagggaaaactgtccccattcaacggttaagcaaactgagaccctagggaattggcatcatcttttagcctcatgggctattcactgaagagctaggttgcaaatctgcccttctatccttgatgacagtgtttgaacctgtcctggcctctgtcctggctgcagccccagcgagggtcccctcctaaaggccagccgccgttgtccaaggcagacaatgtggagtagccaggcctctccaggccttttcatcccattcaaaggcctgcgcggcccccaccccctacggcctcaattctttaattcttttcagaaattctcctttcccagtggtcaggggccagcatgcccctgctgggctagcaagagcagttgacatgggcagggctggaggacggaggtggttgaagcatcagaggccagaagagcagttgtctgagacaggggtggacgtgtggcagatgttacagccaccacctattgtgtgcagacaacagttagcctgagtcggctccgttacctgcattcatcagctccagaatcctcccagctgcttggaggtatgctctttatgattctgtttcatagaggaggaagatgaggctcagagagggaacatgacctgcccagagcatggaagtgagccgccaggatcccagatgctaagaggacagagactatgaactcagaaatcccactgttaggctcaggatgatggtggcgacagcttaaggcccagaccgccctgcagccagttcaaggcagggcttcccagcctgggctcctcacctcccagggtctcctgggtgggaacaggatgatggctataaccaggtatctggtggtcactggggactgtcactccatgtgttgacagaagcctatcacagtagcctgagcatcccaaaaaccctgtgggcaacactattgcacccattgtacagatacggaggctgaggcctacagaggacaagtggcacctcagtccagaccagtcgatttccaaatccagtggctttttctctccagcagccttgctggaagagggaaagaggttgtcggcttgggggcaccaggaaaggtttgcagtcatgattaggagttaggggctccagccttggacagaatggagacagaattccttgctcttacaggcttgatgtgtgacctcaagtgggtcacttcctggccatgggtctcagttttgctctcagtttccttctttcctcgtgggaaggaccagcaccgggcctcacctgcagtggttcctgctatcaatcatgtcacatgggggtagggacctggagcttgaggagtctgtgggctaccagaacctccacttgtggccccatccccacgttgctggagacagcatgggggtgtcatgccctgtcagccttcctgccacccacaccccagcaccccaggcaccccttggcagccaagggaccagacgcagaaaagaggctttgtcctggggagggggtggcctgggaaggcatccagggggccgccccttgccccaggaaggtggtgacacttggagacccccggaaccagggtgcccaagggctatgcagagctgccttggcttgcccctgcccctggggctgcttcctgccccgctgaggtccttctaagcctggagtctgcttcctttaaccactcatctcagcgtttcagctgagggttcaagccttcaccagcccagatctctcgcccctgcagcaccggcttccttccggcaaatcctaggatcagggagaatggagggctctaaaatggaggggatctgccccagcctctgtctagggggctgcaatcccagctgatgcccacaggggtgacctgggtaggtgctttctcttggagcctgtttccccctctgtaaaatgcagaacctgataatccctattccaaggggaagaccttgtgaagaaggtactgtgctggtgtccccaatccccagggaagcccctggaccaagctgctgggtgtggggcccatgtctgggcctgagcccctcagtcccggaacaggaatgaacaatagctgttagcgctgtgctaagggatttgagtgaagcttcccccgctggaggaaattctgctgtccccatttgcagatggacaaaatgaggtccagagagggtcagggccttgtccaaggtcaccgatgtaggaagcagcagagccaggactggaacttcgcccctactgcggggctctggctctcatcataccacccctgcccgcccggtcctttctttcttctccttttcatcacagcccttggccccgggcccgcttggctgcctcctgcaattagcccctatcactgttccggatcgcagccctgggccctacagagacaaagtcccctgggcccctcgtggcagggggtggagtgtgggtgtaggtggggggcctttgtgggagtggccggtgccaggctgagctggtctggcctgtttctcccctcctggaggcctctgggggcctggaggtgctgagtgggcagaagtgttgggcccaggagggaagtgccgcctcttcccagcccctgccctcaccaaccccactgcccagcctcatccagctcttgggcagcttatcaatgaccacaccccagggaaggaagcccccaggggctgcagggatggagcacatggggatgggtcccttcatctgtggaaacctcgggtcccagctcctctggccggagctgctgcctgttctccatcattcagtcattcaacaaacatcgctgagcgtcctcaggctgagccctacacaaacttggtcccagctcatgccctcctccagcacctgcgtgagtgagtaaagcccagggctattgtgagtggctaatgggtggtgcccaacccctgcctgggcctgagggctgagacccaaaggatgaataagagttggctggagcaagagggaggggctttccaggcagagggatcttcatatgctaagatcagaggtgggaggaggggctgcatgagtgtgcaggagaggtgagcagaataagaagtgaagggcagcgcttgcagggctatagggagtcatggtgggctgcggactccacagtgggtggtggcaacattaggtctgcactttagaaagagcctcctgctacccctggaaggtggatagaggtgcaggagggtggcagggccaggctgggaccctgtggaggagctcgggctgatgctaggagtcctggggctggggtcctcaaggtgggggatggggtaattattagtgatccccaggtggagggggcaagggactaaacctgaactccacatggcatgagtgtcctctcctgtccaaaaggtctggctagccggccaccagctccatgtctcctaaggagaggattcaagcacagtccagattatggcaaccaggcagggacccacatggcaaattttttttttttttttttttgagacggagttttgctcctgttgcccaggctggagtgcaatggcgcgatcttggctcaccgcaatctctgcctcctgggtttaagcgattctcctgcctggtattacaggcatgcaccaccatgcctggctaattttgtatttttagtagagatggggtttctccatgttggtcaggctggtctcgaactcccgacctcaggtgatccacctgcctcagcctcccaaagtgttgcgattacaggcttgagccactgcgcccggccaacaattttttttaagagacaaagtgtcactctattgcccaggctgtagtgcagtggcgtgaatatagctcattacagcctcaaactcctgagctgaaacgatcctcatctcagcctcccaagtagctgtgactacaggcaagcaccaatggtagagattttaattaaggaagaagaaggaaaaatactgttttttttctctagctcctccctggtaaaaagaaggacagctctggccattgtggaccatcacaggcccacctctcccggcctagtctgggggctgggcatgtgagggctgttgtccacgtgtgtgtgtgtgagggcagatggctctgtgcgtgcctgtatagatatgtgtgagaagatggccaacagtaccctgctgggcctgccttcacctgtttgtgtacatgtgagaagtgtgtgtgtgtgtacacatgtgcctgcatgtgcatggatgtacatgaatgagagcactgtggggccgtgtgtggacatgcccagagatcacagcttcagcctatatgcgtccatgcgagagggcatgcgtgtgtgtgtgcatgtgcaggtgtgtcagtgtgtgtgcaagtgtgaacgcatttgcagggagaaggtttgactgtgactgtgtgcccctctgggcctgctttggtctgtctatgtccatgtgacagagccgatgagtgtgtgtatgtgaatgtgtgagggcacagagtcctgtatctgcaggtatggacttgtgtgcagggaggacggtcatttctgtgattaagtgtcctgctggatttgccttagcctgtctgtgtgcgtttgtgtgcatgtatggagctctgtgtttatgtggatctgtgtgtgcacacggaggcccgtgtgtccatgcgttgtgtgtacatatgcctatgtgtgtgtgcacgtgctcactgcagtgcgtatttgccctgtgtgcctgtgtgtgcatgtgtgtgcgtgtatctgtgtgtttgtgtggatctgtgtgcatatgcatgaacatgtgtgtccatgcattgtgtgtacatatgcctgtgtgtgtctgtgtgtacgtgctcactgccatgcatatttgctcctgtgtgcctgtgtgtgcatgtgtgtgcgtgcatttgcgtgtgcaggcactgtgtgtttgcgagcatctgctcactggcatagtgtattcattctgtgtccagggcccctttcctgtctccagagcttccgactgtcctctgcccagattgtcctcttcctccctccctccttcactcacgaagcccctgggccagcctggtgagtgtcacgtaggctccaaggagcctctgaacccccttaacctgtacaccaagttttatgcgtatttctggagaggagccacgattcaccgcaattttctaaaggggcttatgcccccactctccatattcaaccctaacaggttcaaaaccacacctttggttttttttgttttgagacagagtttcgctctgctgcccaggctggagtgcagtggcacgatctgggctcactgcaacctctgcctcccgggttcaaacaattctcctgcttcagcctcctaagtagctgggattacaggcgcacaccaccacgcccagctaatttttgtatttttagtagagacgaggttttgccttgttgcccaggctggtctcaaactcctgatcttcaagtgatccacctgccttggcctgccaacgtgctgggattacaggcgtaagccactgcacccgacccttttttttaattaaaaaaaatttttttatagagatggggttctcaccgtgttgcccaggctggtcttgaactcttggcctcaagcaatcctccttgcctcagcctccaaaagggctgaaatcttcacctactcattaggagaaacatttctagcctagggttgagagtgcaagctctggagccagagggacttgagttccaaccctgactgtgccgcctatcatgggtgcctggggcacgtcctggaccccagagtctcagtcttcccatctgtaatgtggcttttttttttttgatacggagtctcactctgttgcccaggctggaatgcaatggtgcgatctcagctcactgccacctccgcctcccagattcaagcaattctcctgcctcagcctcctgagtagctgggattacaggctcccaccatcacacccggctaattttttgtatttttagtagagacagggtttctccatgttgcccaggctggtctcgaactcctgacctcacgtgatccacccatctcggcctgccaaagtggtgggattacaggcatgagccactgtgcccagcctgaagtggctttttaataagagtgtgagaatttaactgagcgaacacgtggacggctctgggcacagctcctggcgtgcagcaagcatgataaacatagctactgttcgtgtagtagacggagcagatggaaagccctccttgctcccagacatggcagtttgagaaaagtgtcatttttttctcactttatatgcacatatctgtacatgtgcacgcatatagaaatagttgacgttctgtctctctcttaatgtaatagaaatgcaatcactgtatatccattggtctttgtctgcttttttcctccccgtaactaggtgtgatagctgggtctcaggtcagcacgcagagacctcgggctttgtcacagcatctggtttcccatgtccggtggctccatagctgtttaggctgttcccagttttgtgccatttctgatggtgccatggcaggcacctgtcacctctgcatgggatggctggctgaaggctctgttgagcttctcctgcttcatgggccaaactgaaccatcccttctcccagccttcccacctccagggctgtacctaggttgtttcctcttccagcactgattctggtgtggcacagaaagatgaagggaattccacagggccctaaattgagttagttgcctggtcctggcccaggagtttctccttctggtggtctggggtgggggcagggctgcagcgagtgggggctgcactgtggtcggcatgggagtctctgtgaaggccgggacattccaggtgctcagcagccctcagccctgcacagggtcacgggccctgtgctttttgcaggggttggggaaggagggatggtttcaggtgacccttctcagcctgggtcccccacccctcccagactttcttcctgccctcaagcctggggtcagcaggttcccaggccggggcgtttacagagccacagaccgtggctcaaggagatgaggagaagacgggagctgaggctctgggatggcgtcagaggctgggctaggccatccaccttgctgggttcaaatctggcttctccacgcaccagctgtgacataagcagttgtcttcacctccccaagcctcagtttcccctctgtaaaaacagggtgggggtaccttcctcaccatcagaggatagtgtaaatacctttagcatataataagtgctcaatatgtgcagtgcactccgattattagttggtgtttggagaactcagtcctctgggcttggggcattgattacacatcccagccattccacggaggggacatgggaatgggtgagacagggcctctcctcttgcatgctggcggagggggcaggcacaaattggcagcttaattcagcgtgacaggtgtgcagatgctgcgggagccagggcagggcaccatcagaactgctcgggtcagggtggagatgggaaaggatggagggaataggccatgtcacatctgggctttgaaggtaggaggcgccatggggagaagcggaggaagggtactccaggcagagggcccagcaccagcaaaggcctggggcaggtgtgggtacaggagatcctgagggttggggagttgggtaggcaaggcaaggatgtaggcaggtttccattctgtgacactgcctctagggagggaccgaggggcagatggagaggccactcactgtagttgtccaggcaagagccaggcagtgatgatggcctggatgggtcaaagttggagaggagagaagttggggagcgagagctcaggggaagatggcccgcttccatctttcccctgccattcattcctcaagacctactgagaactctctgcacagccccacccctagggccatgacattcacccctcagccacagggactccccccagccatttgggcccaaatgactttgcaagctcagggcttctcgctgcctggggattcagggctcttgaagagaacacggacgtcctcacccatcctcctggagtccccagcaggggaccctgtgtggtacctgagtttcctctctttgggtctgtttcaggaactggtgctcctatgtggtgacccgcaccatctcatgccatgtgcagaatggcacctaccttcagcgagtgctgcagaactgcccctggcccatgagctgtccggggagcaggtaaatgaggtggagaaggaactgatggcattccaggtggaggcacagtttgggcaaaggcctggttgggggactgcatggggagtgtgggggaagactggaccccagggtgggcggagcaaaggtagcatcagccgacaccattctcagcctatcccctgtgctgttgaagcaccctggagggcttcctgagggatggatacaccatttgcctgcattcctttactcagtgagtattcacgctgggctcaggccagcccagcctgcagggtcttcttgtccagctggtatccaatctccaatccctgtggcaaggtggtggggggatggaagggctgaatcccaaaatgcaggagagagcctccaaagggacctggaggcagcagaggatcctggaagctctaggtttgtccccatgggtgtccagggcagtgggagaggtcatggaggaccctgtctcagctgggccacctggggactctttcagctacagaactgtggtgagacccacatacaaggtgatgtacaagatagtgaccgcccgtgagtggaggtgctgccctgggcactcaggagtgagctgcgaggaaggtaggactgcccggccggctcccggagccctgcgacagcaggccaggtgcctccctgcaggtgcatggagccgtgaactattaagagagtcatgcacagtaccatgcctgctggggccagctgcacagagcctggctcagacacagtcagtgcttgttgtcccccctgccccccacggtgaccgcttgcctcttgggagactctcaggacccccagaagaattttatatatgctgcatagctcacattttaagtcatgctatcctaaatctttcctccacactcggggaaaacccatccagacatttctgtatgacacgataacagacattacagagaagcaaagaaccattttagtcagttcatgggtcagagaggtaagaatggttttacctatcctgcagatgaggaaaccgaggctcaggaaggggaggggcacacacctctgtctgtctgccaggctgcactccccgcccccccacccctgggctccagggatgggagggctcggctgggcccttgtgtgcagagcatgtcccaggctcagggacttctctcaccccacctggcttcactgtgtgtacctctgggtggctcagggctgagcaccctgcaggggcacagaggaggcagcctgggcctcccaggagcctggccacactctcccctgcagaaccctctcctctcctccaggcacctgcccctctgctgagcagcccaggcctctcccatcctcactgcctggctgaacccatgagcagcagatttttggacaccaagagctgtgtttccaagcatggcgctaaagaggatgggctggcccagaaccatcctgagaaccaggcccagagacagctcaagggacagaagcattcagggcccccacagcagcacatgaacgtgaacatcagtctcaggatataccccaattccggaaacacaaatgtgcgaaaatgtagcctctgactcaaaggaacatggtgcttccagaagccacggctcacaggtgtttcttgggagatttgcacacttcacctcccggggaccctcaacagcccagttcacagatagggtgactgaggcccagtgaggtggagtggagtgcccagaggcacacggccatggggatggggttcagaactcaccacgcagtggggaggggtctggcaggttctgacatggggtagaggagtacccagtgaagccgggaagaaaccgggtggctagagggagagctgagacgccccatgccaaacacccctgcggagaggcagccacaagggccagtgtgggaggctggagcgggtggacagacgtttgaaggggagccaggaacagcaccctcttgtccctggtgggagggagaggggaaggcaggtggggccgaggggcaggagagccagccaggaggggcagctgccaaggagaccacagaggagctgtggaggggagggccgaatccccagggcatgggggccgcctgggcccaggcagagcctccccagacaaaggccattctgtccctggctcccctcccaagggcagaccttcctggtctctggggccttcaaggagttggtgagggagaggacaggtggggacagcacccatgcccttgaatctagctgctggaggccgtgagtccaggagccaggccaagggctgggggctctgctgatgctaaggcaggggcatgagccaggcaatggagccaggccagctccctctgtggggccttcaggtcccagcgtgggtatgggatatctgaggcttcctaggctgggccagctctgccacacaccagctgcatggccttgggccggggacttcccgtgcttgtgcaagtcattgtgcaagggccctgggcttgggggtgctgcactccaggcagcattcttctcatgcccactcggagggaaaggcaccatcactaaaaggcaccaagctgctgtgtgtgcctgcagcagccccggctcgtccacattcagcctcagtgtcctcacccgggaaatgggcaggatgataagagtctgcctccctgggtattgctaggatgaaatgttggagcctatggaggaaagggaggtgggtgagtggatgcatccactattctagaaaactctgctggggtcctaggaatggggagcagagaggcatagggacattgccaggggaccctggtctctgcccttcctcccacagttggtttcaggctgggctcccaagctgcttctcctgctggtgcccactcttgtcacctgcccagtgctgtctcttgaccctcgagccatagagctgcatcaccagggccaacaggacccagggcagcctggggtgggccaaaggaggagagggaacacctgccattctggaatccagccctaaatcagctgcactctgctgtgtgacttggggcaagtcacttctcctctctgaaccttggctttatctggaagtcacccagcatgaagaagtagcactcatgcttggctcatggtagatgctccgcaaatgtcttcctctcccatcctgctcccccaccgcctaccccatgctggggattccgtggcgacctggcagacacagccctgcctcccgcctctgagaccccacttcacagtcagctgctcaagaaacggaccttgagtctctgtgaggctggtgggctctagtgaaggacttcacggcactgggccctggttttctgcagaatggggatgttcactttgtgacgaatgaggattgtctcatttggtgtccatggcaacctgtggagaaggggctagaatgggctgcattttacagatggagaaactgaggctcagagaggtgatgggactggcctgaggtcactcggcaggtgagagccaggattgggacctgtctgagcaagcttctgtgcccccaggcctcaggaggtggggaaggggtcacctggctgcctctcatcagaaacaatagggcttatcagaaacaatgggtgaggaagaaccaaggccagaatgcaccaagtgggccagggaggggtgggcgcaatgccagggccatgtcaggagggcgggccgagccccacaatcaccttttctgggcctgggcctgacccctgagtgcctgggccagtgggctctgctgacattggggctgctgcagtaaaccccatgtcactctgcctcttgaggcttcctgcagacagatcagccccactgtccggatgatgaaagtgaagctcagagagggcgtgggtctcacataaggtcacacagcaagcaagtattgtcgccaggtttctccccagggtgccgacctgagttctgtggcatccccctgccccagatcctcctgcaataatcaggacaaggagaaagaaagctgccaccgtcctccgtgctgggcgctgcaaggtttaccccctgcaggagccatcaagtcatggtacagaaggcccagatgcagaaactgaggctcagagaggggaatgccttgtccaggggagcagcctgtgagctgaggagccgagctcaaacccggtcagtctgactgcagtcaggggtctttcccctgcagcagtgctggctgaggatgtccccgggagtgtgttcagacagctgggatgctgtgaggctggcagaagccagtctcagccccagctcctcctagatagaaagatagagaggccggggctccctcccctcccctccccatgggccccctggagctgggctgcctctgcttccccctcataggtcccattgtccccagcatacatattccttccctgtccatggttcctcacagcccttgtcttccaagaagaggaaccagagaggggacacttgcccgaggtcgaccacaaaatagcctaagaacaggccaggcacagcagctcacacctgtaatccaagcactttgggaggccaaggcaggaggattgcttgaggccagaagttcaagcctagcctgggcaacatagcaagaccctatctcaaaaaaaaaagttaaaaaattagctgggcatggtggtgcacacctatagtcctggttactcaggaggctgaggcaggagggttgcttgagcccaggagttcaagtctgcagtgagctgtgatcctgccactgcactccagcttaggtgacagagcaagatcctgtctctaaaaataaaattttaaaatagcctaaaaacagactgagattctagcccaggcccttcctgtgctccttggtcccttctaccatccagggctgggcgctctccacactcatctctttcatcttaaccaggttccaggtatggtgctaagtctgagctttactttgcagattcagaatccgagggctaaacattgcaaatccacctacatccaccgcccagccacccccactcctggaagtcccagcaacccccacctcctgccagcccatcctgcacgcccagccaacatggctgcctcctccactctctcagcccctgcctgcatcccctgaacctcaccctccttctgtttgaaccccctgcccacactggctttgtctcccatacacggccttggcagtggccggcaagtcgctgctctgcctgcaacccactgggtgctcccacctggctaggttgacccccatcctgccaccattactcccacatccccagtgcctggcacgggccatgtataaagtgagtgcacaggaattgaataggaactttgcctaccctgaggaggaggccaggccggacatagactaagccttcctggaggctcctgattgggctggagagtttttggagctcccagccccagctccgaccctaacccctggctctggtcactggaagcaaatatttacatttgcaaagtaaattccttgcaggagacctggactggggctgggaaggctgcctccctatggcctgtggttactaaaccgagcagagcagatctcgggggtcggttgtgaacgaggaagccctttggctcctctccagggagagaatgtcatgaaggtggatcccagggatacccccagcttttcacaccccgaatccccaacttttcacatctctaatccccaatttagggcaagattggaatcccagcccccctcgtcccactgcaaggacagagcggaagcctctcctctctggacctcagtgttctgtgtcatgaggtgtcatgagggtcctgagaaggggcacaaagcttcttagctcaggcctggcactgggcagagggaagaagagctgcttatggggcccagggctagaaactacaggcaacactggccgtgtggaggtcaagatgtggaggtcaagacagggagtgatgagcttcgaaggggctttgacactgggaggtgtactggcctgtttgggaaggcttcctggaggaggtgacatgggtgcagcagctgtagagattaggggagggcatggggtgggaacgtgtgtgtgtgtgtgtgtgtgtgtgtgtgtgtgtgtgtgtgtgtgtgtgtgtgtgtgtagggcacgtgagggcctcccagatggtgggaagtggcccacagtcaggctcccagagtggagctggggtttgtggtcctgggaccagccttcagggcccccctgagaggacaaggttgaggctagggaggagcccttcagtaggaaccaccaggctgaggtgaggagggtctcagctcatgggggcctgtttcagggcctttgaccaaacaccaatgggagggatatgacattttgttttgttttattttgttttgttctgtgtttttgagaaggagtcttgctctgtcgcccaggctggagtgcagtggcgcgatctcggctcactgcaagctccgtctcctgggttcacgccattctcctgcctcagcctcccgcgtagctgggactacaggcgtctgccaccacacctggctaattttttgtatttttagtagagatgggctttcaccatgttagccaggatggtctcgatctcctgacctcatgatctgctcacctcggcctcccaaagtgctgggattacaggagtgagccaccacgcccggccaggatatgacattttgtccaacagcagatctccccacaacctgtggcttcttccttactggaattttgtgtgctacagggtcgttttacaacctgctacatcccttaaaatgtttctgtccatttctcagaattttgggggagtttttggataactttttgtgaatcttgaatccaaagccaaaattttctggtcttttgaacagttttgttatttctttaaactcttttctttttttaatttaaatttgcaattactttgagcatttgatgtctatgctgctggtcagaccatgtttttatttgttttcctaattctttctggtccctggagaaacgctgaaaacaaactggttgaaaaagaatttccaaccacaagtttacagattaataactcagggacactctagtgtgacattaaaacatttatgctgattttattattttttttagatagggtctcactctttcagtgcagtggcacaatcacagctcactgcaacctcgaccttccaagttcaagctatcctcccgtatcagtctcccaagtagctgggactacaggcatgcgccaccatacccagctaatttttaaattttttgtagagacagagttttgccatgttacccaggctggtgtcaaactcctgggctcaagcaatctgcccacttcagcctcccaaagtgctaggattacaggtgtgagccactgcgcctggcccatttatgctgactttttttttttttttttttgaggagtctcactttgtcacccaggctggagtgcagtggtgcaatttcagctcactgcaacctccgctcccaggttcaagcgattctcctgcctcagcctcccaagtagctgggattacaggcacgcatcgccacccccagctaatttttgtatttttagtagagacagggttttgccatgttggccaggccggtctcggactcctgacctcaggtgatccaccctcctcggcttcccaaagtgctgggattacaggcgtgagccactgtgcctggcctatgttgactttcaagacagttgtttctgccttatatttggtttgcttgctcaaaatttattttcagttggtgattcatgtattcatcaacaaaagttttatacatggccgggcgcgatggcttatgcctataatcccagcactttgggaggccaaggcgggtggatcacgaggtcgggagatggagaccatcctggctaatacggtgaaaccccacctctactaaaaatatcaaaaattagctgggcattgtggcacgctcctgttgtcccaactactctggaggctgaggaaggagaatcgcttgaacccaggaggcggaggttgcagtgagccgagattgcaccactgcactccagtctgggtgacagagcgagactccgtctcaaaaaaaaaagaagttttatacatgaggcccatgaggtcctactgggtgctgggcacttttgtaggccaagcacaaaacagacaaggtccctgccctagtggggctgatgttccagccaggaggccagatgacaggcagtggcctgggaaactggagcagttaataacacgctagaaggtagataatgcaatgggaaaaaaaagaaaacaacagcagagtagaggggagggcagaagcaggtggggggagcagccgaagcttcatcacagaggaaactcaaatatccccaggttgcaagagatggccgcttcttttggtcaacttctcaaaaagagtactaaaatgacatcacatctccacctggaagcagaaagaatgaagagggcttggtgagactgttcttctcaggcaccagcgctcctgctgaacattgagcctccctgccaggtgccccccacctccaccaaccaaaaaaagaaatctggccctggaatcaggcagacctgtgttcaaatccaggcttgggactgtcccgtggacaactgatgccgagttgcctctcttctctgcctcatttcctcctagcggggaagtggagctgagcttcattctctcatccacctttatctgagcatgggtgacagagaagaggtagcacagagctgccctgtgcctcagtttccctacctggaaagtggaggtgaattggaggtgatactagcacccactcacagttaagactatgtatgtgaagtgcttagatggtgccagggccagggtaaatgctaaacaagagttgtctgttctgattatcaccttccttgtaggattgagccaggctatacaaggtccttcacatgagcatggttcacagtgatgtctcccctccccagggagtccccagtgccggccccagtcctgggctggcaacccaccttcctccatcctgggtgagattagccccctgtgcctgggcaagtcacaggcccttgaggagggtatgctggggatgcaggctcagcacgagtgaaggccccacaatgggacccagagcagggcctggcagcctccgctgggggctggccagagggacccgtctggtttgagttcccggcgcctctcgctccctgcatcaacccacagccccgctccgagctgccaggcccgcgccttatttgggtcttgtctcctcccagacaacatttcgtggccttaaaaggaaggcctggggggctgaggggggcagttgccagtgctggctccacagcctctccagctatgcccccgcccctggtttggccagtccatccctccagctgtggagaaaaccagtcccccaaaaccagaccagccagggcggctggggagggtgaggggggttctcctccggtaggggtggcagcaggggttggccctggaactggctccccttgccctcccaggcagccagcctccctctggttttcatttaaaaccagggctgaatccacttcagtctcctcttaccaagccaggcagcaagagtgtggatggcgacagccacggcggccatttattgagcacctactgtgtgtgccagtccctgtgtgtgcacagtgggccctttgcattcatggccgacctcaggcctcaccccagcctgggaggtttagaggccttagaatcccattttacagatgggaaaataagtccagagaggacaagtcatgcagggcagtaagtgtcagggctcggacccaggcttgtctgagcgctaacctcttagcccatgaggctggttggggtcattggggaagccctcagcctcatctatggcccccgccccattgccagcccctctttccagccctatcaggtggccagccttgctctagctcagcccagttcatgctgtttgacccagatacattgcctctcctctgggcctctgtgtcctacgctgagggcagtaggggtccctgctggggctacagtggtgggcaggggggcctgaggaggcaaggatcacatgccagcagggctctcaccctccatcccttagttgcagcttcctctgcctccttggagcccatgtggtcgggcagtaccatgcggcggatggcgcttcggcccacagccttctcaggtgggtcctgggatagcttcttgaggtccccctgggctgagggagccctggagggggctcagggcagtttggtaactgtcctaaaagccagtaggtctggcagtggagggtcaaggacagtaactatcttcccaccccatgctccccaggctacaaaagttgcttcaaggggcacagaaaggaccctagagggtcatctgacctgggcccagacaccctgagacccatgacccctggactcttgcagatgccagttcaatcccccatttcccctttttatttaatcagcacttttctgagcatcagcagtgctggaggccctgtgccaggcgcttcccatcagcagctcgtttagacctcacagctgttcactgcccgcccattgtcccctttttaaagaggaggaagctgaaggtctccgacctccctgccctgccccgccccaggccccacagccaggagtgggggcagcaccaggactagaccccagatgttgtgctagttaggcactcaccccttcctgctctgagccgtgtcctcaggtgtgaacaggggtgacactcccgtgaggaggggagagactgctggcatagcacttggctgggccagcagctgggaggctctgtaaatgtccacagctgctgtgaatgactcatgtcattctcgtgagtctcagccaggcggccgggggagcggtgctggatggtgggtcaggggaggctcagaggttgggacctttgaggccagcccagtccagactgcgctgggtgggtccccaaagccggcaagccctggccccagccctgcccaggcaggaagcaacaggatctttccagagaggacaagtcacgcgggacagtaagtgtcgaggctcagacccaggcttgtctgagctctaaactcttagcccatgaggctggctggggtcgctggagaagtcctcagcctcatccatggcccccgccccattgccatttcttggcttctgggaaaagggtcattttggacacagaggctgccaggggtcaggtccctggtcctgctgccggagaagcaggccactctggaggctccagtgccaaaaggaacccatagggtgaggtccccctggacccactgtgatcctatagcccttcccaagcctaaggtccctcgtgggttggggtcatcaggtatctgacgctttcctccatcccaacccccagagactgaagggttctgaggggaagcctaggacccttggccctggccccagcttcctccctccccgcaggttgtctcaactgcagcaaagtgtcagagctgacagagcggctgaaggtgctggaggccaaggtgggtgagcagctccctcctgggtggttgttccctgccacaggccagtccaggcaaccaccatcccaccctccccacctccttccccgcaccccatgctcgcaccctcagtgaacccacagggcagctctgaactgactcggcgagcagcatcccctgtcaggcatgtcatggtctcctccagtgtccctccctaggaagcctgctcacaggtcgtgcctcagttttcccacctgtcaagcggaggggatactagcatccactcagggaaaactgtatatgtgaagcgcaagtcacagccagcctggcctgttcttcctccaggaggcctgtgagctccctcccatggggctccatcaccatccccaccagatcagcatagacactgcccagagatcctggtaggatctcctgcctgcccctgccccatcccctttctctatccccccaacccccatccataatactatcttcctggtttcaaaaacaaaacatctatcacacatctcaaattatttcaagataaaatgttgtgtattttttgttttgttttgtttgaaacagggtcttcctctgttgcccaggctggagtgcagtggcgagatctcagctcactgcaacctatgcctcctgggctcaaatgatcctcccacctcagcctcctgagtagctgggaccataggtgaacaataccacatccagctaatttttaaatttttggtagagatggggtttctccatgttgcccaggctggtcttgaacttctaagctcaagcaattcactgtcttggcctcccaaagtgctgggattacaggtgtgagccgctgcgctgccataaaacttttttttttttttaaattaaaaagtactgcttggcgcagcggctcacacctgtaatctccatactttaggaggccgaggcaggtggattgcttgaggccaagagttcgagaccattctggccaacatggcataaccctgtctcttttaaaaatacaaaaattagcctggcatggtggcacacacccataatcccagctacaaaggaggctgaggcttgaggatcacttgaacctgggaggtggaggttgtagtgagccaagattgcgccactgtattccagcctgggtaacagagcgagactctgtctcaaaaaaaaaaaaaaaaaaaaaaacaaattaggccaggcgcagtggctcatgcctgtaatctcagcatttgagaggccgagccgggtggatcacaaggtcaggagttcaagaccagcctggctaagatggtgaaacctcatctttactaaaaatacaaaaaattagccggggccgagtgccgtggctcacgcctgtaatcacagcactttgggaggtcaaggagggcggatcacctgaggtcaagagttcaagaccagcctgaccaacttggagaaaccccatctctactaaaaatacaaaaattagccgggcatggtggcgcatgcctgtaatcccagctactcgggaggctgaggcaggagaatcgcttgaacccgggaggcagaggttgcagtgagccgagattgtgccattgcactccagcctgggcaacaagaacgaaactccatctcaaaaaaaaaaaaaaaaaaaaatgagccgagtgtggtggcaggtacctgtaatcccagctacttgggaggctgaggcagagaattgcttgaacccaggaggcagaggttgcagtgagccgagattgcaccactgctctccaccctggacgacagagcgagactccgtctcaagaaaaaaaaaagtaattaattaattaatttaaattaaaaagtacaacattctaaatttagaaacatgaaaaattcagaaatgtgaaaaaacagccagcaaaccattcacagcagttgcccatgcccccaaagaatgcaactgtcgacacttaagcatcctttcttccagattttctaaacacacagacatgcatacactttagtgccattctttgctccatcattcccttctctggaaatttatcttttgtttgttcgttttgttttgattcagaaacagggtcttgctctgtcacccaggctggagtgcaggcattgcaatctgccgtgagttggagctcactgcagcctccaattcctgggctcaagctatcctcctgccccaacctcctgagtagctggcattacggacatgtgccaccacacctggctagtttaaaaaactttttttagagctggggtcttgctatgtttcctaaactggtcctgaactcttggcctcaaggaatcctcctgcctcagcctccaggagtgttgggattacagatgtgagccattgtgcccagcctgggaacttaatgagattatcagatgcaaaaatgtttaccaatagagaaatttgaaaaccaggcaaaagaaggcatggttgtataattgtggagaattcattctatggggcattcagcagccatttacaatacttcccttccctaatatgaaaagatttctctaggctgggcatggtggctcacacctgtaatcccagcactttggaaggccgaagcaggaggattgcttgaggcctggagcccgagaccagcctgggcaacatagcaagactccatctctacaaaaaattagctaggcttagtggcacacagctggcacacagtcccagctgcttaagaggctgaggcaggaggatcacttgagctcagacggacaaggctgcagtgagtcgtgatagcaccactgcactctagcctggacggcagagctagaccctgtctctaaaattaaaaaaaagaagatgccgctgggcgcggtggctcatgcctgtaatcccagcactttgggaagctgaggcgggcggatcacatgaggtcaggagttcgagaccagcctgaccaacatggagaaaccccatctctactaaaagtacaaaattagccaggcttggtggcgcatgcctgtaatctcagctactagggaggccgaggcaggagaattgcttgaacctgggaggcggaggttgcggtgagccaagatcacgccattgcactccagcctgggcaacaagagcaaaactccacctcaaaaaaaaaaaaaaaagaagatgcccctgatttatcaaatgggaaaaccaagcttccaaatagcgtgtgctggcacctgagttacaaggcacggggttccaggagcagttccctgagctccctcccaggagaagcccatgtaagaggcaactcagtcccacatcttgatgggaattcctggttcaggatctgccagagagtttcagcttttctctggacaggcccccacgatccctgagcccctgatctgtggtcatctggcctttcgttggtcctcagcagctgaggggacacttccagcttcccagagtcttcctcaccatgggcccaaaagtggactttgtgtacacctccaggtttctatttcatgtcagactcttccaaacttccttccaaatttagtgaaaggccgggagtggtggctcacgcctgtaatcccaacactttgggaggctgagataagcagatcacttcaggtcaggagtttgagaccagcctggccaatgtggtcaaaccccatctctactaaaaatacaaaaattagctaggtgtggtggcgcatgactgtaatcccagttactctggaggctgaggcaggagaatcacttgaacccgggaggcggaggttgcagtgagccgagatcgtgccactacactccagcctgggcaacagagcaaggctctccatcttggaaaaaaaaaaaacaaaaaaacaaactaagtgaaactcttccagccataccctgtggtgctttaagaaatcaagacaagcttcttatttggataaccatagagaaaaagcacatggcccagcaagcaccgcgacagtcacaaagctcaactttgatggcaatgatggtgtcagtgacttttccataatgcgtgttatgaattgtgtgctttgaaaaacactgtcacttctgatgaagttcggtgcccctgcgagcctggggctccactccaagctgggccctgctggccatgtgcctcctgcctcccacaccaggccccttggctggcctgtccgtggtgagaccctggctcatgcctgtaatcccaacactttgggaggctgaggcaagatgattgcttgagcccaggagttcaagaccagcctgggcaacatagcgagacctcgtctctacaaataatttttttttaaatttgccatgtgtggtggtgcatccctgtggtcccagctacttggaaggctgaggcagaaggatcgcttaagcccgggtggttgaggctgcatgagccgtcatagtactactgcattctagcctgggcaacagagcaaaactccatctcaaaaaaaatagggaggggtcctagtgagaccctggtacccaccccgtccctgtcttcctcttcagatgaccatgctgactgtcatagagcagccagtacctccaacaccagctacccctgaggaccctgccccgctctggggtccccctcctgcccagggcagccccggagatggaggcctccagggtgagtgtcagactcagactcccctgtgggaatgagcagtgggttgggaatcggggaagtgggattctggtccccaccctgtcgctgactcccaacttaaccctctagtgggcctcagtcttcccatttcccgtttcttagacccgcctaagaggaccgtctcctgggactcctgaatgctgcagtccctggagaccaagcagccccagcagaccctgcctggaggtcggggggagctgggagtggggattctggatgagcctccctcctccaggcccagcagggacactgacctctgcctaccccccccaccccagggctgccaggagccatagagagtgtgagggtcccgctgcttccccgaaatggtagatgctggttggggggctggggccagggtgggggtcaagagcagatgtggagctgccagtctgatatgctttaccccccagaccaagtcggtgcttgggggcttcccgggcccaccggccccaagggagatgccggcagtcggggcccaatggggatgagaggcccaccaggtgagtgcccgcaatgctgccccacagctcctctggccatcccctccaccaggtgggcccttccctgctcctgacatggccaggatgacctgggccctttcatctacttgcctcttcactcagcaccccaccacggagtgccctgcccacgcctgggctccatgaagtcctctcttatgttcactgacccacattccctgggcacctacacttatcaggctctgagctgggcactgggtggggtcagacatgtccctgcccttctggagcttccatgctgctgggagcagggctgggcagaggagaagcagcaatgcttgccccatgtgaccagggtttctatgaggggttttgggggtttgggagccccaaggaaggaagactcagcctggacgaggtggagaactaggtgctgtgctcatccccctgttagactaccaggcagcctaggcctgtggactccggggccctctctcatgcccactgctccaggctgccttgtcctgtcgctcaaggccaccctgggcctccttgcctcctgtatacccacaaatccgtgtgattccattgcaggtccacagggccccccagggagccctggccgggctggagctgtgggcacccctggagagaggggacctcctgggccaccagggcctcctggcccccctgggcccccagcccctgttgggccaccccatgcccggatctcccagcatggtgagtccccctgggatcccagcaggtggaggtgggggtggagtagccatcagcacagtgcccgctaccatctgccacgtgccttctgtgtgccagccctgctcacgataggccacatgtgacccagtcctccagcaggcgccgttgtcctcctgtggttacaggtgaggaacactgaggaccagagagggaaggtggcttgccagggtcccacagcctgggcgtaggggaacggcttcaaacccaggctgcctccagaacctgtgcttagagccaccgggcatcaggccctcccaagccttggaactggctggaatccagttctcggaacactgggacgcaaaagacccggcggcaggaagtgagtcctgaactcccaaggccacaggcccggcccctcctccaggccctgacgtgcgtccttggcttcttccctttggcagcccagcctgacctgcccatgggctgccaggggtcagagtgtggagcgccaggtttcagcctcttctccactgtgtttttggtgcacaacccagcacaccattcattcattctgccatcccagcattcattccatctcactatccatacgatggggacaatgacagtgccagcctcccagagctgcgtaacatccatgtacagaagcctggcacacagtaggtggtggataaatggtatcttttattgtcattcccatttgacaggtgacagtacaggctctgaaaagtagaaagtgttgctggatgtcaccagctggattgcagtggggttagaacccacatctccctgcctcctggtcttgcgggaccaacactctccacactcctcaccctggagcaggtgcccaggtggtaccagccatgctgcaggctgccccatagggcagtccaagctgtcttggcagaggtggcaggtgaagactaaccaccccactctacccagctctactcactcatcatctttgctcacccaggagacccattgctgtccaacaccttcactgagaccaacaaccactggccccagggacccactgggcctccaggccctccagggcccatgggtaagttgagtccaggccaggggtaaagggtgaagttggtagatggcagagggaatagggtttgtggctatcaggagggagctgatggggcacttcctgagattgtactttgttccggcccttaggacatcctgtctttttccaggtccccctgggcctcctggccccacaggtgtccctgggagtcctggtcacatagtgagtagttctccttgtactctcacccatgtgtctgtccatctttccatctatgcatacatccatacatctgtccatcatccacccttgtatccatctatccatccatccattcatccttccattcattcattcaacaagtatttattgagcacttaatatgcaaactaccttccataaatcttattcaatccaagtaatgagaaccatgtgtggttatcacctaagaccaagaaaagtagagattcttgtgccagcacatggcaatgagctgtggtgggactgtctgactccaggatcagatcttttaacactgagctgtatgaactgactgcggtgtgctgggtgtatggtgaagaacccagaggcccagaccaagcttgagcgccctccccaacacctctgttcccaagcccctgcccactccatcctgccccaacacaaggctgaggccctgtcttgttgctcagggacccccaggccccactggacccaaaggaatctctggccacccaggagagaagggcgagagagtgagtacccaggtggccccaggtgggggaattctggggagtcctgagggccccaggtcagagtcctcaacagctgacgccattcgtctcctccctcttacacagggactgcgtggggagcctggcccccaaggctctgctgggcagcgggtaagtgttgctgtctgtcccgcattcatccctgcaggatcccttagtcccagattcctcctgtgactccatcccctgcaaccagagcttctaaccctccctgtcttgtcatttattttcagatgctccctgtctctgagactcattgtcctctttggattaggctgcctctgtctctctcactctggctctctgtttctctgtatctctctctttccctctgtacgtctgtctctttgactctgtatttcatttacactctatctctccaattctgattgtagatctgttcatttctctctttaatttggtgaattttgctttacgtattttgagtctttgttattaggtgcattcacatttagtattttaatgtctccttggtcattttatctttatgaaattaatatctttatctctgataatacttgccttgaatcgactttgtgtgcttttaatagcacaccagctttcttatgcttgctatttgcatgttatatctttttttatccttttttttttcaacctgtaactttatatttaaagtgcatcatggctgggtgtggtggctcacacctgtaatcccagcactgtgggaggccgaggaaggtggatcgtttgagctcaggagttcaagaccagcttgggcaacatgacaaaactctgtctttatataaaaatatgtatataaattttattaaatgtaagaaagtgtggaccgggcacggtggcttacgcctgtaatcctagcactttggggggctgagacgggtggatcacctgaggtcagaagttcaagaccagcctggtcaacatggtgaaaccccgtctctactaaatatacaaaaattagccaggcatggtggtaggcacctgtaatcccagctactcgggaggctgaggcagaagaattgcttgaacccaggaggcagaggttgcagtgagctgagatcacaccattgtgctccagcctgggcaataagagtgagacttcatctcaaaaaaaaaaaaaaaaaaaagtgcatcatatgacttgggtcttgctgtttaaaaacagtttgactgtttagttaatttatatttaatgatatgtataattgattaatatggttctgtttagccatcttgctgtttatgttctatttattccttctgttttgtgtttcttttttcccttttcttttcttgtcttcttttggattgagtactttttatgatttcttttttcttttttagagacagggtttccctatgtgcctaggctgaactcaaactcctgggcacatagtgaatgaagtgtcttaagtgatcttcttgcctcagcctcccaagtatctgggactacaggtgtgcaccattgtgcctgacttaaaatcttctctttctaaaattaattttctttctagaattaaagctttctagaatttaagctttttttttttttttttttttttttttgatacagggtctttctctgtcacccaggttggagtgcagtggtgcaatcatagctcactgtagccccaacctccctggctcaggcaatcctcacacctcagcctcctgagtagctgggaccacaggcatgtaccaccatgcccagttaacttctattcctttacatttaatctgttttgtggttatatttaaagtcagtttcttatagaaaacctacggttaggtcttattttttggtccattctaacaatcctcatcttttatttgctgcatttaggccattgacatttaaagtgattattgaggcccagcatagtggcccacacctgtaattccagcacttcaggaggccaaggcaggaggatcacttgaaatcaggagtttgagactagagtgggcaacaaaatgagaccctttttctataaaacaaatttaaaaattggctggacgtggtagtgtgcacctgtagattcagctacctgagaggctgagctgggaggattgcttgagcccaggagtttaaggtgacagttataattgctttactgcattccagcctgagtgacagaaccagaccttgcctctaaaacataactaaatagtctgtgcacggtggctcacacctgtaatcctggcactttgggaggtggaggcagggggatcacctgaggtcaggagtttgagaccagcctggccaacatggtgaaaccccgtctctactaaaaacacaaaaattagccaggtatggtggcgcactcctgtaatcccagctactcaggaggctgaggcaggagaattgcttgaacctgggaggcggaggttgcagtgggccaagattgtgccactgcactccagcctgggcgacagagtgagactccatctcaaaaaaataagtcaatcagtaaaataaaaaataactaaataaatgaagtgttatttatatagttgggttaacagctaccatattactattttctttcttttttttctttttttttttattttttgaggcagagtcttgctctgtcgcccaggctggagtctagtggctggatctcggctcactacaagctccgcctcccgggatcaagcaattctcctgcctcagcctcccaagtagctgggactacaggcgcccaccaccatacctggctaatttttgtatttttagtagagatggggtttcaccatcttggccagactggtcttgaacttctaactttgtgatctaccggccttggcctcccaaagtgctggaattacgggtgtgagccacctcgcccagctactattttctatttgttttccttgttctttgttcctatttttgtctgccagactttttctgcctttttttggctttatttatttatttacttacttattttcttttgagagagagtcttgctctgtcacccaggctgtagtgcagtggtgtgatctctgctactgcaacctctgcctcttgggttcaagcaattctctgcctcagcctcctgaatagctgggactacaggcacctgccaccctgcctggctaatttttatatttttagtagagacagggtttcaccatgttggccagactggtctcaaactcctgacctcaggtgatccacccacctcagcctcccagagtgctggggttacaggtgtgagccaccatgcccggccatgctcctcctttctttatgtaaaatctgagtttctggccaggcacggtggctcacgcctataatcccagcactttgggaggccgaggtgggcagatcatgaggtcaggagatggagaccatcctggtgaacacggtgaaaccccgtctctactaaaaatacaaaaaaaatgtagctgggcgtgctggcaggtgcctgtagtcccagctacttgggaggctgaggcaggagaatggcatgaacctgggggatggagcttgcagtgagtggagatcgcgccactgcactgcagcctgggcaacagagcgagactccgtttcaaaaaaaacaaacaaaaaaaatctgagtttctgacacataatttttgtcctctctgaagaactacctttattttttcccagttggctttatttgtgattctagaatcgggcaacacttcattccataaaataaaataagtgctccgctgaagaacttcttttaatgtttcctacaaggcagatctactgacaaaaattccctcactgtttgtttgtctgaaagtcttcatttccctttcatgcatgaaggataatttttcagggtaaagaattctaggttgatgtgtttttttcctctcaatacttggtatattactctccactctcttgcttgcatggtttctgcagagttggttgtaattattattgttgctcctctgcaggaaagatattttttccctctgttttcttttcagtatttttttatctttgattctctgaagtttttctaaaaattattattattattattattattattattattattattattattattagagataaggtcatactctgtcacctcagaagccttgaggcttctgggctcaagggatcctcccgcctccacctctcgagtagctgggactactgtcatgtgccacacctggctaatttttttttctgttttgagatgaaatctcactcttgtccccaaggctggagtgcaatggtgtgatcttggctcactgcaacctccgcttcctgggttcaagcgattctcctgcctcagcctcccaaatagctgggattacaggcacctgccatcacgcccggctaattttttgtatttttagtagagacagggtttcaccatgttggccaggctggtctcaaacttctgacctcaggtgatccgcccgcctcggcctcccaaagtggtgggattacaggcgtgagccaccgtgcccggccattttttttttttttttttttaattttagaagcaagatctcactatgttgcccaggctggtctttctgacctctagtgatcctcttgccttggcctcccaaagtgctgggattacaggtgtgagccactgcacccagcctgattttctgaaatttggatatgatatgcctacttgtcatttcttggcatttatcctatatggtattcccttatcttcctagatctgtggtttggtgtctgacatttttggggggaaaattctgtcattattacttcaaatattgcttgtgtttctttctcttttttccttctggtattctattatgcatatttacatcttttgtaattgtcccacaattcttggatattctgttctattctttcagccttttttctctttgcatttcagttttgaaagtttccattgtcatatcatcaggcttagagattctttcctcagccatgtccagtccacgaataagcccatcaatggcattctttatttctgttacagtgctttttatatctaccacttatttttaattatttcttagaatatcttttttttcttttaaaaaaaatttttttttaatgtagaggcagggttttaccatgttacccaggctggtctcaaactcctgagtttaagcagtctacccacctcagcctcccaaagtgttgggattacaggcatgagccaccacgcccaggcctttcttagaatttccatctctctgcttataatccatctcttcttgcatgttgtctactttttccattaattcccttagcatgttaattgtagatttttaaaattcctggcctgataatctgaacatttctgccataactgatgcaggttctgatgtttgttgaatctcttcaaactgtgtttttgccttttagtatgccttgtaatttttcactggaaggtagacataatgtactgtgcaaaagaactgcagtagataggcctttagtaatgtagtgagaaggtattggggaagggaagtgttctggagtcctatgattagatctcagtcttttttttttttttgagacagagtctcactctgtctcccaggcactggagtgcagtggctcgatcttggctcactgcaacctccacctcctgtgttcaagtgattctcgtgcatcaacctcccaagcagctgggactacaggcgcctgccaccacacccagctaatcaacctcccaagcagctgggactacaggcgcccgccaccacacccagctaatttttttgtattttagtagagatgagctttcaccgtgttggccaggctggtcttgaactcctgagctcaggcagtccacccatcttggcctcccaaagtgctaggattgtaggtgtgagccactgcacctggcctaggtctcagtctttagatgagcttgtgcccttggactgtgaacttcaccagtgtgtctcagttgttgttttgttttgtttttgtttgggggttgttttgccccttaggtgggacaggttatctagagggagttagagttggatatttcccttctttcatgtggaaactagagggagctggaagtgggtatttcgcttcctccaggttgcttagtgttgggagaaaagctgagtgttgggagggaagctgaggcagggcttgcacgtctgacataatgtaaaagagtcttggaacatgtctggggtccagggtcaagaacccctcgtggcctttggaacaccaaactctgtgctaaagggtggaaggctaccctgccacaccgtaatctaagcccagggcataaaacccctcgtgacttggatggaatccagggctcagggcataaaacccctcgtggcctctggaatgtgtctagacttgctggctccttgcttctagcactcccattacctcaagtagcagaacatgttccatatgcttcaaagaaaatgctaaactgtcacagctgtaaatcatgcgcttgacgcatcgcattctctcaacccccacatccttgccacctgtttctttgtttgatcaccagtaaatagtgtgggctcccagaactcggggccttcacagcctccatacttgtgttggccccctggacgcactttctctctcaaactgtcttttctcattcctttgactctgtcagactttgtcgcccccatgacctggtgttgggtccgatcactccaacaggttaggctctggtaaagtagtttctcctgagtcaggctttgttcagaacagaatgcttggtctatttcaaaatgatgccttctctcctctccttgctggaaggacaagggcatttttctctgatattcactgtgagggccttgtagagctccttgaggtaaaactcatgaaaggagggatgtgggtctgactgggtccccctggagtttttaaccctaagactggtctacactgagcctccagaagttcatcaattacagtttaggttttcctaccctggccctggttcctctggaggcttgtgcttgtgggtttctgctttagtaagttgtgatagtctggatttgcctctccagctttgggggcaatcgtttgcctatggtctcacttctccaacagatctaagaagagttgttgatttttcagtttttttcaactttccacttgttgttaagatggaatgataacttctaaggtctttttattttcgagatgactctcgcccttgtcccctaggctggagtgcaatggtgtgatctcggctcactgcaacctctacctcccgggttcaagcgattctcctgcctcagcctccagagtagctgggattacaggcacctgccaccacgcccagctaatttttgtatttttagtagagacggggtttcaccatgttggttaggctggtcttgaacttgtgacctcagatgatccgcccgcctcagcctcccaaagcactgggattacaggcgtgagctaccgcacccagccaacaacttctaacctctttacatgccaggttggaacccagaagtctgttttgttttgtttttaaatcaaatttgaaaaaaaaaaaggtcaacatttccccaaacatttttttctgtttctgctctccagtatgtccttctggaactccattgattttctcccatgagtcactgaagttctgttagttttttaaacaatctttgtctctctgtgctttatatttctttattttacttttttgagatagggtcttgctctgtcacccaggctggagtgcaatggtgtgatcacagctcactgcagtcttgagctcctaggctcaagcaatcctcccacctcagcctcctgagtagctgggactacaggtgcacaccaccatatctggcttgtttttttgtttggtttttgttttttcatttttagtagaaatggggttgctcaggttggccccaaactcctggcctcaagctatcctcccaccttggctagggagctatcctcccaccttggcctcccaaagtgctaggattacaggctctgtctgtactttaaattattccattgatctatgttcaagttgattgattacttcttctgttgtgtccaatcttatgttaatttcatctgataattttctatttctggtattatcgttttcacttccaggatttccatttgattcttttttataatttatatatctctcctaaaattctccatcttatcacccatgatatcaatttcagtagattctttaacatattaatcatagatattttaaactcctttgctgattctaacatataggtcggctgtggatctatttctattgacagatttttctcttgaatataggtcacattttcctgtgtcttcacatctagtaattttttgttgcacactggacaaagtagataatatgttgaaaagactctaaattctgttatctcctgaagagtattgagttttattctagaacagttaaattattgatgggtcatcttgctcttttagagacttagttgtaggttttatcagagagaatctctggttttgctcttagtcctaggaaaaatcccttaatcctgagatagggtctttcttcctaagtcatggctgttctagagtttcattagaaagctttaggtgttcacaagcacctctaacttggttggactggaactctaaactctgtctcctatatggtgggcaatttttgacatctttagtcagttctaccaatctgttggttctccccctctgggctccttggagtattgccctgtgattggtcaatccagggaccatccaagcgtcagaaaggaacatttatgcagatttagttcccccacttgtagctccctgcttcccagtatttctcatcaatttcttgcttctctggcaacctcaacctctgattcctgaggccaataaaactgaaactttctgcttgagctcttgttttgccaggctgatggggctgaggtgcaccctctgaggaaaagctgtaaatacatggattttacccaatgccattcccttcttttaagggttgaatattctccagtgtctgtctgctttttattactttccgttgccttcaatcagttggtttttgctttgtatccaatacaagctactttctgtttctctaagtttctctccctttccccgctctttttcctccctctttttttcccgtccctttctgtctccttgccttcctcactgctgctatctctgtctctccttgcagggggaacctggccctaagggagaccctggtgagaagagccactgggtaagctctggcctggcactggcctctccctgccttctcagccctacatgctcaagagagtattccctccccaggaggccctgggagtgggagcatcccatccacatccccactacagcctggtctcccaggcaggagccttggcaattatcagccccaactccttcccccatcttgttgctcccaaccgggcagggccagccctatcagcagaccccatgccttctgtctcagtctctgtccctgtctccaccttccctctgtggcctttccaggccagggtggctctgccttttcctcctgggtggtttgggctgacccaggccagactgcatcccctgcctccatagccccctcccagccaaggcttagcttgctcccttgtctgcagaacaaagggaagaatgaagacaatatctacacaggagaatgggatagaggacctaggaaaggggcctagaaatgatgaggtacataggagccacgtggtaaaaaggacagggaactagataccaccatacacatcggaaattcatgaagcctgtgaagagacgcctcgaaactgctatgtacacgtttgatgtggttaatgaggccaggtgacctagactcctctatacttaaaggacctatagtttacacaaggtcctagacaccatcacatacataggagacccatgatggatgagaagggaagcctagaaactctcacatatacaggagacagagtaaatgagaaggggacaagaagggggaactagaaaccacacaccgcaaaatctcatgattaatgtggggtcctagaaaccttcacaatcgtccgggatgccgtggctcctacctgtaatcccagcactcttggaggccgaggcgggtagataacttgaggtcaggagtttgagaccagcctggccaacatggcaaaacccccatctctaaaatacaaaaaaatacaaaaatacaaaattagccttaaaggtttgggctaaaaatacaaaaattagctggacatggtggtacgcacctgtagtcctagctattcaggaggctgaggcaggggaatcgcttgaacccaggaggcagaggttgcagtgagcagagatcgcgccactgcactccagcctgggcgacggaacgagactctgtctcaaaaaaaaaaaaagaaaagaaaagaaaatagaaaccttcacaatcattgaaaatcattgcaggggagggattttcgggttaggacctagaaatctactcacccaagagacgtgggggaaagacgaggaccctaaaacataccatacccaaaagccccacgacacagggatctggaaaccatcactgacaggggagacatctggaaaatggacagagtggaggcagacactccttcaggagagagagacaactaggaagctctttttggcggtgggggggattgtgactccccctccacatgcagtctggctgggacaccctacttcctggcagtcacaagttagtgaggatgtgggtggcacccagtgcctgccttgccctcttagttcttgattgtggggtcagtgatggatacagccgtgggagccccctaccctgcacgagtcttcccctgtgtctgcccatgacttctggtgccctgctacctctccagttagcctctcctggcccctgctgtcctgaatctcctcctaccccatacccatcctccgtagctccagagtctcttaatactgccagtatggacatgagctgagctgggatcagatagacccatgcaagcctggctctctgcctcccctaggctaattactggcctctcccagaggcccttggtctgggaacacatttaccacccagtccaggaggggtgggagagattgggcagtcctgtcccttcatgagaatccccggcaggatgccctggccaccctagaccagtccttgaacccagaaccacctgtgggctccccgcaagaggtagcagggcccctgcccacccaccttcctgcccctcttctacctgcacttctgcccctgcttgctgcttgcctgggaggggacccactgggctgggggctgcatgaagctttgggggctgggggaacagctctgttggggacaggtgggaatgaggttcagtgctggcaaggtccccgagggctcctatgtacacttcaccaaccaactcccttagtgcagcttgcagatgcgttctggctgtggcccagcagtgacacctggtggtcatgatagtgcactgcaggaactggagtgactgtgctgggcctgcccacctggatcaaagctctcaccccttattcagacagggaaactgaggcccgactcggcagagagaatccttggcagagcgggaactggagccctgacttttaagttcctagggccagagaaccagctaccattccccaagcatctcctccataggcaccagacctggagctgggcactgtttacacagatgcaattcagacacagtccccaccctcagggtggtcacagtgaggtgagggaaaaaagacctataatcagcagctacaggactgtcaactttataaacactttacactttagcatcctcccggaggagccaggtgaagcctgaaaggtgcattaaccaggcacggagtgtccaggcagaggcgagggtacaacaggtgcaaaggccctgtggcaagagggagcctcggatatttgaggagctgcaaatacttggagtggcactgtgacaggtagagagtggaacagaggccaaagaggccttcagggtgtaggaggccacgttcaggaatttggactttgttctagggcagtggggaggcattgaaggctctagaagcagcagagtgatgcggtcaggttttttttatttgcaaagaatccctctgattgccatggcgaatggatgggagaagcagaaagacagtaggtcgggggctgtcgtggtcatcctggtgagagactgagccgggcagtgggtgggagccagtgaggacagacagccgtcgatggagcaaaaagacacttgtgtgctggtctggctgcaaaagggagtgaggagtcaagggagacttaaaatagcaaaagagaaccaggagaagcaagcaggctgagttttgtctgtggaccaacgggaggagtctgtgttacagccaagtagggttgtccagcaggcccagacacttagatccggagtgcagagggcaggccaggctgaaggagactgggttgtcatcagtgcaaacatcaggccacctggtctgagggagttccaaacagtggattttaaaaacacttttccccatatttttctttttaattttatgttttaaaaaatacagacaagaactcacaatgtgtcccaggctggtctcaaattcctggcctcaagtgatcctcctacctcagcctcccaaggtgttgggattacaagtgtgagccactgcacctggcctccccaatatttttgtttatttttattttgtttttttccttttttattgagacagagtctctatcgcccaggctggagtgcaacagctcaatcacagctcactgcaacctctgcctcctgggttcaagcaattctcgtgcctcagccacctaagtagctgggactctgtagccatgcctggctaatttttgtatttttagtagagatgggtttgcgccatgttggccaggctggtcttgaactccaggcctcacgtgatccacccgcctcagcctcccaaagtgctaggattacaggtgtgaaccactgcacccagctattttgcattttgatatacagaaaagttggtacaatgaatgtcattctgcccttcctgtagatggaccaattattggtacagccatgtgtcacttaatgatggggatatgtcctggaaaatatgccattaggtgattttgttgtggcatgagcatcatacagtgtacatacacaaacctagatgggatagcctacaacacacctcagctgtatggtgtagccaattgctcccaggctacaaacctaaacagcacgttactacgctaaatattgcaggcaactgcaacacagtcgtaagtatttgtgtatctaaacatagaaaaggtacagcaaaaatacaccataaaagatttttggagcttttttgtttgtttgtttaggacaaaatcttgctctgtcgcccagggtggagtgcagtggtgtgatttcggctcactgcaacctccatctccaggttcaagcgattctcttgcctcagcctcctgggtagctgggattacaagcatgagccaccacgcccagctaattttttgtatttttagtagagacggggtttcaccatgttggccaggctggtctcaaactcctgacctcaagtgatccgcccacctcagcctcccaaagtgctggaattacaggcgtgagccaccgcgctggtgaaattaattttttttttacttttttttttttttgagacagagtcttgctatgtctcaagaaaagtacagtggagtacagtggcttgatctcggctcactgcaacctccgcctcctgggttcaagcgattctcattgcctcagcctcccaagtagctgggactacaggtgaacgccacgatgcccagctaatttttttgtatttttagtagagatggggtttcaccatgttggctggccaggctggtctcaaactcctgacttcaagtgatccgcctgcttcggtctcccaaagtgctaggattccaggtgtgagacactgtgcctggccctttttttttttttttttttttcactttttaaatgtttttgctaaaaactaagacacaaacacatacattagcctaggcctacacagggtcaggatcatcagtatcactgtctccatgtccacctcttgtcccactggaagttctgggcagtaacatgcatagagctgtcatctcctatgataacaatgccttcttctggaatacctcctgaagaacctgcctgaggctgttttacagcttaactgttttttaaataagtagaaggagtacactctaaaataacaatttaaagtatagtatatgaccaggtgcagtggctcacatctataatcccagcactttgggagtccaaggcaggaggatcacttgagcccaggagttccagactaacctaggcagcatagcgagaccttgtctgtacaaataaaaaaattagctgggtatgatggcatgtgcctgtggtcccaggtacttgggaggctaaggtgggaggatcgcttgagccggggaagtcgaggctgcagtaatacgagatcacgccactgcactccaacctgggcgacagagcaagactctgtctcaaaaataaataagtaagtaaaatatagtaaatactaggcaatgggaattttttggctccattataatcttatgagaccactgtggagatatgcaatccatcgtagactgaaacatcattatgtgatgtatgactgtattgagccacaattgttctgtcattctctcttacatatttatagatctttttttcaaattcatttaaaagtaagctgcaaaacccagccacgtttcccctaacattgcagtgtgcaccgtgaatgaatatggacattctcccacattaccacaataccgtcgtcatacttaagaaagctaacatttatttagcaaaatgatgccattaaatatgtgacttacctgtaaatgttaccagttgtccccagatggcttttcttttttttttccttttttttgagatggagtctctgtcaccgaggctggagcaccaggacggagtctctgtcacccaggctggagtgcagtggcgtgatctcagctcactacaacctccgccttccaggttcaagccattctcctgcctccagttcttgagtagttgggattacaggcgtgcacgcacaccaccatgcctggctaatttttgtacttttagtaaagacagggtttcaccatgttggccaggctgatctcaaactcctgacctcaggtgatccggccatctcagcctcccaaagtgctgggattacaggcgtgagccactgcgcctgacccccaaaatacctttattatttatttatttatttatttatttatttatttatttatttttgagatggagtttcactcttgttgcccaggctggagggcaatggtgcaatctctgctcactgcaacctctgcctcctgggtttaagcgattcttctgtctcagcctcccatgtagctgggattgcaggtgcctgccaccacgcctggctaatttttgtattttgagtagagacgatgtttcaccatgttggccaggctgatctcaaactcctgatctcagttgatctgcccgcctcagcctcccaaagtgctgggactacaggtgtgagccaccacgcctggcccccaaaatgccttttaaagctctttttttccaaagtccaagatctggctgggcaaggtggctcatgcctgtaatcccagcactttgggaagccaaggtgggaggctcttttgagcccaagagtttgagaccagcttgggcaacatagggagacacctgtctctacaaaaaaaataaaaaaatttgttttcaattagctgggtgtggtggtgcacacctgtagtcccagctacttgagaggctgagacgggaggatcatttgagtcctgaaagtcaaggctacagtgagccatgatcataccactgcattccagcctgggcaacagagcaagaccttgtctcaatcaatcaatcaataaagtccaaaatataatcaaggttctcacacactgcgtttggttgtcacatttcttgtctcttttaacttagaacaggcctcctgcctttttcttcttctcttgactttgtctttgtgtgaatgtcccacaatttaaatttgtctgattgtttcttcatgatgagatgcaggctaaataatcttggcaggggcacctgtggtgccttttattgtacctcgttaggaagctcatgatgtcagcttgtcccattgtccatgccaggaatggcttcatggaattttattttatcttttttttttctttttttaatttgagacagagtcttgctctgttgcccaggctggagtgcaatggcatgaactcggctcactgcaacctctgcctcccaggttcaaacgattctcccacctcagcctccagagtggctgggattacaggcatgcaccaccacacccggctaatttttttttttttttttttttttttttttttttttagtagtagtagagacagggtttttccatgttggccaggctggtctcaaactcctgacctcaggtgatccatccgcttaggcctcccaaagtgctgggattacaggtgtgagccactgtgctcagcctggaattttttaagatcatctttttttattttttattttttgagatagggtcttgctgtgttgcccaggctggagtgctatggcatgatcatgactcactgcagcctcgacctcaggggcccaagccaccctcccacctcagcctcccaaagtactggaattacaggtacacaccaccacgcctggctaattttttaattttttctttttttgagacagggtctctgtcgccctggctggagtgcagtggtacgatctcagcccagtgcagcctcagcctcctgggcatcaatcctcccacctcagcctcccaagtagccaggactacaggcgcacaccaccatgcctggctaatttttgtatttttagtagagatggggtttcgtcatgtgggctaggctggtctggaactcctgagctcaagcagtccacccacctcagcctcccagggtgctgggattacagacgtgagccactgcatctggccattttttttttttttttagagatggggtctcactatgttgccctggctaggctcaagtgatcctcccaccttggccacttaaagtgctgggattacaggtgtgagccaccatgccagcccccccggcgttttttgagacatggtcttgctctgtcacccatcgtggagtgcagtggcacaatcatagctcactgtagcctcaaactcttgtgctcaagtgaacctcccacctcagcctccacagtagccagaactacaggtgtgtgccaccacacccaaataatttttttttcttttttttgagatggagtctccctccgtcacccaggctggagtacagtggtgtgatctcagctcactgcaacctctgcctcctgggttcaagtgattatcctgcctcagcctcccaagtaactaggactataggtgcacaccaccaagcttggctaatttttgtatttttagtggagatggggtttcaccatgttggccaggctgcttttgcactcctgacctcaagtgatctgcccaccttggcctcccaaagtgtcattaggtgctgggattacaggacagctaccgtgcccactctaatttttaaattttttgtagatatggggtcttgctatgttgcccaggctggtctcaaactcctagcctcaggtgatgctcccactttggcctcccaaagcactgagattagaggtgtaagtcactgtgcctagcgaaggtcattcatttttagatcctgcccctgtaatactcgaaaggggattactttggcatgcagctcgtggtgaccctgggacccccaggctgaaatggccattcagcggcctgagggtcacccgatccatgtgatgtggacaggacagctggatcacaagggtcagccccagcgagcaggctcactcatgatggacatattgagagacctcttagttgtttagatggttttgtgggaagcagcaaccttaaagggttggcttgtaattatacaattatgcatattgtctatcccttcacttatctgtactgagtaaagggcaccaagagagatttccagatgttgtcagagctgggatagttctatttgtcatcctggtgcactgttggaattgagagatctacattctggaaatagctttggtctggactaggaaagaggaaggagtgagggagtgtggagcgttgtcaagactatggaccatatgctggggaaggaaaggatgcagatggggagaaagagatgaggtctctggcatgagccctgggtagcagctggtaccacttggggagtggggagccccagagctggtggccttggaggaggggctttgtgagcccagtgccacatccctggggtctgggagccagagacagggagaagcagacccgtactgctaagaggagagggctgggctgagggtgacgcatcaggatgtgccagattgtggacctggcatagtctaagccctgggagaggtgagcactgttttccaggcagggagcccaaagcgtgaagacctggggaagggacagagtgctgagcctcaggtttctcagaattttaagcgcaagttctccaaaagcaatgtaactcaaaccttgtctaattttattgacatactgatggtccccagcttacgatggttcaaattacaatttttcaactttacaattgtgcgaaagcaatataggctttcagtacattcctcaacttacttccaaataaacccatcgtaagttgaaaatattgtatgtcaaaaatgcacttttttggccagggatggtggctcacgcctgtaatcccaacactttggaaggctgagacaggaggatcacttgaggccaggagatcgaggccagcctgggcaacatagcaagacccttgtctcttaaaaaaaagaaatgtgtttggctgggcgcggtggcttacgcctgtaatcccagccctttgggagaccgaggcgggcagatcacctgaggtcaggagttccagaccagcctgaccaacatggagaaaccctgtctctactaaaaatacaaagttagctgggtgtggtggtgcatgcctgtaatcccagctacttgggaggctgaggcaggagaatcgcttgaacctgggaggtggaggttgcggtgagctgagatcgcgccattgcactccaacctgggcaacaagagcaaaacttcgtctcaaaaaaaaatgtacttttgacttgtgatattttcaacttacactgggtttatctggatgaaatcccattgaaagtcaaggaacatctatatattcatttgggcataagtggaaatactggtaagtagcctgaactcactgatcggagtaattagggtgaggctaatgtggtgatttaaagcaaaaagaatgtgaagtaaataagcatataggtggccaagagatatagtcatgcaggtgttgggagagcaactggtgctgggcgacagacattagaggacaggagggctcccagcagcttctgggactgccgttctgcccctgaagattggctccccctgccttcagcgcagcaggatttgcggccttgtcagagagcagccagctgggatccaacgggaccttctgggaggtcctgcaggggttgcttccttccgtctgccttgttgtccccctcctgtcctcacctggtcttgttctggctgtccatggaccctgggctgtggcaggtagtgtggggctgcaggtgcatgtcccgggtggggcatgggccaccgacgggctttgcagggtcccctcccctgcccccttcacggctgcatctgtctctttcctccacagggggaggggttgcaccagctacgcgaggctttgaagattttagctgagagggttttaatcttggaaacaatgattgggctctatggtgagtagagacagacagacggacagacggcccagcccctgcctgccagccttccccaagccctcctggggtggaactggcctgagcccagtcatgaggctggagaaggtgcctgccccaggcaagcatggacctgagaggccacaaccacccttccctcaatgactggttccctcctccacgggtgcaggggtgccctagaaacccgggccctgctgctgtggtcagacctgggcctctaagcattatgggtagtgtggtttctaggcctgcagggaaccagagatgaaagattttaagtttggaagaaattatgggcaatggaaccaaactccactccagcagtgggattgtgggtaacagagccagactcctggagtgcaaggaaccatggggaatccaatcacagctcaggacaacaggaggattataggtaatggatccagactctagtcagccttcagctctagagaaatcatgggtaacagagtcaggcccgcaggacaataggtcatggagcaagactccagaagggcaggggactgtgggtgacagagctaggctcaggccccaggggactctgggtaatacaccacctactagttctgactttcctctcccataagcccccagaggctctcacaaggcagatcctcctggtcccaggtgtcccctttgcagttttccctttggtcctcctaacctgttctgttggtccctttaggggactaagagagccaggccctcactcaccccaggcattcattcacccagaaactctccacccatgtggttatttgaggagccaggccagccctgtccccaccataggaggggaaactgaggtctcagtactgagactcactcccaggctcctgccctgacgccagctggcagtgccctcccaccctccccgcttggctccccagcccagccctcggaggccagactcgcaccgtctgctcttctccatctcccatcaggctcctagcttacagagcttcctgcagcagcaggctcagctggagctcctggccagacgggtcaccctcctggaagccatcatctggccaggtaatggcagggcgggcaggcaggggcagcctcttccaggaagggcctggaaaaggcctgggcatgcagaaggcgccttccgatgcttggcccaggccagcggacactcattcttcatccagccagccagccagcaaatggtgcctggcagagagaaggctctggtcacttgagtgaatgcgcacctgctctgtgccaggcaccttgctgggacaggctccacaagataagacagacacagtcctgcccttgaggagtgtagggtgctggggggctcaggagaaccctgacactggtagagaaacccaggtgagctacactgcaggaaagggagtacaggcagccatggaaatacagaagtgcctctggcctggcccagaggaggttggaggggggtcagggaggtcttcctggaggaggtgatatctaagtgaagacttgaagggcaaggatctggggagagtgaacaggcagagaaacagcataagcgaaggccaagagaccagaaggagcctagaagcaacagaatctggcagggcctagattgagaaggtcctagaaggcaggttggggtagtacaggaggtggttagacaccagtgggtggtacccctccttgcgtctggctcctgggagtgaggctgagaaaatctctccccatgaaactggagcctgtggctggccctgaagaaaggaagggattggccacccgaggggctgagctctattcctcacctgcccagccgccctatctcgcagcccagtgagcacatcagtgcacagaggcctccatatcatgtccaacctcgcatctattttaaagactgagaggccggtcatgttagctcacacctgtaatcctagcactttgggaggccgaggcgtatggatcacctgaggtcaagagttcaagaccagcctgggcaacatggcgaaaccccgtctctactaaaaattagttgggtgtggtggcgggcacccgtaatcccagctactcgggaggctgaggcggagaatcacttgaacccaagaggcagaggttgcagtgagccgagaccgcaccactgtactccagcctgggtgacagagcgagactccatctcaaaaaaaaaaaaaaaaaaaagactgagaaacttagatcccaagcaggaagaagggttaaggttagagcccagcctccttcatccagcaaaactgtagggagcactcattgaaagccagacctgttgggcactggtgctctggagtacagataggtgctggccttggggagctggccatgagtggcagggaatcgtatctacggagatatggggtaggggagcatggaaggatatggatgaggaagagtcacttgtccctaggggttggagaaggcttcttggaagaggggactctgcgttgcgtcctggaagatcccaatgagtgtgccaggtggggaagtgggtcgggcagccttgagagagtcctgcctgtgcagaggcccagagcctgggaagggtgtggggtctgcttccaaagctcctcccacagtgccacatgcttctctaacttctagaaacttcagtgcctagctcccagacctcctcccctcttacagagaggggccaaggaccaaatctcaggctctcagaacctttttaggtgtctccacctcctctctgaggattggagcaggagctagaagggacacatttgagccaccatgtccctggatctgtccctgccttcagccagctctgtctctgacagcccagggagaaaagtgccagacacctcagaagtcccacacccactgccagtggcccctcaagccagcttgggtcggggcttggagggacaggtcgggggactgggaaatgggacagggaaggaggtgggaccctccccattggcgcaacatacacatcaggtgctactgaagacccagatggggttcatgtttaggttataatcaataattatgataatagtatcagctgccacgtgtctggcccacctgggctggattgatcatctccaatctcttagaggagtaaacttgctaggtgagcgatgccgtggccattttacaggtgaagaaacagaagctcagaggctcctgtgactgcttcagagtcacaggaatgggaatggtcaggctaggggtccacctcaggtctcccctctaaagtcctggccctttggactgcatcagcaaaggtttgctgactctgccactcatccagggccccaaatttgattgtgacaaactcacaggggccagacctgcaggagacctgggtggaagcgacaccaacctagtaaccataataatccagcatttcccgtgaaaaccactttccagtcctggtcacggtaaacacatgtatcacaagggtgtgaaaatgggactattatgcccacgttccagatgacgctcagaggttctatgacttgcccaaggccacataactggcagagtgggaccaagccatgatcccagctggcattggggccagtgctctgtgccactcccctcccacgctccctaaggcatggaatgtccctttcagtgaccacacatgcctgtctgctccgggagccctcaactcagcccagaggtgcagggcaggctgggccacacagggtcggggcactggcagtcatgattacgacggacagcccactccatggcagtgccctcagtgggaacctggtgtttaccagaacccaagtatctgtcctatggaggcttagccaagtcctccaccgtggccctctcctccctgagtgtccatctccccctagaaaaacagcctattcttctgacctgcctggcctgctcattttactttgggaagggctgagatgataggcacagaaggcttcctggaggaaatggctcctacccttggttttgaaggatgagtagttttctggttccatccggaactgtccctgtttcagagatgagatgactgaggccctgacagaggtccagcttgcccaagactgcacagtaggtcagtggcagagcctggcctcctaagctctttcccccaactggtggcctagcccatgtctgttccctggcctcagtttacccagctaccaaatggggatgactcagggcacacctccaccccaaaatgaatagaaaaagaagcagcctttctatgaagcattcactgcatctaaacacttcctaaaggaggtgggtgtggttatccccacctgacaaagcaggaagcagaggccctgagtgctctccttgggctggggggctggtaagtcctggcgtgaggcaccaaccaatctgcagaccccctttcccacagctctgcagccagataccagggtggattatacctggcagagcgtgcccggttctgccaccccctagagggccaaggggaggtgggcacctcacatgaacccctctaatgtggcctctctccttcttccctccggcagaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggctccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgcagcttggtctcagtgtgtgcttagatgggggcagctgggaatgaggctacgacggagagggctagaaatgggcggtggagaatgctctgtgctggaggacagagcctcctggaggtataggctgcaaggtgcagggccaggaagcctgtgtctctggacatcagggaacagctctcccacaactggtcattcatttggtgctcactcattcattcatccccctgatgccaacacagaagagtcaaacacaactgctgcctccaaggaggtccaggttgaaaaacaaactggtttttattctaaacacgtactagggcagcatgctggggggcctctcctgcctccagaggtgcccctgctccccactgtggccctctttagacagagtaggagctcgggctacccacatgcagcccagcccttagcacccaagggcctgcctgtgccccactctctgcctgggctagggaggcccaggaccctcggagtgggcaggcccaccctttccatgggtcaccagggtctcagtgcccacttgtcctccaaccaacagtgacacggcaccctccacacggcctgtggctgccagtgccaccaccgcctgctccgtagggaagcccatgcgctccagctgctgcagcctgttgggggtggggggagaagtggggagtgtcagggccaccccggcccctataccaggggaccccacctctgcccaccccaccttaccgcagagaggagacagaggacttggacagccatggtgcgctctggggttcctgggctggcccgtcaagaagcgaggcctggatgccctcctgcagcatctgctcatccaaggccgcccacatcggagtccctggggagaagctggccccagcccagtccaggcctgcctctgaggagccctcccaggtgggctgcacaggcctcaggcttggtgggggcagggctgagtcttcccagtgggaccagaggtcaggggaggccacataaggcggtccagggatgggaggcctggaggagtgggaagagaagagggcctgactggcagccctgccacagtgcccaccacctggactggcatcccccccatcaccctcacctcactccggcaggatgggtgacaggcagctccgccaggctacccggggtggcaaggagcctcaggggccagcaccccgccaaggtcctgcacaagacgccctcctgcagcacctgcagccgtcgctctgagggttccagccaccggaaggccccagctgcatctgtctgcccggggcagggcggccggtcaaggaaaaccaaaagcagccaggggtgggcccacgccacaggccaggccccatgccaagtgtgctggccaccattccctcccgtctcctcactgtggaccagcatggaatagcgtcaccctggtcagcagcagaggctcagaaaggaaaagggatctgcctgaagctactcagccaaacagagccaggtatgcctcaccccaaggcctgggctcacccgtgacccactctgttcccagaaccctatgcaccttttcaggtctgtaactcaagacccacccgtcctggaagaagtcccatggacacacctgctattgccttcagacaggcctggataactcctgtcaccaatccagagtgcagaggccagcctgttctctccagtggcactgttttccccgataggtatgaatcatcttagggctggacgcagtggctcacagctgtataatcccagcacttggggaggctgagacgggaggatcacttgaggccaggagttcaagaccagcctgggcaacatagaccccgtctctacaaaaaatttttaaaattagctggacgtggcagtgcacacctgtaatctcagctactcaagtggctgaggcaagaggatcgcttgagcccaggagtttgaggctgtagtgagctatgatggcgtcgccacactccagcttgggtgacagaatgagaccctgtctctaaaaattaaaaaaaaaatctcagaagcagaacaccaataaagagtgctctagcacgacttatttatttatttatttttgagacagagtctcactctgtcacccaggctgatatgcagtggtgaaatctcggctcactgcaacctccaactccgaggttcaagcaattctcctgcctcagcttcccgaatagatgggattacaggcacgtgccatcacacctggctaattattttgtattcttagtacagggtttcaccatgttggctaggctggtctcaaactcctggcctcaagaaatcggcccacctcagcctcccaaagtgctaggattacaggcgtgagccactgcacccagcctctagcaccatttattaaaaagaatattcttttcctcattgaatcgacttggcactcttgtcaaaataaattgactatacagtaaatctaacagtttatttctagatggtcaattctagtccattgatctgtatgtctatcctgatgccagtaccacaatatcttgattattataattttgtacggcttttttttttttttttttttggagagagtcttgctctgtcgcccaggctggagggcagtggtgcaatctcagctcactgcaacctctctcctgggttccagcaattctcctgcctcagcctcctgagcagctgggattacaggcgtgtgccaccacacctggctaatttttgtatttttagtagagatggggtttcaccatgttggccacgctggtcctgaactcctgacctcaagtgatctgtctgcctcggcctctcaaagtgctgggattacaggtgtgagccaccgcacctggccacttttgtagttttaagttttgaaattgaaaagtgtaagtcttccaggtttgcttttctttttcaagattatctgaggtattctgggttctttacatttccatattatttttaggaccagcttgctaatttctgcaacaacaacaaagacagctgagattttgataagaattgtgtgggatctataaatcaactgagtagcattaccattttaacaatattaagtattccaatccgtgaacatgagatctttccattcacttaggcttttaattttctttttttttgagaggaagtctcgctctctcgcccaggctggagtgcagcagcgctatcttggctcactgcagcctctgcctctcggattcaagcaattctcctgtctcagtctcccaagtagctgggactacaggcgcctgccaccacgcctggctaatttttgttttttggggtttgagaccggagtctcaccctatcgcccacgctggagtgcagtggcatgttctcggctcattgcagcctctgcctcacaggttcaagtgattctcctgtctcagtctcccaagtagctgggactataggcgcctgccaccacgcctggctaatttttgttttttggggtttgagaccggggtcttgccctgtcgcccaggctggagtgcagtggcatgttctcggctcattgcagcctctgcctcacaggttcaagtgattctcctgcctcagtctcctaagtagctgggattacaggtgcacgccaccacgcccagctaatttttgtatttttagtagagatggggttttaccatgttggccaggctagtctcgaactcctgacctcgtgatccgcccaccttggcctcccaaagtgttgggattacaggcatgagccatcgcgcctggcctaatttttttatttttagtacagatggggtttcaccatgttggccaggctggtcttgaactccagacctcaagtgatctgcccgcctggcctcccaaagtgctggggttacaggcgtgagccactgcgcccggtcaggcttttaatttttttaatttttaatttttgctcagggtggtttggctattctgggccttttgtggttccatataaattttagggttattgtttctatttctgcgaagaatggcattgatattacagggagcccacgtagccctttacattgtaattggcacctccaccaggccataagaccccaggtcccagcccagagcatgtcccagaggaagactcagagaagctcctggaatgtgtgtgcacggctccttggtattgcttgggccttcacccctttgtgccacttccttcccaggcacccacccacagaacccacacatccccacgggccctgggctcaggcaaaggatacaggccaggccggcaaggaggccgcaaaggagctgcaggaagggtggctcagagctgagcagtggggtcagggcaagcagcagccacggcgacagccacggtggcagtgccccacggggccgtctagggcggtgtccctccccagccagcatggccaggtggacaggcatgtatccacagctgccggctgcactggacagcccaaggcctgccagcagcactgccagcagcccagaagccagggcgagcagggctgaggcatgcaggaatctcagcgtgcccaggtggcactcctgctgccagcccacagtgggcaggagcagcaggctcaggagcaggcctggcagggccgtgtggcccagggcatgggtcagcagccggtgcactgggagagagaaggggcttatgtgccaggttagtggccccaacatccaaggctgtcccaggtgtgccaggttgaaggttacgctacaccagggccacctgctgagcccacctcccctccccaggagccagtcttcccacagccagcacttaatcattggtggaagggaccaaggacttccaaacactgtggctacgcctctgtggtattaaacagaatacactggacgtgccactcagtcttttcactgacaacccgctacagagcactcactatgtcccagacaccatgaaggtactctgcttctgtatttactaaatcatacctggctgagagcatgaaatggcctgcttcaatcctggagctaccccattccctcaagctgtgtgaccctggtcaaatcacttaacctctctgagcatcattgggggtcctcaaatacaaattggaggagttattattgggaaacaggtgctcagctgaggtcactcctcaaaaccccaacacctcctcctcccatcctgatgcttagttgaaagtcttagctgtttttttgttttgttttgttttgttttttgagatggagtctcactctgtcacccaggctggagtgcagtggcgcgatcttggctcactgcaagctccgcctcccaggttcgcgccattctcctgcctcagcctctcgagtagctgggactacaggcacccgccactacgcccagctaatctttttgtatttttagtagagacggggtttcaccgtgttagccaggatggtctcaatctcctgacctcgtgatccgcccgcctcggcctcccaaagtgctgggattacaggagtgagccactgcgcccggccaatttttgtatttttagtagagacagggtttaaccatgttggccaggctggtctcgaactcctgacctcaagtgatccacctgcctcagcttcccaaagtgctgggattacaggcgtcagccacctggccttagttcttatttcaaggaaaagctgctagaaagggaaaccatgagaaaagcactcctacccataggttccagcccaccctagggagtcctctgcctcccttcttggctgtggatgtgctgggcatgctcctgtctaaggccatgctttcccgggacactgggccccatccctgtttgacccctggaggccttgtgctgctcctgccaagtgggcccaggccctacagcaagtctcctgcttcctccaaggtccacgtggctggccctcaccctgccaggggtccagcaacagctccggggccaggaccaggccggggccggcccccaccagccacagggtgctcatcagcagcatcaggactgaggaggccagaggcagtgctggggacagttggccatgggggcccctggcatgcatcgcttggttgaggacggtcaagggtggtcctggggctgtgtgctggggataaaagaaaacaataacaagttattactggagcttttatctcaccaataccctctcaagcaccttatcaacagccctattttacagaggtggaaacaggctggagacgcaggcccagcagcttggccttagtggagctcagaccctaacccatgcgctcataagccatcttaccattccactcacctctgtttaaggactggcaggggacaggcatagagacttctgagtcctgataggccctgaactcccaaaaagaggggttcaggccctcaccccccagggcgaattcagggccatctctagccctcttctgtcctcccccttccctcagactactacctccctccttcctcccctcccctgttcccagccttaatgctccagatggtttcagttgcccttgaccctggggtggggccagacaatgggcaagccgacagggtaaggggtagggcagatgggcagaagtcccacatcttgagccatactcagagacctgcgactgagacatcccctttgagggtgaacccatccactgtaagcctcctcctgcttccttactggcacagcccctctggccctggctcccctttccacaggaagggtacagtatgcgctccacctctttctgctctgtgtcctgaggcaagtttccaacctcatctttttacagatgagcctcattttacagatgagcctctcctttctcatctgtaaaatggaaattcataaattcttttcctcagagtatgatgaaataaaaaggaataggctaaggcaggccctggcccacaactcttcctccataaaccatagcaatccgcactaatcatggcaggcgtctgtagccaccaactggcccatcgagaaggcctcaatatggaggtggctgctccagcctagctggtcccagctttggccctcaaacatggcctttccctgcccaccaaagcaaggccttctcccccgtgctgttctcttgcatccagcctgtcctccagggcctgtaggtcttcacccctggtcaggcctctcggtcccaggactcccactgagctgattcagggcaggaagcaggatcccagagagacaagaaggctgcctaatttgctcccctgccaagcgccttctccacatctaccagtttcctgcaggaaaaatgtggaaagctcctctgcctgcattgtccttccctccattttgccagcaggcaaactcctatttcacccttggaagcccagctcaaatatcccttcccctcctctggccccctaacatcatggatcttatccttaggagcacagcttggccagtctgtctccctaggcaggtggtctgagctcatggctcctctgatccaaccccacattccccagggtattcacagcacacagccagtgctttatatatgttcactgaaaaaaggacactagcttggctcctggtcctgccgagggatttgaaggtgaaccctgcccttcgcggacccgggcatccacctagggggctggggctagaggtccaggaaggtgggcagggtcagccttgcctggaggcagggtttggggccaaggcacccaccgtaaacctcctcctgcatcgacacctcacaaccattccccagctctgggcaccttagcaagggtgaagggcttacccgtggacactcggaactgggacttgagccccctggacctcactttcttcaatctatgaaacggggcagtgcaccaccaggccctgcctaccttactgggaagccgggagggcagaatggaaagacaaggacggagattcttccggtggcggatagagtagggggtcccaggatctgtctggttcgaactcagctggtgactttgcagagatactcaatttccttgggcctcagtttccccttctgtagaaacaaggatatcggatgagggatgattaaagggcctgctccacctcgaccgttaccggggatagggtctcggggccaggcacggcgttcgaggcctcccacccagccgaccggccttggggacccttccccgctggcccgggccacgcgtcccgggtactcactgcagagcgcgcccggcaaccccgaaaggccggtcggggaccccggctgggagtcaggactctagctcccgggcgcgacccgagaaccctgaatccattccgcgcacacccggccgcgtgacccctgccgaccggctggcgcgccacccattccccgcggcccgcggattagtcagcagttgttctagtccgggtcccttcccccagccctcccgccgatctccgtctccctgcagggccgactcttcagcgaccgtccctagagccagcggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacgggtgagtatggtggaactgcggtcgcgccggcggtagccggaacgcccaaactgggggtcgttcgtctctgggcttggctgggaagactgagtggagttgccgagagggggttgaggcacccgccgcggcccgacgagctcggggatccgcattcctctcccctcccccaaccgggcgggccggttctggaatcttccggcgcccgtggcgcgcggggggcttgctgcggcgggggcgcgcggggcccgccttggcctccattgtgtggcggtcctcgcgccctgagctccgggcctcccgccacgtgggcggggcctgcggccttcgaggccctgcgtgaaggggaggatttggccaggcctcaagccggtcactatgaaaccgccggggggcccgcaggctgctgtccctgtgaggcctccctccccgttttcagggtttcctgagaaaccaggggaaaaagcaaataaagataccgtggatttgtgggccgaggggtgccggcctatgagcgggagccccgtcatccttaagacccagtcggctggggcgtctggcgctgccgagctgccccctctgtggcttccagccccaagccgaacttctgctcgcctgggctttagacagaatgtgcttccctcctccagggcccccagtttgccgctttcttgggcttctccatttttatcgttattaatccacgtcctcccctcccccaaaaccaattaagtggcttcccagggccctttttctgcaaacgccgagggacatccgttgtataataaggccagcctgggtcgagagacgagaaacgctaccagaaagatatttctggtctctctgacctaggaggaacaaaaggccgagccttcatttgaattatgtttcagcagtggcctcgcacgtttattcgcctgcgttaggccggcaggcctgttgatttcgtaggtcgacagaggagaggggaaaaaaggccagtagaagcaatcttaaaggcacttgcaagcaagccccggttgggaactccaaaatgggagtagagtggtccttgatggaaggagcgtttaagagtgtcgcctagccatcacctgcagttcgcaatctgtgggtacactaacccgcgaaaattggcagggtggagcatttttgccccgggggtattctcaggccacctggttccaggccttagagacagtgggagaagatgagaaggaagacaggaaaagttctgggcactccagagtttttggagtccagaatccagcaacttaaggacagtttaagaattctccccatctgtggtcaataaacaggtaagtgttggctgttcgtgccgggataccaaagagtggataccaaagagtgccggtagaagagaggactgaaataccacagctaacctcccggtgggaagtggtttcctaggtgccctatccaccctcttctgctctgcaaaagcctgaaaaggcaaaacgtgtgcgttgacatttttgcgtggctggacgtgccttttttcagtcaactttgttcaaaccttgttcaccagtaactaccatgtgctgtactgtattagaattacagttgtggtttctgttgacacaaagtaaacacattaggcctggctgggggggccttcagagagtcacataagtaatctggtccttagtttcctttcctgtaaaatacagaagttaggctagacctcttaagcttttgagcccttctgaccttccagcataagcattccacaaatttgtcctatgctgacttcagctcaggtactgtgaagctcaactcaggtagtgtgaagcagcttccatagtgactgctctaaagtgttaaaccgttgccttgggttaataatagaagttttctctcctcgtatgttatctcatgtagaaaagtacgtaaagcatatatatccagtgcaacaaagaattggaatgcagactcgcagcaatctagaacccccagcgctcaatcacagtgaagtgatttttagtgaagtcagtggctcacttttgggggttaaaaacgaacacggttgctgaataatctgaccagtttgtaattgtattaggttggtgcaaaagtaattacgtttgcatcaacctaatagcttgcttgagggcctgtgatgtttgtgtgctctaggaagataaatgtaagttcatgaaacaaatttgctaccttctatagcccaccagttagtatagggccgaatcctgtggtttctcactgataagaggtcattggttgttccatatcagctttgccagtttgatgttttacataactgctcttgcgtaaaagtcgtcttgcaaacgttgaacttacatgacagtgatttacaatcacttctcaagcaaagacctcaacaaaacgtgggttaaaatatttgatgttaaatgattcattgctgtgtttattttgtagatgccacatggaaaaaatgatctgcatttagttttaatgtcagagagagtatgacttgtagtgctattgaaaatgcctttaagattgtcatgaacagattatttttttcattataggttagcctttgggcagttgatttgttcctcttggtgattcagggttttgagttaagagtgtgtacaaaggaaagaaagtagtccagtaaagtacagagaggtaggcagataagccaacgtgaagagatggattcagcaaagctctctcaggccgccgagggattgtgaggctggctttggattccatgaagtggatgccatgaagagctgtcaattgttggttttggatgagggactactttctgattggaaaataaaggaccccttttttccgtcctaatggcagtactgtcttcagacagaacaagatatgtgttcttgtggagaagaaagaattgggcagaattttcaaaaataattactttaactgcctttaaaaaaaaactaaatttatctaactttaatgcagtagcgctctgaaaactattttccgtttgtttttactacttgtagacacctcagtggaccagtttttggtccctttggatgcatgttataaatttcataggaaaaggaaaattatagggaggtttacttagataagggatgaaaattcatgtcttttttttaagttgaaatcattttgagttgtatgaaagacaatggtgttaccaaatttttcccagaaagactaaatgctttttcttctttgccagtcttcagggttctgccttagctctgcttcaccagggtttataatatatctagcttttaagttgctgcacaaatatagttctgacacagcaaaccctttaaaacactggagtgtggtgactgccttcttgtctgccattccgtttcactgtcgttgagctagggaatgatggtttgtctaacttgctaaagtgaggggagtgaaaactaatttttgaggagaggtaggttctaacgtaaccaatctagtgttaaactttgtattattgttgcatgcctccgttttatatgagggtagaaacttctgatcctgttagtagatcttgttgtcagtctgtgatattgatgatcatcctgtattttaaatgacagttgggattgggatgggttttgtggtcatgggaacataaaaagtatacctgccaaatcagctgatcttgacctcattagctagtcccacagtcaaatgttgagtttaactggtttagacttttttttctgttagatgttgagaggtaagggggactcatttggacctgtgttggcaggtctccctacagtttaaagaattcttcctgccacgtgaattctttcccccttttttctcttctccttgtttctgctaactttacactatttttcctccttgttttcctctagattacagtacctatagccaagctgcagcgcagcaggggtaagtcagtcttttataaccgtattttgtgtgtgattaatattttttgaatatggagccttctataattgtagaggtggtatttgaatgttctctattcaagttattgcatttaattcttttgcagctacagtgcttacaccgcccagcccactcaaggatatgcacagaccacccaggtaatctttaaaataattacatgtagctgcacctccaagtaaaatcagtatattatccagttatctttcagttatccagtaaaacaaatgagtaatgtgtttggaatagtaaaatacccaggcattttaaactttcacagtgggagtgcgaaggactccattgtgccatcataaatgaaaccattcagaagctgataattgactctttataactttttaatatgatttctcaagttaggtgccctgttccatgcttggtccttcttcattatgtttaaatttagtgaatttattcatcatagcaattctgcaaaggaagaggatgatatgaccattctgcagaggagaacattgcagtgcatagatattaagtaacttgccagtggttgcacagtaagtggcggggttagctctaaaaactggcgacctagccaaggagctgctgagctctttccagtgaagagtctgttgaaaagcctaggccaacagattctagaaattagccttctagtgttttcaagataatgttgaattctgaaatgatccatgccataaaatggatactaataactgccatggaaacatgttctaggacaagcagaatgtgatgtctctggcagatcttacataactggtcatttaaacaaacctagagaataatcatgctaatatctgaaagaacaactcttccttgcctgattttaagtattatggatgtctaagttcaaaagacagtactcttgatgtgcccaccataagaggacatacagcgttctggttcattttctttgaagtggtatagtagttttaaagtctttttgtcaggctgaaaatctggttttcaattttttctgacagattttagccctcttcattgctttctctgttcatttgtcttcgtaccttttgtttccaatcactaaaactgtgctacgctaagtgctagcagttaatacacctgtgcccttattgctcttcccttgagagtgtcttgttaatctcatgtatagttaactgaggttttgcctgattatcttttttttcccccttttgagaagctgtgaatgacattgcctacttacctaatgagctttttccgtagctaactttaccataatatgagtgaaccagataagggataacattcatgatactgtgattatttgtcttgttttgttgtttttgttttgtttttttaatcttctagaaaggaatgtttttgattttggttctccaatttagtccattttattgctaaaatacaaaagttcatgtatgaagttcttgcattcgtttttttttggagcaggcatatgggcaacaaagctatggaacctatggacagcccactgatgtcagctatacccaggctcagaccactgcaacctatgggcagaccgcctatgcaacttcttatggacagcctcccactggtaaggcctgccttggagagatttttgggtcgttctggctagggcattggctaagaagcttattagtcatgctttcggatgtatattctggtccataccttggcatctggggaatcctttattcttaggaagaggtattttttctctttcttccctactcttatagtcttgagagatctccaatagaatgtgggtgggataaattccaagagagaaaagaacttttaactgtttgaataatctcacgatgaaatggagactatgtaaaagattttgctaatgctaatactgagtaagaatgagtcttcttaaattgagctgcttaaaaatcaaactggttttcacatgtttgcttcatctgatagtgtaccctctactttttgttttgtgctttccacagtagaagggaccagtacaggtttgactatcctgctcattcttgcatgggaaatgctttccatcttgtctaaccctgtaatgttaatcctttaggtgttttcatttgttgaacccccaaactttctaacatcacacacagcaaggtgctaatgaaaaactgcttcaggtgccatttgcagatccatgtcctattctttatatgattttgggaaaggtttttttatttaatattactttgtttcaagccttaataatagttatttaccttcccaaaggtatttcaggtgatttctccccagctgattttcccctgttccctgaaggatagattgcatgatgagatttatttagaggagcagactgccaccctgcatgtatcatgtttgtctattggttggtttctagtccagacacattttattttctgttttaagtgttatgaattattttaatccatggtatgtcttgaatatatataacattattccaagatactaaaaaataaactattctaagaattagaagaaattgtattccgatactgaggttgggtgggatacatgaaaaacctatgataatttttttgtgttcagtgctgtgtaatgtttcaggctgtctccccctgcccttttattattgctgttataaaagactctaataaagtcttaaagatatcagagctcttattttcaaactgtctttagttctccaaattatatatagtccagttaaggggaaaaacctgtctgtaatttatctcattgagtaccagtgtcctgattttgatgggaagtaattcctaacctcttctagggtgtttctcaaataggatgggaaatgtttatctaaactttctagtggtgttaattgcagctgtgggaagagctggaactaaggttatgcagtttggattttttagcatagaattttgaaattgtgagataaacttcatgtattaaagccattacattttttaaaacaagcatgatgtgaaagttaatgtggcctagatctagccttccgaatccttagatcattttacaggaatgagacggagtgatttataggcaaattaatggttctctagagccatgtatcacattgtcgttggttgagaaatccccatcatgactgtgggcctaaaaagtacaggtcattctagtttagagactagtagctttgatgagctggagattgcacttagtaataataatgtttgtataaaattcacagtttatagagtggccttcttgtctcccttaatcctcccaagaacttttggggtataaaaacaccaaaattaagcctgatgagcaaactgtgtgaacaaaacttagcaggagcctaattggtagtgcgtgggttcaagcacacatgctgcatttttccttacctcatactgcctttacacatgaaagttatcggatagtcattggagggaatacatagaaatacactgttctcttctaggatttttaaaaattaaacttcagaagaaaggggttatataaacctcaattcaatggaattcttaaaaacttcttaatttttacgttgaacaaaagttttggtttgtgtaatatttcttaccacctttttccttcaagttgtcagcacatagtaggtgtgttttctttttttgccactggtcttttgtttttttgtttttttgttttttttttggtcattaaatcattttgctctgttgatttttgttcattttgcttggctgcttttgtgggtactacagattaattaaaaggttatttattaacccagtgtctattgctgtaatctttagcatgacaaggccctaactgttgctgcatagttttatgacatgagttattgccctgatcacttttagttttttgtttttttaattgccctccttgtaaatcttatagacgtgtcatgtagtggggtgtaatcggtatatgaacggtagggtagatggtattagattctaatttaaataaatgaatgccttatgtggttgaccttaggactctgcaaaaacttaagcagttcagatgaacaacatgccaactcaaaaacttttattgcttggggcttcctgttttctggaactatgtatactttcatacacattttaactcagcagttttgacaaggacattactatctctgtgtataatttcagaatttccttttaatatttgaggtagagaagaaagagtattattatattctgtgctacaaatggtgattgtacaaaaggaagctgatacttgtttctggccagtacatgaggacactttaaggccctaaatcttaactaaaatgggcagtcttgattcaggatttattttaaatatggaagctttttctttagtgagatgtagactttttttttggatataaatgccagcacctagaccaaagttttgttttgttttgtttttttaagatagggtctctgttgcctaggctggatcttactgcagccttgacctcccagcctcaagcagtccacccacctcagcctcccaagtagctgggactgaaggctcacgccaccatgcccagctaagtttgtttattttttgtagaggcgaggtctcactatattgcccagggtggtctctaactcctaaactcaagcagtcctcccacctcagcctcccaaagtgtaaaccaaactttttattgcatggcttaattgtacccattgaccatgaggaagaagagtccagcaccaggaatggttgtaacacctcctacaggaaaggtactctagttaggagctgcagactttcgtggttttggtcatgctccacgccgaagtcccgaagggaaaggcatggatcctgcctggtctggcagaggcaggagctagggatagaatgcatcttgctttgcagcatacctgtgaaaccaggttttttctgacacctggttagtgaaatactgaaggggaggagagactctagggtttacctccaatattgctgagcaggaaaaaggccttttgcttgtggtaggtaagtaagaggaatggagctgagtaacttgataacgaggcaggaatctgctttatgatgtgaaaacattaccttttaaatgtttgtttggagcaatatcgaagtttaattttaaataatttacaaaaaaaggataaactgtgttaagcaactataatttatagcttatttttattaatcatgtgctcaagtaattaagcttgtgcttcacatgatgttagtgcttgggaccaaaagaaagtgattaaattaattactacccaaattacaggttttagtgctagaactagtacctggatcattttctaattattttaaaatgctatgtcatttgccttttaccttttcttctgggatgttttattcctgcttgagggtattttggggtaagtttgtttacaaacttgttaagacgacctgctagcaaaatcagtacagacttggcaaaaacagacttgtctcctattcacagcattcaagagggggcagaaggaaccctgttttctgtagcatgacatgccatttctgttaggtgtggttttagagcaaatgagacagttactttaccaaaaactaggtacattcagagaacttaggctttaaataccagtttgttgctactcttgcggaagggggaatatttaaagggattcaatatcctgatggtttaaagtaagtggtttacaaattgttctgataatgagtgtctaggcagatctctgaggggacctgaaatctgatgcagctctcctttgttctaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaaggtaaggccatggtgtccttaatgcgtcagtcttatgttggagggaaagaaagcaactgtgtacacttaaaataatctgtggtttagttccttattagtggttgctttcatatactctcagatgttcactgttagtaactgatgtgctagaacataccacagaaatattctgcatttaacagtgaaattggctgggcgcggtttctcatgcctgtaattctagctctttgggaggccgaggcgggcggatcatataaggtcaggagtttgaaaccagcctggccaacatgggtgaaaccccgtctctactaaaaatgcaaaaataccgggggggcgcagtggctcacgcctgtaatcccagcactttgggaggccgaggcagggggatcacaaggtcaggagatcgagaccatcctggctaacacggtgaaaccccggctctgctgaaaaatacaaaaaattagccgggcatggtggtgggtgcctgtcgtcccagctactcgggaggctgaggcaggagaatgtcatgaacccgagaggcggagcttgcagtgagctgagatcgctccactgcactccagcctgggagacatagcaagactcggtctcaaaaaaaaaaaaatagaaaaattagctgggcgtggtggcgcacacctgtaatcccagctactggggaggctgaggcaggagaattacttgaacctgggagatggaggttacagtgagctaagatggcaccattgtactctagcctgggcgacagaggaagacttcacctcaaaaaaaaaaaaaagtgaaatggtgctatcgaagggtcaaaatgaggaatggcactgaataggttctctggtttcagaatgaccttttagggtaggagaaggctattgtttttaaacccagaagaagagagagagagagtgtgtgtgtgtgtgttttcactcaaaacagcataactgatagaattgtacttttgaattgtacttttgatgcttttatctttgatttcattgaccctgtaaatgggtaaccgctttctctttggcaaaaacatggtagttcacacaggcaggaggggaagggagcatcatgtgagtcaagaaatggtcgtatgacctaattgtctggaaaggacataaccatattcaagaaatcaaacattactgtctcggcttaagcaattgacatgacttccctacattgtatagaggcttaatctaaatattataggcaaataaaaattcttaactgggtaccctgctataggatgagcagagctcataccccatgactggttagcaggtaaacagtataattattacttaacaaaagattttagatctttgctttaggcagtcacttaactggcttgtgtatacagtcttgaaaggacattgaattctggtttgaaagaagacattttaggaaatcaacttctaacctagatatatctgctctagaggtaagaaattagctctgacaaacactcgtgaaattacttttaaaatgcacagtgagtaatcggagccgcttggcaatttacccttggtagaccacctttgcagtagctaagttaaacttagtggcttattcctgaaaggcctcatttccgagtgtcatcagatgtatgaagtcccatttgatactctgatgcaacagtatatccaagccatatctggagggttttatatatgaattgggttttgataagtcatcctttttttttcttttcacttgttaccactttaaaacagctgtctgtctcataatcagtggcaactgctttttcgactggaaaagggtatgggacctatttcagctcaggaaaagttagtacttcacaccctctctggtttttctgggttggttggttggttggttggtttttgagatggagtgttgctctgttgtccaggctggagtgcagtggcgagtgcacccaccacccaggttcaagcaattctcctggcttagcttcccgagtagctgggactacgggcatgtaccaccatgcccggctaatttttgtatttttagtagaggcaaggtttcactatgttggccaggctggtctcgaactcgtgacctcaagtgatccgcctgccttggcctcccaaagtgctgggattacaggtgtgagccaccgcacccggcctgcctgttgattctttggactttgcttaaaatattaatagctctaactcagtctgctgcagccttgatgtaaagtgttagggccaagaggtaatagaaacccctggagttttccttggaactgagattaattttcgtcatttaacagggatacttacttccaggttcatctgagcagggacttgggaggggtctctttgccttactctggtgtttccattacggagactttgagccaagttagattagtttatggcagcccagtttaggaaatgatttttttctggttggttggatggtttggttggttttttttttttttttaagatggagttttgctcttgttgtccaggctagagtgcgatggcacaatctcggctcgctggagcctccgcctccggggttcaagtgattctcctgcctcagcctcctgagtagctgggattacaggtgcccgccactctgcccagctaattttgtgtgtgtgtgtgtgttgtttttttttttttttttttttttttttttttttttttgacagagtcttgctccgtcgcccaggctggagtgcagtggcgccatctcagctcactgcaagctccgcctcccaggttcatgccattctcctacctcagcctcccaagtagctgggactacaggcacccaccatgatgcctggctaattttttgtatttttagtagagacagggtttcactgtgtttgccaggatagtctcgatctcctgacctcgtgatcctcctgtctcagcctcccaaagttctgggattataggtgtgaaccaccgctaccagccaattttttgtatttctagtagagacggggtttctccatgttggccaggctggtgtccaactcctgacatcatgcaatccacctgccttggcctcccaaagtgctgggattataggcatgagccaccgcacctggcagtttgttttttttgagatggagtctctctgttgcccaggatggagtacgcgatctaacagctcactgcagccttcacctcccatgccccagcagtccctcccacctcagtcttccaagtagctgagaccacaggcatgtaccaccatacctggctaatatttttctatttctgtagaggtggggtctccctatattaccaggctggtctgaaactcctgggctcaaaccatcctcctgcctcagcctcccaaagtgctgggattttttttgtttgtttgtttttgagacggagtcttgctctgtcgcccaggctggagtgcagtggcgcgatctcggctcactgccagctccgcctcctgggttcacgccattctcctgcctcagcttcctgagtagctgggactacaggcgcccaccaccatgcctggctaatttttttttttgtatttttagtagagacagggtttcactgtcttagccaggatggtctcaatctgctgacctcgtgatccgccctcctcggcctcccaaagtgctgggattataggcatgagccattctcgcctggccttgacctggtctgtttttaataaatgagaaacataaacccacaaattctctaaatttatgatgccatggacttacgtaaatgttacttcaacctaaaacttaacattattgttagtttctggtcttcagcagtcccctttgagaaaaagcatttattccctaacagatcacttctcccggatcacctaaactggtagcacacaatatcgcaacgcacttttatagcgtttactgtgatgaatggagcatattaatgtctcttctgtggatatgattgattctcccccttccttagtgttgtcttcaagcaaatatagttggaccgacactgagtttgatgtagtttactttaggattgtatttattattgtatttatttccaggcttaatcataacattgcttattgctcgtagctttgtagcattcttacccaggagttttgtggttgaccaaccacacaaaaaaagtcactttttaattttatttattatttctcctcttagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccaggtcagtctactttttgtggcaaaacaaaaacagtgacaaaacagtttttttcaggttgttgaccagcttgctttgacttcttcagctaaggtatgttatctgactgtcgcagtgataagtcatctgaccatacttggttacattaaagcctgagatctagggtcccatagtgttgcctggcagctaataactattcttttttctttttttttttttttcccccgagacggagtctctctctgtcgcccaggctggagtgcagtggcgcgatctcggctcactgcaagctccacctcctgggttcacgccattctcctgcctcaacctcccgagtagctgggactacgggtgcccgccaccacgcccagctaattttttgtatttttagtagagacagggtttcactgtgttggccaggatggtctcaatctcctgacctcgtgatccacccatctcggcctcccacagtgctgggattacaggcgtgagccaccgcacccggcccagctaataactattctttctaaatacaaaaacatttttaccactctaagttctttctttaagtttcttccttttgctgttttagttaactcagatgggaagcagaagtatatgaaagcatgtaaatagatgtaagagccatcttccccaatgcagttaggataagtaaagcgcagggcattataattcaccttaatcattttacattttacctaacacataaaggtttattcatgcactaaccttttaatgtatgggccaactctttttattttatttttattattatcgcctggccaagttttcttttttgagacagagtctcactctgttgcacaggctggagtgcagtggcacgatctccgctcactgcaacctctgcctcctagggattctcatgcctcagcctcccgagtagctgggactgcaagtgcatgccaccacacctgactaacttttctttttgttttattgttgttttgagatggagtttcgctcttgttgcccaggctggagtgcaatggcacaatctcggcttactgcagtttccacctcctgggttcaagtgattctcctgcttcagcctcctgagtagctgggattacaagtgctcactaccacacctggcaaaaatttttttttttgtatttttagtagagacagggtttcaccatgtgggccaggcttgtctggaattcctgacctcaggtgatccacccgcctccacctcccaaagtgctggggtgacaggcgcgagcccctgcgcccagccagtttgtttgtttgttttgagatggagttttgctcttgttgcccaggctggagtgcaatggcgtgatcttggctcaccgcaacctctgcctcctgggttcaagcgattctcctgcctcagcctccctagtagctgggattagatacagacgccaccacaaccggctaattttgtatttttagtagagacggggtttctccatgttggtcaggctggtcttgaactcccatcctcaggtgatccgcctgcctcggcctcccaaagtgctgggaatacaggcatgagccactgcgcctggcccagtttttgtatttttagtagatacagggtttcacaatgttggccaggctggtcttgaactcctggcctcaagtgatccgcccaccttggcctcccaaagtgctgggattatgggattacaggtgtgagccaccatgcccagcctgcaagttttcttaacccatgtttaattagatgtgggttttcaaattgtttgaattgtgccctgaaagttttgctagaagtagcggttcccttttttgcactcatttcattgttttgcagcagatgtgaacaggtttaggaacaagtagaattgattgggtgtctctccatacagccagcttggagcaaaagtgggtagggcttacaacccttcttccacagagcaggttcgtacctattgcattgagagcagttaatagcagttaatctggcaagttggataggtacacagtgagagattattgaattcatacagcaatggtgagggatgtggtgtgttagaagctttgtttgtttgtttatttttggagaccgggtctcactctgttgtccaggctggggtacagtgacacagtcgtagccccctgtagcctcgaacttcctggcctagtttaatcggactttaaaatatgtgtccttactgtttctcatcatgatttgtaaagcttaataccagatgggtttttttgtttttgtgtgtgttttgttttgtttttttgagacggagtttcactcctgttacctaggctggagtgcaatggtgcgatcttggctcaccgcaaccctcgcctcccaggttaaagtgattctcctacgtcagcctcccaagtagctggcattataggcatgtgccaccacacacagctaattttgtatttttagtagagacggtgtttttccatgttggtcaggctagtctcgaacccctgacctcaggtgatccacccgtctctgcctcccaaagtgctgggattacaggtgtgagccactgcttctggcccttgtttttttttttttttttttgagatggagttttgctctgttgcccaggttggagtgcagtggcgctgtcttggctcactgcagcctctgccttccaggtttaaacagttctcttgccgcagcctctcgagtagctgggactataggcgtgtgccaccatacccagctaatttttgtatttttagtaggtggggtttcactatgttggtcaggctggtctcaaactcctgacctcaggtgatccacctgccttggcctcccaaagtgctgggattacaggcatgagccttcaaacctggccaataccagttcttttcaagcttcatttctgtgcaagaatgtatctattaatttctcccatgtaattgacataatcttaatatttgtctttcatacaattccttcattctgaagtttcctctattaatactcagatttcatagttaatcaggcatgtctgaaagattgaaagtagcaaagacaaatctttgagggaaaactactatttttgtgttgagtacccttatcccttcagaaaatcgttaactcgagattattggcgggcaggcttggaactgaatgcctcacttcactctctctatattttctcagtccccatttcactgggtcagccttccccaagtgcatattcttgccacaatacaggaagcatctaaactcccatatttgcctgccttgaatatagttgaaaatgacgttttgttttgttcttttgagacggagtctcgctctgtcgcccaggctggagtgcagtggcactatctcggctcactgcaagctccgcctcctgggttcatgccattctcctgcctcagcctccccagtagctgggactacaggcgcccaccaccaggcctggctaattttttgtattttttagtagagatgggggtttcaccatgttagccaggatggtctcgatctcttgacctcatgatgtgcctgcctcggcctcccaaagtgctgagattacaagcgtgagccaccgcacccggcctgattttttgggtttttttttggagacggaatcttcactctgttcccgagtcgccaaggctggagtacagtagcggatctcagctcactgcaaactccacctcccgggttcatgccattcccccagcctcagccttccaaagtgctgggattacaggcatgagcctccgctcccagctgaaaatgaccattgttttaaatgggagtggcgattaagagaaaactctttaaggattatacagatggtggttataatatttccccctcccagctgggcaccgtggctcatgcctgtaatcccagcactttgggaggccgaggtgggcggatcatgaggtcaggagatggagaccatcctggctaacaagatgaaaccctgtctctactaaaaacaaaaaaactagccaggcgtggtggtgggcacctgtagtcccagctactcgggaggctgcggcaggagaatggcatgaacccgggaggcagagcttgcagtgaccggagatcacgccactgcattccagcctaggcaacagagcaacactctgtctcaaaaaaaaaaaaaaaaaaaaaaaaaatttttttgttttaccctcccatttaatgttttattctgaacacaaaagtatttgctgagttgaaattcaaattgttgatgtgtagaaagtaactactgttttatggatgtctgtgtcacatggtgtgaatgtctcttttattcaggggatttgaaataacaagcctctttctaaaaaagcttttttttttttctcttctctctctttcagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagtgagttgctaagagagaaaaccaaataagaatgaatgtgtttagagtttttttgtggggttgattttttttgttggtttgtttttcttttgagatggagtttcactcttggggctgaggctggagtacagtggtgccatctcagctcactgcagcctccgcctcctggttcaagcaattctcctgccccagcctcccgagtagctgagatgataggcgcctgccactatgcccagctattttttgtatttttcgtagagacggggtttcaccatgttggtcaggctggtctcgaactcctgacctcaggtgatcctcccgcctcagccacccagagtgttgggattacagtcatgagccactgcgcccagccacgtttggagtttttgaacagggggaatactctttgccattgtttgcttttggaatccaggacacatctttagggcatggcattccagctaacatcttggatgccccagtgaagatttcagtgcttttttccaatttgtttttagtatgccttggcaaaaaagaaaagagatactaattgatcagaaaaaatgttttagactgctagccctgctgtctttggggaagttgtatgcagtgagtaaattcaacatcgtttttggcctccctatcagtcattaatgtaaagtggggaggcagctattgcaggccactatgattttgatagtcaagtaaaagctatgtttttttgttgctgtttgtttatatccattaaggggaaaaatggccaggcatggtggctcacacctgtaatcccagcactttgggggaggccaaggcaggaggatcacttgagaccaggagtttgagaccaccctgggcaacatagtgagaccctgtctttttaaagataaataaagattctttaagaaaatagaaaaggaaagggggaaaaataatcctcctcacagaatatttgcagttcttctgtatggagagaggtaaccaaaacacataattatcttcagaatttaggatcattgctctttttaaattacattctatccacggggatttctcaacaactcaaaggagtagtgttgatttatggagctcagcccctagcagtgtgctaaagccctaagaaacctggctctgttttcatttcttgagtttagctcaaaagaagctgcttttggagacatcttaggatatagaaccctataaactatatgttagccagagggctttttttgttgttgttatttagaagaggtttattataggctaactatataaggttatttcagctgtgatgatccagcagttttgttgaacttaaaagagcctacctattaaggatgctttatcgtgatgtaaagaagatggtgccttggttagtgccttggaattgaggattttgtgattccaggagaaagtacatcaggcagtggtgtaaatgctggtccatggcttacagatgtgactctttcctcaggttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggtaagagcaaaccttttctccttttacctaattttgtttcatccataggattttcagtggaaagaagggactgaaagacataagaaattaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtatatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaacagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaaatactccagaagttataatcctactaattgtgctagactttgctagtagagggggcccctctttctggatgagaagtctctcttgcagccatagaagagaccatggctttccccataggtttttcaacagactgtgaagcagtctgtcggatcctgtggggatagacgggcatttccctcgttgcccccctttttattgtggtgtggtgatggttttcagtgtcttgtacaggtaaggcactcaatgttgttaacatgccctttttcattgcctcagtattttgatattttcattggctgttaaacgtggaaactttttaacatgctttgtcgcatttatatgctacaggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcagttaacccccacttgctcctcccctctataccaagctcttctggtttttcacctgacggggtgggtgtttgggatctattttttcttgctaatttgccaagtattgcactattaataccagcccccgaaatgaaaggaaccaaccacactggtgtgtacaatcagacaagcaaggttgtatattgaggaaatttgagcaagctgccctgaagaaaggcatagtgacaagatgagagagatgcattgtttggagatgtgtttagccagtgcccttcttccccacgagcccccccaaggctcagagcggtactggcttttaaagggaaaggccttcatttcttcgtttatccccccagcagcgctggagagcgaggtggcttcaataagcctggtggtaagtttttgagtattaccatagatagtgtttaaaaaaaaatgcagtcagtttttagaaaactataatttttttattagtttcataagtggtttaaaaatgatctatacaaaagagactaatgggtactgccggcattgtcttaggggttaataaggttaacctatggttacaaaacaaagggtaacttgaagtattgagtaactgcttctgtaatatgggggagaataaatttttaaatttggtttatttagaggaaaaattttgacttaaatttaacactgatttggcacataagcattgagagtgtatttggttaatggtttagaagcaaaccagcaaaggaaaaaagcaaaccctagcaaacctttcacaaatgttaaagagacactgctccattttagcagtgcgggtcattttgagtttaatgaatccccatcaaatggtggtatagtagatagctatgtgtgtttgtaaggtttgtagcttgcaagacgtgcactaataatattttatatgatctttcctggttggcaggacccatggatgaaggaccagatcttgatctaggtaattttgaattctagttgtgcttcatatcgtgctttgtaaattaatggtacagaggtaaatgcatgcgtagagttcagcagccttatagaccagtgtgatattcttgctgtcaaggacagtttgggaaatcctatgtgagcatctactcataattgccttaagtgaagtaaaccaaaagtttgatagcattcttcttagtatgcttggtagttttcttagatttatgatgaatatccttgggcagtagtgatcaggtagttaagaaacccctatagatacatgataataattctcctgtcttgttgtctctgaaaggcccacctgtagatccagatgaagactctgacaacagtgcaatttatgtacaaggattaaatgacagtgtgactctagatgatctggcagacttctttaagcagtgtggggttgttaaggtcagtaaaagcataaccaggtcatctggcagaactttaaaccacagagcattttaaagagattgaattgatgttgagagttgttttctaaggttgcctttgcctgacttctttctaggtatcttatggtttgttcctttttaaaaaagattagcctttttttttttttttttttgagacggagtttccttcttggtgcccaggctggagtgcaatggcgcaagtcttggctcactgcaacctctgttcaagcgaatctcctgcctcagcctcccaagtagctgggattacaggtgtgcgccaccagctaattgtgtctttttagtaaagatggggtttcaccgtgttgggcaggcgggtctcaaactcctgacctcaggtgatctgcccaccttggcgcctcccaaagtgctgggattacaggtgtgatcccctacgcccggccttccctcctccacccctagggacagagtgttgctcaatctcagcctcccaggttcaagtgattctcccaccacagcctcttgaggtagctggacttataggcacatgccaccacacccaactaatttttatatttttagtggagatggatttttgcctgttggccgggctggtctctaactcctggccacctcaagtggccacctacctcagcctcccaaattgctgggattacaagcatgagccactacacccaacctcaaattattgtgtctttatgctaattcttcatagctagtaacgcagattttttcttcagggattttgactgtttttcagttcttgctcttctgtattagagttagtttatgaaccccataaacctcaaaaccttaaaaccccaattgaatatttactaaatctatgaagtaatttcaggagaatttacatttttatgatactgagtgatctttttttccccatgaagattttatttctccatttatttgtatatttatttgcttatttatttactgagacagtcttgctgtgtcaccaggctggagtgcagtggcacgatctcggctcactgcagcctctggctcctgggttcaagcgattgtcctgcctcagcctcctgagtagctaggattacaggtgcccgccaccacacccagctaatttttgtatttttagtagagatggggtttggtgaaaccatgttggtcaggctggtcttgaactcctgacctcaggtgatctgccgcctcaactcccaaagttttgtgattgcagacatgagccactgtgcctggcctgtctctatttgttattttattttactttgagacagagtctcactccttcacccggctggattgcagtggcgcagtcttggtttactgtaacctctgcctcccgggtctccttgcctcagcctcccgagtagctggaattacaggcgcctgccagcacccctggctaatttttgtaagtagagatgggatttcaccaggttggtcaggctggtcttgaacttctgacctcacgtgatccacccacctaggcctcccaaagtgctgtgattacaggtgtgagccaccacacccagcctatttagatcttcagtaaagactatcgatttccttaaaggtcttgcaaattttactagttttacttctaggtttcgtttattttcaagttgctgtggttaagggtcttcgttaaatgacacttttctggttattactggtgtatagaaatacagttgatttggccgggcgcggtagctcacgcctgtaatcctagcactttgggaggccgaggcgggtggatcacgaggtcaggagatcgagaccatcctggctaacacgatgaaaccccgtctctactataaatacaaaaaattagccaggcttggtggcgggcacctgtagtcccagctactcggaggctgaggcgggagaatggcatgaacctgggaggcggagcttgcagtgagctgagatggcgccactgcattccagcctgggtgactgagtgagactccgcctcaaaaaaaaaaaaaaaatacagttgattttgggcgggcgtggtggctcatgcctgtaatcccggcactatgggaggccgaggtgggtggatcacgaagtcaagagatcgagaccatcctggccaacgtggtgaaaccccgtatctactaaaaatacagaaattagccgggtgtggtgacacgcgcctgtagttgagctacttgggagtctgaggcaggagaatcagttgatcccaggatgcagaggttgcagtgagctgagatggcgccactgcactccagcctggcgacagagcaagactccatctcaaaaaaaaaaaggaaatacagttgattttggtaaatcttatataaggtgatttctccctgcttgtaggtgtgtgtgtgcacagatatcacacacacctcaaaagtaaaatgcttttagtgtctactgtcacattctaccctgtgcaagactccttgtttgcttttttgttttgagatggagtcttgctctgttgcccagactggagtgcagtggcacaatttcagctcactgcaacctccgcctcctgggttcaagcctcaagcctcttgagtagctgggagtacaggcttgagcatattaaaaagactgctttttaatatgtatataacatgtagtttattgaggaatgtggagtttatcctggttaagaaagtagtatttaccatcaaaattttggaaataaagatgttaaaatagatttccaagctggatacagtggctcacatgtgtaatcccagcactttgggaggccaaggcaggaggatcccaaggattgcttgagcccaggagtttgagaccagcctggacaacagagtgagactctgtctcacaaaaaagaaaaaaatgcatttccacattattcataccacagttttgccatattttcttttcagtttttagggtatcacgttcctttttttaagtcagaggtatcaatatatatatcctgttgtaatcttttttaagtcctataaatagattgctcttgtgttactggatatatgtaaacaattacagactaaactgatcgtgtgcatatataatgcaaaaaagtacacgtgaagatattcttatacaaggtagctcctgaattcaagtcaaccacatctgatattcagctgaaagactagtcatctgttctaactggaggaagtagtggctgtgttagactaaccaagaatccctgtagttcactcacagcctgtacactgtccttcacggtttaaggataattttctttatgccagtcatgtcttatgtggtggtatcaaagtctgactacccctacgaggtggctgtgctcagtggatacctgtctgggcatagaaaatgccagggcaggcaaaccagcatcagaagatggctaaggcaggagtggggcctatcctgttcacttccacactttggtctactttggtttttatgataaagcagggatagaggagaaaataacttagaattctgaaaaacttaaaagcggagaaacggtgacatttagtgacttactacatgtgagaaattggtacttttcctggattttgcctggacttttttctcccaaattagtatattctagtcatgcctaactatgctattctttgtctagatgaacaagagaactgggcaacccatgatccacatctacctggacaaggaaacaggaaagcccaaaggcgatgccacagtgtcctatgaagacccacccactgccaaggctgccgtggaatggtttgatggtgagatgtactcactggcattcttaatctccctggctatagaatatggcatgagggagaaacttgtgaaccataggagcaagaagaccttccatctcttcctgggggaggtagatggccggtctccctgcagtagtagtagcacccagccattgaccctggatttggagatccctttattttgaggcattagtattacaaatcaaccttgcttaaagtggcaaacacttcctaagcacagattatcagaaggtacagaaaacccttcaaaagaacatcttagccagtgtacatttgcatatagataaatatatatatttaaatgaggccttgacattaatggtgggatttcacttcagacaaaaccaacttgaaagcattgaatgacttggccatgtccagtggcttgcacctgtaatcccagcactttgggaggccaacatcggtgcattgcttgaatccaggggcttgagaccagcctggggaacatggcaaaaccctgtctctacaaaaaaaatacaaaaattagccaggtgttgtggcacactcctatacctatagtaccagccactcaggaggctgaggtgggaggatcacttgagcccggagagtttgaagctccagtgagctgagattgcaccactgcactccaacctgggcaacggagcaagactctgtctcaaagaaagtgtcaaataacaagtcctggttctgttttcttggtcatgcagtcagcttcccaccagcttattttcctccttatggtagacagtgttttttgcttgtgttgttttttttgagatggtctcactttgtcacccaggctggagtgcagtgacacaagccatctcagcttactgcaacctccacctcccaggttcaagccaatcttgtgcgtcagccactcgagtagctgctggactacaggcgcatgtcaccacgctgagcctaacttttgtattttttagtagagatggggtttcaccatgttggtcaggctgtaggaaggtttttaagtgtatttaagtatggcctttttctggccaggcacagtggctcttgcctataatcctaccacttcaggaggccaaggcaggaggattgtttgaaccaaggagttcactagcagcctgggcaacctagtgagacactgcctctacaaacaattttgtaaaattagtcgggcatggtgatgcgtgcctgtagtcccagctacttgggaggattgcttgagcaagtgagattgaaactgcagtgagctgtgccactgcactccagcccgggcaacagagtgagactcccatctcaaaaaaagcctttttctggccttgtcattaaagatcttagagaagattacaggcagacctaatgcatctgggagtggtcatttgatgatgatgtggagttggtgaacagggagtacaggggagtaattgatgttctgttgtcttgttccagggaaagattttcaagggagcaaacttaaagtctcccttgctcggaagaagcctccaatgaacagtatgcggggtggtctgccaccccgtgagggcagaggcatgccaccaccactccgtggaggtactttttctgagctcctatgttgcattaaaaggttttcagtacacttcatacccttgagaaacttgattattagagtgaagaaatataaaattgtgtgtagagtcaatactagactatcgagagctaacaatgaatgtttgttgggaataaaaggaagagaagaacatgggaggctggaagccactctgcctgtcaactccagactgccatttattcagctttggttgtgtctgtatagacatgcctattccttacagaattgtgggagttcagccaggtgcagtggctcacgcctgtaatcccagcactttgggaggctgaggtgggcggatcacctgaggtcaggagtttaagaccagcctggccaacgtggtgaaactccctctctactaaaaatacaaaaattagccgggtatggtggtgcatgcctgtaatcccagctactcgggaggctgaggcaggagaattgtttgaatctgggggggtggaggttgcagtgagcaaagatcgtgccactgcactccagcctgggcaacagtgtgagactccgtctccaaaaaaaaaaaaaaaaaattgtgggagctctgtttctgtagagcacgtggaacacgctcctcacagggaagggggctgatggcctgagccacacggaaacacgggacaggtgatggggaaatgacagcagtagtatctgtgggtttacttagtgatttttatttcctatagcaaatttggtgctacagagaaatgatttgctgtttcttgttgttcttgttgtaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgtatgtacttgtcttggcaaattgataccctacgagtgaagccacccttccctcaccccatccccactctagagtggattgctctgtctagaggaacagaatgatgaccctgatggctggttagggacactagtcagccattcactggacgcttcagagccttctgaagattgatttgacctgtcctgtgggtgcaatgctgcctgaggctgtgccctaaagcatgggtgtacatagatcctcttgatagtgagtgtgtacctgttcacacaccacctttccttgtttatcttccttagttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataagtaagtgctggtgaaaagcagctgtgggccgccaggcacagtaagaggacagcccttcccagcttggttggcgcaagtcctcatgtctctaggaagcttgtgatagtggttgggaggagccaggaaggggcacctgggggctctggaagggcttcctcaccccttcccattctaaccgattgggaggagccaggaaggggcacctgggggctctggaagggcttcctcaccccttcccattctaaccgaagggccctctttaccttgcagaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtcatccttctcggcctctgttccacagtcactgtgtgtctgctgggagcatgctcccaccccacccaggagaggggtgccttccaggtaaacggttggttcagggtttgtgtgaggggaaataagcggttgtgacatggaaacagactctggccctgatgcagcctctgagacccactagtgtccaaaggttcaaggggagatccaggtaagggaggcacaggaagaactggaaataactttgccttccatgggatcacggatcaggcactaggagcatctaaggggctgctccctcaggtgagggacgatccctctcaggcggactgggtcgggtcctctcatccccagcacttctgggcatgcattgtgtgcacctctgctgtttctttccctggtcatttcctgttctaatatgtgtttgactccctgcgtttggaaaaccctcccttaaccagccatcatccccttccctccatcaaaccatcttcctggccctttctacaggaagcacatggaaagagctttgtccacccctccctctctggaacccacttcattcttcacctgcactaaaacaagcagctctcagtcaccaaccacctctaatgttgcccaatcaatggtctttccttctctgttctcccatctccttcattgcttcctttttctcctatccctaaatgcaggaaggccccaaagctagcattgcgctcccctgagccgccacactgcctggctgtcctttccatactgtggctttagccctttctccctagggccaactcggcttgggtgcatgatgggtgtagagcagggcttgctcttgtcccgtcctgcctacaccccagttcagtaaacacacacctgccccaaaccttggagtcatccatgacccattctcaaaccccagcccccaacctagctctcttgcaaatccaggacggtgcaaatccacccacagcccccacctccataacgccccctcactgggttccctgcttctcccctcagtatctccagcccttcctcagaagccagaccaaggtttgtggggttttttgttgtttgagatggtcttgctctcaccaagactggagtacagtggtgcaatcacagcttcacctcctgagctgagtagctgggactacaggtgtagcacccagctaatttttttgatgtttttgtagagaccaggtctcactgttgcccaggctggtctcaacttgggctcaagtgatcatcccaccttgacctctcaaagtgctaggattacaggcgtaagccaccacacttggcccaaaccaacttgacacgggaggtcatctccagtctcaaaaccatttggtggctccaagcacgcttgccatgccccaaaagacctctgggaccccagctgccctgctctaccttgcacgccagtccagcactgttcctcaaggggccgaggacgctctcaccgcagccttggtgtgtcagagccaagatgcacacataacctaggaggcccaaactcgactagggcatcactgggtccctgcgtcgtgccaggcactgcgctaagtacctctgtgcgtttaattcctaataaccttcaaggcaggtaacataggacagccacacgtcagctgagatgggaagagagaggtcaagggaggacttgccattgagaggcctgaattgagctaagggtggtcgccctccaggccccgcacgctcaccctcccaccaacccactgtatacaggcacctgcttctgaaaaggatgggtgctctgacatgacccgcatgctgccagcactaagggaagacaagcagcctgctctggaagctgctactgcacaagcatctgtcagactctggcattgcataggctccccaggagtagccttatgtccctgcccgagaggggtttgtcactggcactaaatagccctggtagagatgtttacagcaggcaggtctatttttctcagcccaaagaaacttctggatgctctgggcacagattccctcaggcagcatggatgccaagcctgtctcaaagggcggcaggaagctggctggtgccagggcatgaaggaggtgggcagggcagagagcagagcaggtggagaaaaagcctagtctctacccacaccctggtcaaactccccaaaagcacctagactaaaagttgccaacacaaacttgaggtcccacgaggccacatggcacaggcctgggcaaaggtggcggggtccatggggagactgatctatgcccacagggagtggctcccctgctcgacggggaagagcacagggctgcagcaacagcagtaccagcagctgtggggctgaggactgtgcagtctgtgacagggacaacagctggccctcgtgctgtcccctcctaccccactcctgacagatctgctgggcgcagggccggcagtgaggacagtgtgatgcaggcaggttggaaagagcccacttgggttttccagttttgcgtctctcttgtgaagggcactggaggcagctcagggtcacctgtcccacagccagagcaggagctgaccagcaggtgtccttggagctgagcccacacctggacacagcagccggaagcctcctgcgagtccctcacttagcctgggctgtgctcagagcctcagtccagactggagaatttggagttctaatccaaccagtgccagagcttcctggagctgcccggtagcagggatgtaggccacaatgagagttttgccacagccatcatctgacctctagctgcaaccaaggccaagcaggctgctggctggcacccagcagtgggcgcaagaaactggctatgtgccctctggccaaaggccagaaggagcccacatgggagccacagcattctgtgcatagaggtgggtggcctcaagggtccgtgcagatgggctcagggtctctatagcccaaacctcctgtccctccagcagtttctgtggtttctcttggtcctgcaaggaacaagggagaccatgtagaggctgaggctttcccagaggtggccccacaggccctgggccaccacacgacagagggggtcaaagctacggtctaccatgccctgggccaggggtctgaccccccagtgaggtctgcatcatagcagctacatgtcctagaatcaggtgggaggctgtggtctagaacaggcctcttatcacaagccacagctcatgggagagaaggaggaaggaatctcgtgtgtgtgtgtgtgtgtgtgtgtgtgtgtgtgtgtgtgtgtgtgtgacggagtctcgctctgtcgcccagactggagtgcagtggcgcaatctctgatctctgctcactgcaagctccgcctctcgggctcacgccattctcctgcctcagcctccagagtagctgggactacaggcacccgccaccacacccagagaattttttgtatttttagtggagacggggtttcaccgtgttaaccaggatggtctcgatctcccgacctcatgatccacccgcctcggcctcccaaagtgccgggattacaggcgtgagctactgcgcccagcagaaggaatttctttataatccctcctccccagagaagtggatatgctgagccaggccacactgagctgggtagtggcattatttttcacaaccccatgatgtaactactactactgtcccattctgcagatggtgccactgaggctcagggagcttcaccatcccacccaatgaccaatgacagagcctgggttccgtccaacttcacccatgtccaaaaccccaaaatgcagcaaggtaggtataagcaggagtcaaattcctgcacagctgctggctacacatatcccatgccttctctgggcctcagtttccccaaattgtaaaatgagaacacctaagagtatcatagctcatcggggtattttgaagatgaaactgttaaatgtccacaccctgattcacccccaccccaaacctgcaaccctcctccacctccagcagcccttccctccccaggtgttagcacctccgccctcccagtgctcagccctgggagttgtcctggattccgtcctcacactcaaccaatccaccagcacatcagctctcccctcacaatatggccagaatccagcgccctctcaccacctggtttcctctgaggctccagctcctgccctggcccaccacagcagccccagggaatgtttttttttttttgagacggagtctcgctctgtcgcccaggctggagtgcagtggcacgatctgggctcactgcaagctccgcctcccaggttcacaccattctccttctcctgcctcagcctgccaagtagctgggactacaggtgcccgccaccacgcctggctaatttttttgtatttttttagtagagacagggtttcaccatgttagccaggatggtctcgatttcccgatctcgtgatccgcacgcctcggcctctcaaagtgctgggattacaggcgtgagccgccgcgcccggccgggaatgttaagacctaagccaaccacccctgctctaaatcactgcatggctcccatgtccctcaaaagagacacggcccccaaggccctgcttaaccggccctggggtctctctaatctctctacctcctccctcacccacctccctgcactccagcctcagccacctccccagtcttcttgagcacgccggacacatgcccaccatggggcctttgcactggccgttccctctccctctccagatatccccgaccttcctccctcacttcctttcctgatgagggattttaaattgcagccccctcacacccacaccctcacccggctccatccctgtcttctctgcacctcatccctgtctctgccctggggctgcctccctgccagacttggacaacaggccctgagagctggctctgcttggttccctgctgttttgctgttgatttccagtgcccaaagagacccagcacacagtaggtgccacgcaggtgtcagccttgaggattgctagttactgccttcctcactggaggaagtgccatggggggcgctgaggtgagaaaacgcctttgaaaaggtcacacaggccaggcaagtggctcacacctgtaatcccagccctttgggaggtggaggcgggcagatcaccttaggtcaggagttcgagaccaacctggccaacatggtgaacttgtctctactaaaaatacaaaaagccgggcgtggtggcaggtatcagtaatcccagctactcgggaggctgaggcaggagaatcgcttgaaccccggaggtagaggttgcaatgagcccagatccagccactgtactccagcctgagcgacagagcgagacaaaaaaaaaaaaaaaaaaaaaaaggaagaaaataaaaaagaaaaggtcacaaggactctctgggatgcctgtgaatgcctggcaccaagaggcctggctcacaggtgctcaaccaatgctgctgatccgtggatgagggcgtccccataatcgtcatgttcaaatcctggctccaccagctgctctcctgactgtgccccagttgggcatgagtgtccttcacagaggtgacacaccagttcattcaggtcaagggcgcagagcagtcctggcagcacacagtaggagatttattggagctctgagcctggctgtggttggcggcttccctgcaggcctgccccacccgtgtagcatggctgccgcccagacccgcccgacgtcccgcccagcccagccggcagcagcagggggcaggatttcccgctgatcccggcggtccgtcctctgcagtttaaaaagagcccagcggggcttaaccctcccgcgtccggccggcctccgatgccccccgtcccctgttctgtgcggaactccggctttggccatctgcctacttctctgagcttcagtatcctcatctgtaaaaccggttcccctcatttcagggtcaaaaatgagcattcagtgagcacaaggagccctcagtcgccaggggcatcctccccctccccgcggcggtgccgtttatctggccaggggaggtccacccgggaggaggtgactttgcagcctccagccgctatcgcttcctgccttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccaggtgagcgcggagacccccagcactccctgcctggtgcgcatggacgggggtggggaggcggggcgggaagcggcgtcctcggcctctgttccccggggctgtgtgaccttgggcggccccgcaccctctctgggcccagagccccagcaccggcagggcctgcggaggccgctctgagtcctggccccgcaggcaccggcctggagcgctggggaggcttcttggaggaggcggggcctggccctggccccggatcgccgagaccggccacgctgcgccgcctggacgccgggctcctccacccacagctctgcgaccttcacgagctcgaccctttctgcgcctcagtttcctcatctataaaatggagataatgcctccgcgcgctgagcccgagcgcggtcgtgctgttacactattgctgctgctatgtcgttaatgacggcacagcccttatggaaggggggccaaggaaggcacggggaccttcccgcaggacatggggtgggcaccagccctaagccatgcacataacccactctgaggtcaggacctgggttcctttcgtgtccactgggggccttagccgttgtcttcacttctctaggtcccagcccttcacaatgggcgcgcctccctgcctgagagggaggccccagccaagccccagtttccaccgcaaaaagccacacagcaaacacttaatggaccctaaatttataaaaattatcccatagagtcctatgaggcagggaatgttactgtacccatttcgcagatgaggaaacttggggcaccgacatttcccagagccaacatgtaaaccaggcatttggcctgagtgacagactggtgcaggtggccagcagcttaatttgtactgagcgcttactgggtccccacagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagtcccccagcaccaggtgccagggacccgacagcacagccagtgcctgcaatctgtccctgaacctcccagggtccaccctgctatctgcagaacagtctgccccacaaaaagagtgcacatgttgagcaccaaaccgaggaatgtatacctgaccccaaggaaatgggtagcccacagagagggaggtgccggggagatgacgcagcccagccgggcctgggacaggatgcgggctcctggcacgatcttccctcactttgtgtgctaactgtgcctcaactgagcttgtgcattccttcttctggggggccgcatgatcggggcgcctcctctgtgccctccctgcagtcagtcttaggcagatgtacccacaacctcatggaggctcgaggttgagcgggtgctgtgatgctcggttgagacgaggcatggaaaaacctgggcaaggtgcctggcacacagtaggtgccccagggggctctgcaggtctccccactccccaggcacccctgggaagcctagctgggttgctgctgttgctgggagcagggatcctgtttggaattacaggattcgttctactctaagcataggcgttgctgggccctgcccccaagtctctcctctcccaggatctgggtggcccctgccacccctgagggctggaccaagagtttccttcttatcagaaggtcaggactacaatgtgcctgcctgggaggcagatagcggatggcagtgggcagagcctggggccccaccccctgtcctggaccagggtcactcaaggccccacctgcttatttcctctggcggcaccactgccgctgtgggcggggaggcgggcagggctgcccacatagccagcttggcagcgctctggctctggtggggggctgtatgtggtgcgtgctcacccggccagtggtctgtgtgtgcatgtgtccgatgtgtctgtggtacgcctccacatcagtgcccacccaggggcatggggccccctgcacctgtgtcctgtagcctgcctggccttcctgtgggccccagccttcttgtctgagaagtgggtgaagcgggagtgaggacgggctctgggccttccccaggtctaggggctgtgggatgttcgtcaccgggtctcagaccatggcctgaccacagtcccatcatctcatcctgggcagctccctggacccagagagccaagaaaggggagccggtgaaaggtcatgtgtgggccgggcgtggtggctcgcacctgtaatccagcaatttgggaggccgaggcgggtggaactcctgagcctgaccaacatggagaaaccccatctctactaaaaatacaaaattagccgggagtggtggtgcatgcctgtaatcccagccactcaggaggctgaggcaggagaattgcttgaacctggaaggcggaggttgcggtgagacgagatcgtgctattgcactccagcctgggcaacaagagcaaaactccaactcaaaaaaaaaaaaaaataaaaaaaaataaaaaaaataaaagaaaggtcacgtgtggaagctgtaccccatccggggcaacactgcctccatccacttacccggaaagcctgacttcctcctgaccctggaatggctgacattaagccccaggaggaggacttgacctctgacccctaccctctctctctggcctcaggtgagggagattctgggccgctgcacctgccctgaccagtttcccatgatcaaggtctcagaggggaagtaccgtgtgggggactcgagcctgctcatctttgtgcgggtaagggcctggggccgccccagcgggcagcagccaaggtggtgggctgcggggcgcccggggcacagccgtgacctgcccacacctgcaggtgctgaggagccacgtgatggtgcgagtgggtggtggctgggacacgctggagcattacctggacaagcacgacccgtgccgctgctcctccactggtcagtgccagggtggggctggggctggacgggcaggggacttgcttctgtggctctgtccctcacatgctgcctgtcctctctccccgcagctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagccacctgtctgtttcttggggactccaccttggggccattcagaccctttcgaggaccctggagttaactgcctggaggccaagcctggcaactctgacctctaggcttaaggcgttatcccgcccagcccagaaatcccaggcgcactcaaattattttcccttttattatcccgtggtaggtgtggcataaagaatatgtccagtgaagctccaggagcaggctgcgtgtttccagtcaagttcatagccaagtcctttccatccaatgggattgtgacccattgaggtcccagaaaggactggtcatctccaatggagcttgggacctggttgggtccaatgaggttcaaaagggggccagtcgcttaggagactgggttggagctttcctcatccaatcagggcggagacttccctgtccagtcccagtgaagttgggcgatcccgtccaatccaggtccctgattgtcccagtcacaaggtggggcccatggatggcactgtccgatcgggtcacatgaggctgcagcgcgcgggatgcagcgccccctgcaggcgcagggccgggtgtgcagggcgcgcgcgcaccagagcgcagcgcagcagctcgcggaagagacgcagcacgtgccagttgtacttggcggagcactcgaggtagccgcagcgccagcccctgcgcactagggcggccagcgcgcgccgcggtccgaagcgcagccgctgcctgtcccgcttgttgcctaccacgaggatgggcgcttcgggcgcgcccgccggcctgggggccgaatggagatgagagacgcggggaccccacggccggagaattcccccagtgggtatacacacgcaggcgcattcccttcctacggccagagacaccgccccccccgccgccccaacgaaaccccaggcccatgtgggccaaagagcacatacagcttaagaccttcccacgggcgaaggcctaagacccggcccacgacgttgggagaccctacacactctcctcaggcaaaggccctgccagacctgtcctagctccccaccgccagaactgccgggcccctacctggtctccgcgatgcgctgccgcagggccttcacgtagtcgaaactgtccgggctgcagatgtcgtagacgagcacgaaggcgtccgtgtcctgcaagctccagtccttagcgtctggccactcctggggacaggaggccagggtttgcggaagcctcctttccactcttccgctctcgaaccctctgcaggggcctggacgctaatcctcaggccaacatcacccccatacagacctctgtgcccctcccccaagctttccgggccgtctcctcatgaccaccagggtaaaattttccaaatcgtgcctggagcctgtcagccagcctccttcatccttggtctcccctctgtttaccccgaatcttcctcttttcagctttccccaactcggctcaggccgctctcctccctagatgctctcggtgcttaccacggcctctaagactaattccaaagcccttggcccgagtcccgtggtccaccacgcccccagattgtcagctgtaaccgtttatgaccgtagcgtaagcacctgctggtctttccacctggtatgtttttgccacttcctttactcagaacttcactcggtcttccaggttcagctcaaatgccactccctccaggaagccctgcttaatcctgcctgctctttcctcttcactgctctagggtcggaggtctgtcctttactttgcacaaattactaaacgagtcttcgctccaggggacaaaaatgatagggcagagaatgaacccctccaccagcccccgtagaaagtacacccctgctcctgaccccagtctctcccattgtagctctgctcaaggccccaaacacaaaacgccacactctcgggaaggcaccgttatgcaccaccaagagctgctccacacccccagccgaggcaggcaaaggtggaggcgctcacaggagcaagggaacgcccctgggcaaaatcgcccggcctccagcctgggcttgggcgtctccaggtcggcgggaagggctgaaacgcaagtatcccaggacgcacacacatccctccatcccggagcacagccaggcgcccgaggcctccacgcggacacgcacgtgtgcaccgagcacgcacacccctcacactgtcacacgcccctgcccgctcctcgagccgctacctccggacccccggggctcgagccggggccagcgacgtcgccgtcgcggatgctcaagtcgtagacggcgccgtcgagcagcaccgcgggtcggtagaggcgcggcccgtccgtgggccggtggcgctcggggtagtcaccgaacaggaactggcggatgatggccgtcttgcccacgcccggggcgcctagaacggccacccgcaggctaccccccatggccggccggcgctgtcgctccccgcgctggaaagcctcatgggccggcgccgcaccgtgcgcccccaggccgtgcgccccgcgcgccctgcccggtgcgccacggccccgtcgcgcttctcgtcgcccctcggagcaccgagaccggagagggcaggcccgaggcaggagctggcggcgggagggcagacagacagccgagtgggcagacaggtggcgggcgcgcgagcggctcgggcgggtgccgaagctcgagagagagcagagccggagcggcgctcagacaccgcctccgccccgcagcgccaacccaggcgccggcggacgcgcgaggcgccgaagtccgcccctctcgcggcgcgggtcccgcagcggtgcggggcgcggggggcagcgctgcctcccggagcctctgtgcctctatccttctctcgcttccgcgcctggagtcgccgccccagccgccggcgcgagcgagcggggcctcccggaggcggcgatgaggtaaccgcccgcccctcccaccttcccccaccgcccaggacgcccctcccaggaagggtcgcaggaaggtgactgggggacagagatcccggagagggcctaccccttccttacctcctccgcgtgtcccgctcctctcacccgctccaaaatagaagccccttcccacccactgccgcggccgctcttccaaacactgctcgcccccacgctggctcccgacaagccccggcccccggagtcaggccgcccggggtccgaattggggggggcggctgtgtgaccttgggcgaatcgccgcactgcgctgggtctgcgctccgcatccatcacaggcagactcctcaagaggctccaaccttttcttgagagcctactatgtgccaggcccattacctacgtgattctcgaacctacagcctcagcctggcatcgctggttgagagaagaggaaacaggcccgagaggggaatctgcaaggttagaagggcagtgggggggcccttgaagtctcctttgaagtccctcctaccttcctcctgcccacgggggtaaatggcccacactagacaatattcaaacagccgtcctcgaggggaagtggggacagagggtgccgagaccacagcagcttagccccagatccctgtcccagcaaggctggaggtgactaaataaagatccagaaattggcccactccacctccatcactactaaggtcacctttcctgcgtgagttgcaacccgtagcgcccctcaaagggatgcaacctccaaaacaggcgcccagagcccaagttccccctccctcgagctagtggagaagctcctgccccatcacagcttggaaagcctgggttagcccagcccccccatcctccgcctctgctctcctccccgctgtgtgggggctcccacgtctctgacctgcacatggcaatgctcaagaaatggcggcaatgctcaagaaatggccgcaatgcacagatctctgcactgactaaggagttcatttatttatcccctcaacaaatattccaaatcttattgcttgtcaggaggctgagatagatttaaaaaacagaaaacaggaaaaaaaaaaaaagttctgctttgggagagaaggttctagaacacatgggatctagggactgtcaaagcacagacaatgtgcccacaccagcccaggggaagtagaggagctaaatcctgaagggggaggaggcacatcctccagggagcctgtataatgacaaccagaaagtgtctccagaacaatggctgtgctttcatcctcccatgctagatcgggggctggggtccgctttcactcctctcctcagccactaggaagctcagaaccacctctgtctagtgttccaggtcttctagctcagtgagtggggactgctggcttcatctttctttcctaccatgatttttcccttcacttgatgtcctctttcacgttgtaacttttcagacttctgggttttgttgtttgagacaaggtcttgctctgtcacccaagctggagtgcagtggtgtgatcttagctcactgcatcctcaacctcctgggttcaagtgatcctccttgcctcagtctctcaaatagctgggactgcaggtgtgtactacgacatccagctgatttatttttattttttgtagaggtggaatctcactatgttgcccaggctggtcttgaactcctggcttaagcaatcctccctcctcagcctccaaaagtgcgaggattacaggcgtgagccaccacatctggccaaacttctgggtttttgacttttcaggcttctgggttttgtgagctgcttcaattccttcggggaacaaggcaaggagtaaataacaaggcactcagcaacacaacaacaaaacccagaagtctgaaaagctgacaccaggacggtcttttgtttgtttgttttgagatggagtctcggtctgtcacccaggctggagtgcagtggtgcgatcttggctcactgcaacctccacctcctgggttcaagcaattctcctgtctcagcctctagagtagctgggactacaggcacatgccaccatgcccggctaatttttgtgttttttagtagagacggggtttcaccatattggtcaggctggtctcgaactgctgacctcaggtgatccacccgcctcagcctcccaaagtgctggggtttcaggcatgagccactgcgcccggccaggacggtcttttttaaggtgttctcaatgctaggcgcactcccgcccacccctgggtattctttctctgaaaaactttccttgcttctccttccgacactgcaaacagagctgtgtgtgaggcgtctctggctcccagtatgtgtttttggatggcgaggggaaggggcactgtggactgggaacgtcctgaggctcccatgaagccctgcaaacgtgccatgttccctaggagactctcacagcagcgttcctagcagcagtgcccatttatcaagggcctgcgatgtgccaagcctgacccacagcctcatgctcactaaggctccctgggacgccatgattgggccacagttgcctagcaggaaaatggcagcacaggggccggaacccaggcccttgggctccagagcctggctgagaagcctggcttcatctggacccagagggttctcaggaagtactcaactgaagctcagcccccagtgaccactcagccccctgtcgggagggacttggggaggcctctaggtcccgtggagccccccatccacaggggctgaaatgagctctaatgggagtgtgcagccctgtgccaggcttcctaaagaccagcaggctggggggctgaagctgcctgtctgcctgggatgtggatttcagggttctctcatcagtcccctcattccttccccaaggaaaggctgtaggcctcctgcctgctgcccccctccaatccctattccccaggggcctcctgggcactccttgaatgcccctatccagggctccagggaccacctgccaactatgcatgcatcttctccttcagcagaggggactggcactaggcacacagtggccaaggtggtcctgcctaccctctgtggcagggagaaagagacagacatgcagctaggcagggacgggtgaagacaggagctctgggctggttcaggcctggggagatgaggaggcctagggtaagcaccagtccagcgggagttgaggggcttatactgagccctgaaggatcaagccacagatagtggggagggctgggcaggggcaggcaccaggtggggaattctgctttccccagttcattgcccacaggctcctaacaccagctacctggccttcacccatgtgtttcttcccaactgggcctgattccagcccatccctgaagtcaggcacccaagactgcatccagctcccagggggtgttagttctggactcctttgctaggccacaccagtcaccactaattatggtctgtcctggccacgaatcatggctccacaccaccagtaactcacctcctggacccacgaatggagggatcctccacagctcacatgcttggggtgtagtgggtccttggacatcctcatgatgactcccactaatcacagccaggcagcctcttgagggctgggctggtcttccagccatcaggacacaaggaggctgggcagggctgggcttccaagcctctgaaagtttcttttcttgggtttgaaacctccttccagggctgtgtcatctgtgcaagttacttaaattctctgcaccttgggctgggtgcagtggctgacgcctgtaattccagcaccttggggaggcccaggcgggaggatcgcttgggcccaggagttccagaccagcctgggcaacacagtgagaccccgactctagaaaaaattttaaaaattggctgggtgcagtggctcacgcctgtaatcccagcattttgggaggccgaggcaggggaatcacgaggtcaggcatttgagaccagcctggccaacatggtgaaaccccatctctattaaaaatataaaaattagccaggcatggtggcgggggcctgtagtcccagctactctggaggctgaggcaggagagtcacttgaacccgggaggcagaggttgcagtgagccgagattgcgccactgcactccagcctgggtgacagagcgagactccgtctcaaaaaaaaaaaaaaaaaaaaattaaaaaactagctgggtgctgtaatcccagcacttcgggaggctgaggcaggtggatcacgaggtcaggagatacagatcatcctggctaacatggtgaaaccacgtctctactaaaaaatacaaaaaattagtcgggcatggtggtgggcgcctgtagtcccagttactcgggaggctgaggcaggagaatggcgtgaacccgggaggcagaggttgcagtgagccaagatcgcaccactgcactccagcctgggcgacagagcaagactctgtctcaaaaaaaaaaaaaaaaaattagctaggcgtggtggtgcacacctgtggtcccagctactcaggaagctgaggtgggaggattgcttgagccctggaggtcgaggctacagtaagccatgatcacaccactgtacagcagcctgggtgacagagcaagaccctgtctcgaaaaaacaaaaaacgaacaaacaaaaaaacacctctgcttctcagcttccttctctgtgaaagaaatattaattttcttgacttcactgagctgtgggatgcaatgagatgatacaaagagaaaaacaagacaacttgttaagtttggggagacaaaattggtacatataaaacttccatttttctatgtaaatggctacaaatacaaaacataatggaggcatatgtgtgtatacgtgggtaaacaggcacacatatattttctagctctgtcagcagagggcctggaagaagtgacacccagtggcagtgaatacatccagcatctagctcttggtttctttcctttttattatttatttatttttgaaacagggtctcattctgttgtccaggctggaatgcacaggcacaaacatggctcactgcagcctggacctccagggctcaagcaatcctcccactttagcctccctgagtagctgggaccacaggcataggccaccacacccggctaaatttttgcatttctttgtagaaacagggttttgctggtctcaaactcctgggctccagcaatcagcctgcctgggcctcccaaagtgctgggattacaggtgtgagtcaccacgcctggccgctcttggtttctgttttttctttttttcttttttgagatggagtctcgctctgttgcccaggctggagtgcagaggcgtgatctcggctcactacaacctcggcctcccaggttgaagcaattctcctgtctcagcctcctgagtagctgggactacaaggcgcctgccaccacgccccgctaatttttgtatttttaatagagactgggtttcaccttgttggtcaggctggtctcgaactcctgacctcaggtgatccacccacctcgccctcccaaagggccgggattaccggcatgagccatcgcgcccagcctggctgctcctggtttctaatatggttttccagtgaaaggaaccacgctccttggagagatgactgtttctagggttggcgcaggaccagtacaagatgatcctggagccacttatggtggcagaaaggagggaagtgctcaaaaacgaggatggtggtatgtcacagggacataggaaccttccagaaggagctcccagtggccaaacctgcaacaattcaagcaacaaagtaaataatgttgtatgggattaagcccagattataaaataaatatccatgagtccaaactgatataaatgactgagtaaataaatgaataaatgtgatcattcagcttgcttgctcccaggggaaaaaaatacatctgagaagaaaccagtcttgcttaaagaagaattccaaacacttccatgtagctactcccccaccccgctttccaaagtgtaggctacatttagttatttgcttccaaagaatagagtacataaaggaggatggccgggcacggtggctcatgcctgtaatcccaacactctgggaggccaaggttggtgaatcacttgagcccaggagttcagtaccagcctgggcaacatagtgagacctcctctctactaaaaataataataaaaaaaatattgaatgaaattagccaggtgtgatggtgtgtgactgtagtcccagctacttgggaggctgaggtgggaggatcaactgagctccagaagtcaaggctgcagtgagctgtgtttatgcctctgcactccagcctggaggacagaatgagaccctgtcttaaaaaaataaataaaataaaaaataaagaggggaaaagtaacttcacggtagagaaaactgcaaacatgcaaacattatcttggctaggtgatccaggcaaacgtgaggtgacaagaaatgtcgatagcatgtcaccctgattatgatgcgtaggaaaagtcacctgtgtggtattctttctaaaaaaccataatcccaggctgaccatgagaaaaacacccaacaaacccaaactgagggactttctacagaatacccaagcaggactccttgaaaacagtcaaggtcatgaaacaccaagaatagctgagaaactctcacagatataaggaggcatgagtaccacgtggaatgtgggattctggaacagaaagaggacacgagcgcacaactagtgaaacacgaataaaaaaccgaaatgggcggccaggcatgatggctcatgcctgtaatcccagcactttgggaggctgaggcaggcagatcacttgaggtcaggtgtttgagaccagcctggccaatatggtgaaaccccgtctctactaaaaatacaaaaattggctgggcacagtggcgcatgcctgtaatcccagctacttgggaggctgaggcaggagaatcacttgaaccagggagtcggaggttgcagtgagctgagatcgtgccactgcactccagcctggcaacaaagggaggctccgtctgaaaaaaaaaaaaaaaaaaaaaagaacttttacatgaagaaaacttaaaatattacagagacataaaagaaaacctgaatcaatgggaaagcatctactcctgttctttacatataaagatccaatattgttattgacatcataacaaggccattctccataaataaacatttgatgtgatccaaatgatacgatcaatttttttttaaggacaaactagttctaaagttcaaatagaatgaaatgggaataagagggtacaagaagttatcaaaacatggctgggagctgtggctcacacttgtaatcccaatgacttgagaggctgaggcaggaggatcgcttgagcccaggtgttcgaggctgcagtgagctatgatcatgccactgcactccagcctgggtgacagagtgagaccctgactcaaaaaataaaaaatgattgggcatggtggctcatgcctgtaatcccagcactttgggaggccaacgcgggtggatcacttgagttcaggagttcgagaccagcctgggccacgtgggggaaccctatctctacaaaaaccacaaaaattaggtgtggtagctctcacctgtagccccagctatttgggagactgaggcaggaggattgcttgagcctgggaggtggaagttgcagtgagctcagatcacaccactgcacaacagcctgggtgacaggagtgagaccctgtctcaaaaataataaatgaataaaaataaaaataaaagttatcaaaacatgaatagacaaattatcttgtatagaacagagtccagaaaaacacccagatatatgtggaaatttagaatatgataaaaatggcatttcaaatctgtggggaaaagatgaattattcagtaaatggtgtggagacaagtggggaaccatctggggaaaaagggaagttggatccctacctcattcctacagaaagcccagatggaacaggattgaaatgcaaaaatgaagagcagacaagtactagaaagaaaaaattaaaagaaaattacatcttaaaaagcccaatttcagcatggaaaagtaaaaagcagtaacaaaatagggaggaataatggtaaatcagtaagaaaaggatcaataatcagatagaaaaatggcagaaaatgtgaagacagctcacagaaagggacatacaagtggctcaaaaacacatgcaaagaggcacattgaaaacatgggaagggccaggcgcgatggctcatgcctgtaatcctagcattttgggaagctgaggcaggcaggttattgagcccaggagtttgagaccagcctgggcaacacggcaagaccgtctacaaaaacatacaaaaatttacttggtgtggtggtgcgcatttgtagtcccagctactcaggaggctgaggtgggaggatcacttgagcctgggaggttaagactgcagtgagtggtaatcacatcactgcactccagcctgggcaacagagaccctgtcacaaaaaaaaagaaaaaaaaaagggaaagaaaagaagaagagaaaaaaggccaggtgcgatggcttacgcctgtaatcccaacaatttgggaggccaaggagggcggatcacctgaggtcaggagttcaagaccagcctagccaacatggtgaaaccccatctctaataaaaatacaaaaaataattagccgggtatggtggtgtgctcctgtaatcccggctacttgggaggctgaggcaggagaatcacttgggtctgggaggcggaggttgcagtgagctgagattacaccactgcactccagcctgggcgacagagcaaggctctgtctcaaaaaaaaaaaaaaaaaaaaaaaaaaaaaggcagctgggtgcagtggctcacgtctgtaatcccagaactttaggaggcagaggcgggcagatcacctgaggtcaggagttcaagaccagcctggccaacatggcgaaaatctgtctctactaaaaatacaaaaattagccaagcgtggtggcgggcgcctgtaatcccagctacttgggaggctaaggcaggaggaacacttgagcctgggaggcagaggttgcagtgagctgagatcataccattgaacgccagcctgggaggcagaggttgcagtgagctgagatcataccactgaacgccagcctgggcgtcagagtgagactccatctcaaaaaagaaataaaaatttaaaaatgaaaaaataaaaaaaaggcatgaggacactctctgtaatgggctaataatggaaaaacctctgcgatataagcccaacatgtattccgtgctactatttccacacaagaagggaaaaaaatccaattaggcactgccaagtctctttggataattacgtggtttcctttggggaggaaaatgagggaaaggggtaggtttttacatctgtcttgtctttagattttgagccatgtgaatgtgttaccttttcaaaacaagaactaaaatagaaaatgcatcttgggtataccctctggttcagcagttccggggctagatcctacagctacatccctgcccaggcaggagggtgtatgtgggaagtattcgctgcagcattgcttagggtgcagaaacagcctgaatgccccgcagcagggactggctaacggtggcccattcacacaaggaagcctgaggcggtctgctcctactgatagggaaagagctccagaaacgactgtcaggtcagagaagcgatgtgctagcagtgtctaggtaggccatcattcgtttagtaaaactctatatggatttgcttatacacatgtgcagaatatccctggaggaaaatcaaaatctagtgacaatgtctgccttcaagggaggaaaattaaggactgaggatggggtgggagggagaactttattctctggctggctgacctcaccatggtcctgaattacttgctccacaaaaatgaacgcaaaccactagctgaaaattaaacaacgtaaaaccaggtcccgcaacagccttggcagtgtctggtgcacaggggagcccatcggcccttgggtatgtgttggaccctccagaaataactggttgctgttgttggatttcctgattggctgggaaggttcaagacacttgggaatcttcccaagaaaagtctgggaagttccccaagctgcgggatgccaaggcctccaagaggcgagacggggaggcctgagcgtgtcaggaccaggaagtgccacatgagcaggagggaggcggcctgtgatgaccctcagaggtgagggagggacagggaagctgaagggcacagactggctatgccctgaggtactcttcctaaaggcaggggcccaaagtagcatcctgtgtgtctattctcctgatgcagtagtgtgggggactgggagcatgaaggccctccctgcctcagtttccctgcatgtaaactaagccgcattatatgcttagtccagtatatgctgggtcgccttatgctgagcactgtgggggtgaaagaggggcccaactgtagtgaggcaccgctcacaatcacctgaggcttgagcagactcattcaaacacaaggtgtctagggatggtcctcctttcttgccagctctcctcacccgggtggcttgtcctgggcctccggtggggacagcgatcccacacttgcactcttccgaccttgcaatggaggggtggggaggtgaagtgccaagctccctgaatggctgagctggcaggccatgggcgtggtggcccgtgcagctgcttcccaggcagagtgcgaaggtattgggctcaggggaggcagacgacacggcagggtgagagtccctctcattaagggctcaccaacctctagttccatggcagggcagggactccagatgcatttgggcagagactctcaggcgaggcaagaaccagggttgcacagtcaagggccttggttggttctggactctttggaggggccacagctgggcacacagctcgagcccttgaccctggggtccccagggcagcacagtgacaccacagaggtcagaggtggggcagtggagggccaggtgcccctgtgatgccctgcaagagggcaggctgtctcacccagcttccagcagccaggaaggcagcggtgtgtgtgaggtgggcagcatgtggggggactaagtgcagacagaacacgagggagcggctggagctgaaacaggctgagggacacctgggctgctcctccctcagaagcaggctgaggcccaccagccaggaggcagctcagccgatgaagccctgcccagggtctggccaccctcactgggagccaggccagtgccaggactggggccacacaaggtgtcctcggtggcggctggcctggtccacacgcccaccccctctcccacggctgcccctgatcaggggatctcccacggcccctggagcctcccagatggcagggagctggggaaaaccacaaggggagcccagccttctggccagcatcacaaggcgaggcattgtcagctctgggggaggtgggatcaatggcaggagaggggtcagggacagcagcaggccgcagcagtcagtttgccaaggataggatggagggaaggcgctgtcctcagagtgccacgggaggggctgctgccgcacataccactggagcctttgaccctggggtccctgcagcccgggactcctgcccagaagagcctcgggcctgacacactggctggggacacacttgatgtcatcatttttattcattttctctttctgaaaataagagtaaacatacaatatatattttctgatgatatatattagatctagttaccgtagggtcagaaaaccatccccaaccactcggaggcagctttcaatcctgacattcggtggaggggaaaaaagtgtccgtgattgccaaaagccgaatctttctttattattacacagcagtaacaggaaaacctaatgctctgtcagacacaactgaaacctgggaggccaggaggagggcagcagacactacagagaaaccccgaagaaacccaaacaggaggcgcacccgcttacccagccccatctctcggcccagtctttgtggcaggaggcctgggctcagaggcgacactgaggaatgtatcacaggcagtgaccacccttggggcagaagtggggagttggggatagtgcagctgccagtcggtggggagcccgagacaggggctctgggagcttctgcctggtcttgaccatgtgggtcagcactcgggaggctgtggcccaactggcacagctgcagggcaccagcctggtggttgcaagtgggtggtgcaggccctgggctcctcccagcctagctctgcccctctgccggcacctacagctccttgagccccaggccctaagtgagcagctctcctggtaccaaggggaacccctccctgcacacccaggccaggttggcagggtccatcccatgagaggtggcagtggagggccctttaacaccaaccggagagaccaaggagccaggggctgccggggctgtgagccggaggggcaagctccacactcacccttcaggcacagcttctgtggctgctctggctctgtttcctttggtccccacctcacttaaccccacatcacagccacaggagcaggggtgtcccagagcacgggagtgcactgcgctctcaccccaggagggggtggtgccctaccccagggatcgggtgggttctgccatcaggaccagggagcccactgagtggcctggagccccgcctggtccctcctgcgaggaggaagatgtgctgcccccgaggggcctcctcgatggggcgggcagaaggctggggtgggcgctggccggggtctcagttcttgaggatggtctcgtaggcctggtacacgtgctgggacacctctggtgctcgacacttcagggacagctgcaggggagagaggggtcgggggaaagagcgctcatccctggggttcctctcaggaaggaaaggggtggggaagagagcaggaaccaatgggacagcgtggagtgcacacagcctggcggcagctgcgcctggcacagatgtgaggtaaagcggagggggcggctgtcgcagccagccgggtgtggaccaaatatacttgcagcccacacacctgctgtcagcccagtcaccagagccctgctggcgagcagtgtgagtcacgagccggaggctgccagggagtgcccggcccccaccctgagggctgcccggccccccagagtccctgaaggtctggggtcctcaggactgaagcctgacagaaaatcccgagggggtgcggagggctgggagggagcctggaggggtgctgggctcattcctggtttcctgcgtaggaagcaggcacggtagagactttgcctccgctctggggcctgagcttgagatcacaggcagaggagagaggagcccccacccatccactctaaagcactggttctgcagggtgcagttaggaagtgggaacaatggagttccgcaggtcagcagcagcccacgggccctccaggtctcctaggaaggactctgtgcacactgtgaatgtgtggaagtggggtgtcagcacctcaatcagggccacctggctgaagccccccgggtgaggtgaggccaagagatgaggtgcagacaggagacatggggtgcatgggggccatgacaggagacaagactggggagggcggacggggaaagagaaagcgatctgctaacctctaagtcctgcaccacgggaaccagcagggaaggtgacatgcagcaaccaaacacagggagacggaagttaccaccaccgaagccacgccacagccccccaccgaccagcactgccagcaggacccaggaggggcagtgtctggagggccatgcctgccagagactcaggggtgtgggggagaagcagagtttggggctgtccggggccctggaacagcggtgcaggcctccaggacaactgtgtgccccagggaagccattctctaacaggtctacctcaaaggctgggaggttcaggctcctgggaaccactgtcctcccagctggacatgcaggcactcacaggacagggccagggcctgtgcccagcaatgtcacttcccagtcaggggtgccaaaccaactgcaccaccttacagggcccaattttacacaatcttctagtccaactcactgttccgagacccaattggtgtcttatctgggtaacctgacggggttgatttggaagctttctagaaaggtccttctcagggaccaaactgattctagttcaagccaggcttgaagggacgcttggaccgcgtcctccaccagggccaccccctggcatgggacgaaggggaggctccaaggctgcagggcgggtgccggggctctcaccgtgcagctggggttgcccggctggatccgcagctccgccagcacccagatgccgttggtcagcttcagggactggtagagcatgtcctggccctccacgttcctcttggcgacagtgaagatgttgctgctctgcagcttgctgctcgcagcctctgtggggtcacatggccgtgagaggccccagtcagcgcgggggcctgggtacaggcgaggggctggggtcgggggctcggagtcctcacctgcattgagggggcagtctctgatctggaactgggcctcattctcattgggaatatccttccatgtggccaggaacatctgccggtctgcggggtgagcagggtggggatgagaggcgagcccctcataaacctgtgggccctctgtagctcagcaggaaatgggtctggcctttactgtgccacgtgaaagctgacaacaggcactagctgccgcacagccctcctgcttccctaagcacaccctccgctctgtgagggaggccccagtgccgcttccaaatgaccctggcttcctgcctccaggccttggatctcccctccccacccccacacgccttcctcctcctcggtgagcagcctgctcgttagtcacagcctcccatgcaggccttctgtggcaagcaagagatgacatgggccaagggctccacgcagccaggggcagggtgcaggccgtctgtgtgctgtgatcaacacccttcttgggggttccagaaagggcacagaggagggggttaccaggtgtggggcatgacctgggctcgctgcagcccatgggacaaggctgaggagcgagcaggagagcctgggagtggggtgagttccatgtggcacagcccacctgccagaccagaactggccactaaggccgggggggtcctgggtatacccctcactccaggccctgcagggaagcagcaactccccgactccatttacgggcaaggcagtccatctggaccttggtaaaggcaccaccttggccaggttcccaagccacagccccatttcaggcaccccagcgggctccctcatgactcacccatcttcccgtcctccacaaagaggatgtgcagtgggtacaaggtgctgaagtagaagacatcgatgttgttcttcacggccacctaggcacaagggggtccccagtcagtctctggggcttgacgccacctctgaggccccaggaagagtgtcactgagcagattctctcccagggccttccctggtaaacacaccccttcgttccccaacctgggcctccccaacacatctgcagctaagagcatgactccgcagacacgaccttctactgaccccagtggggcccggctggtaggtgagtaaggactggggtgcctgccctgcccggaacccacctggaggttgttcagaggctccatcttcatgaccgagcccaccgtgctgagaggcagggagatctccactgtctggttggggctgagtggcgcgtggacctggaggggggtggcgggggccaggccaaagctggggagagagaagccccacagggatggcagggggagtaggtgctgatgcgggacaggtgagctcctccgactcgggagctggggctgtggttggcagggagcctctcaccgtgccagccttcccatgttctggaccctggacagaaggatgggctgtgggtcccctcccccagatggccatctggacagaaagaaagagccccaggccaattgctctgctctgccccagcctggctgcaggcctgaagcccagctctgttcctctcctctgggccaggcactggtgggcccaggtaggcaggccttgccctgtcctgccctcaaggagctctgtctaatgccaggggcctggagtataagctgcttctaccttgaaaactctgggaccacccaagtctctgctgccaatcctcaactcccagaagggatctgaccatcccaagcaagacgctagattttactctcttggccagaacttgccaggtcacacagtggccacagagagattcaggaaagctctgcttctctgcaaagcagcacagtgacaaattaggaagatcctcatgggtgtgagacacgccagcagcaggctcttggaaggtaagtcacagggcatgggactgggggcacaaaccgagggctcggtatacctgggctgcggattcaatattatacctgctcctagcctcataaaaacagagccaggtacacctcttcctatcctctagatgaggacaccgtctcagggaggagcaggcctgtgtcagaccccatagggtgagggcgctgctgagaatcagagtttgggctgtctgaccccagcctgtgctctgcccaagaagccatcagcctgcctgggacacagagggagaccatttggggaaccccaggtccgcttggtggctcagcacactaggctttcctgggagctccactactgctcgctatgtgagctgtccaaggagcccaggtgtcattacctactaaaaaggggtgatggcagtgactttgctgggccatcaagtggctcaagtgagacaatactcccaaagccggtgccacagggcctgggtgcccaggaagcattcagcacacagtaagtttgctagaggcaaccattggaaccacctctcggagcctggtgcacttctgtggcctccagggtcacatgagggtaagtggtagagccacccctagccccggtctgcccaagggtcaggacctactggcccccaggcttccttggggaagcagccccttcagtcaacttcttagaggctcagtttgctcatcatgagcgtgctcaggaagaagaatcatcaggaggggctgccaggggtccccagggagtcctagcctcactggctgggtccatgacgcaaccttcccactgacacccagtgtagcggacccggtggggaggggcctgaagcagctaccgctcccagaggccccatctgacactttaatcctctgccacaatggggaggctggtaggcaggcccactccccaccagccttctgagagctggtccctaagatgggcccctcctatgtggggtgtttgccagaggtgggcttctcagctggagcagggcgtttctgtctgtaaaacactcctttggactgtggaggcaaaaataaggggggccaggtgtggtggcgtgcacctgtagtcccagagacccaggaggctgaggcaggaggattgcttgagcccaagggttcaagaccaacctgggcaatacactgaggccatctcaaaaaaaataaaaactaaaaagaaagacgtcctttcccactctgcctggtactttggagtccatatgaagaggccacttgggggtaaaaatcccactgcttggctgagcacggtcactcacacctataatcccagcactttgggaggccgaggtgggcggattgcctgagctcaggagttcgagaccagcctgggcaagatggtgaaaccccatctctactaaaaatacaaaaaattagccaggcgtggtggtgtgcacctgtagtcccagttactcgggaggctgaggcggaagaattgcttgaacccaggaggtggaggccgcagtgagccgagatggcgctgctgcactccagcctgtgtgacagagtgagactctgtctccaaaagaaaaaacaaacaaacaaaacccagtgcttcagagagttttggcctgagcggtggtggggaacatccttcagaaaaggggcactgccctcccctctacagcccccacccctgcctgcagtccccagaacagactccgagtgggttctctcacaggcctcctcttgagaggtgcgctggcctcagggagctctcacctgttgcggttgaactggatggcaaagtcggtcatgacctgcaaggccttgttggtcagctgcaggtccatggagatggagcccacctggcgggtgaaggtgcctgagatctccagccccttagccttcatggctgggagccagacctgcagggaagagggtgcggagggggcgggtaggtgcctcttcctgcagcccaaactcaacagcccacctgagggtgctttttctctctctctcctgcaggggcctcccagatccagcacccccacctttactgctaggggatgaacaggtgtgtactgggaacagaacaatcccatgtaccatctagggccaccgccatgacaggctgcctctcggagcagctcagggtggggaggcacttcagcgctccagggctgacgttgagtcctcagagggcaatggagggatcacttgggaagtagggctgagggaggccatgagctggcaatggagggatcacttgggaagtagggctgagggatgccatgagctaaggacagagctcagtgcccaatggcatcctgggcctcggccagaatctgggccttcctggccatcaccgcctgtcctcccttgcaggaggcagggctggcctttggctgtagaaactggtctgaccaaggacagtacctaagaggacccctcgcctggcaggccttctgctgcttggctgcccttgtcattcaagtctcagctcaagaaccacctcctcctggaaccctgcccccaggttccctcgccccagtgatgttatggcagataaatatgagcttgtgtctgtctctcctgtactcagagagctcgctgagggaaaggctctgtttttctgtctttaccaccttggctcagagcctggtgtgaaaccagtgtttggggagtgtttgctgagcaaacaggatgagttagagccctgccatggaagacatccaccagcggcatcctgtgggctcacaaacgcctctcaggcggttactctcctgtggacggctcacaggccccttgaggtgaaaaggctcagaccccaccgacagcttccgcagcgcactcagtgccaacaaaggtcccactgtctctcaggttgccaggccagaaaccacagaaacatcaggcaccagccccccaccccaccctaacccccttgagacagtcacgcaacccaagtcctgtgaaggccacctcttacatctgcctccagggcctccatttctctccatctccagaggtgccaccagcatctaagctgccaccagatttcccaggtaagacagcagctgccaggtggcaccccatttccaccctctccccctttccacagcagctgatgttatcttgtgaaatgcaaatctgatcatggcaccctgagaaactccttccaatcctgcaatggcctccacgggccttggcctccacagcctggtgcccatctgctccccaggcttggcttgcccctgcccctgggacctcacactggctgttccctctgctttgaaagcgcctccccacccccatcctgctcggttaaccctgagcacgcccccggacagatctgtgaggacagaaagcaccctgcttttgttcttggctgtgccacggcggctgagagagtacgcagaagctggctgaacctgaccggggggcatggctctctcatggacaactctccaggggccccccaatcaggcctcctttcccctggccctctctcagtcgcccaaggctggggatgcagaccgcactgctcttggtcactatgggttcatggcatctcacacaggtcccaacagaaccatcttcaatctttactggatgaaccaatgaactgtcaccaccagcagactcaaatggtgaggaacccaaaagttcttatgcacagacagcctcattccttagaccaacatggttggccaatgtctgtaaccccacaagcagggtgtggaaatgcatgaggaatgaacaattccaggtggccacagcgctgttaggaagatgtggatacctactgagtgattctgaagggatagtgcacccacaccctagaaccctcccatgaccaaggcagtggggaaagtcctgcccgtggcagaaaaactcctcctccaggcaacctgccctgatgactcttgactaggagatcccctcccctctcctttccagcatgctctgttggatacactcatctgacccttcacgaagacaaagcaggggtaacactggtaagacaaacacatggctgggcgcagtggctcacacctgtaattccagcactttgggaggccgaggcaggtggatcatctgaggtcacgagttcaagactagcctggccaacatagtgaaatcctgtctttactaaaaatacaaataattagctaggcatggtggcaggtgcctgtaatcccagctacttcgggaggctgaggcagaagaatcgcttgaaccccggagacacaggttgcagtgagctgagatcgcaccattgcactccagcctgtgtgacaagagcaaaactctgtctcaaaaaaaaaaaaaaaaaaagatgaacacacaagcctagtgccagcttgccaaaggccagctccaggcttatttttcctggcagctctgcagtgcctggcaagggctggcacccacagggttacaggagtctttgctgttctctgtcccttagtcctgctttgtatgcctgtgatattgggcttctggtgagtacgagttggcctcatgccttggtgcagctaatccaggtagtaagtcaactgcacatgctgtacgttatgccgcgattctacgttcccgtggccctgctggccctgacaccccacgcatgaaggcaggtgcacaggtggttctcacgctctgtggggaccatcatataggggtctggagcagaggctttagtgtcacttgctttcacttccagactctgtcaccagctatgtgaccttaggcaaaagcactaggatttctcaaccacgaaataggaggaagagccacaaagggctgctgggaggaggacgtgctggcggtggctgtggaatgctgtgctgtccctacaaggaagtgtgcggctactagtgtccgagttgctgtctgctgtgggcctctcagtgcccagaccctgccaggggctccagtcaccaccactgcaggtgcagctggcatatggtggggaaagccagctcagggggtggggaggtgctggctcatggctccctagtcatgacagagctgtcactgcccctgaccgccaactgtatcctgctttggggtggggacctcagaagagagaggggagctctggcaaacacaacttctgatctgagtgtgatgaggggatcaggcctggttggtcccctctggcagcttccttgacactgacaacatggcccacactgagctctcctcagtgccaggcccgcatgtcctcacatcccaaactcaactctccttccctcagccccggctcctccctcccagggagctctcaagtctggccgctgtttccacccacaagagcccccgtggtccagctgccccagcactcctcctccctgccacggaatcccccggggccggtgcttctgccccaccccttccctgcagacgcagccatctttctcaagtgcaaatcagactggttcatctctttgcttaaaactttccaatggctccggctgtgccaggatcaagaagaaacgctcagcctggcccgccagccttgccagcttcctccttcactgatccctagtctagccaggagtcttgggggtgtgccctaggtggcatagtgggcatctgtgggcatcttcaggtggcataacatgtagtgggctggagtcagggatgctggacatcctaccatggggacaaccaccccacaacaagcaactgtcctgcatccttccagtattttctgcatggtttcaacatatcctgagacttccaggaacacaattctcaggaaaatcgagggaagcctgttctttatcttactccaaaccttactgggagtcagtgaccacttcagaaacaaatggcaccactggccaaaccattcacggggtccaggctacaaacacccagactgtggttgccacagtcacagtgactttgccctgcagcaaacacctggcaacttcatgtcttctggggtgagcgggcaggcgtgcccagacgtttataacattgatacatacacttgtattctctcccttttatgtctcctccatgcagtgaaagcatctgagtatttttggaatgctatgtgtaggtaggttacacagcccaccaattgcatttaaggagaggaatggtgacaatgtaaaatgtctatgatgactaaggggtgctgagtctgatggcactgagaactactgctcccacctgacaggcctctgctgattccctcacaaaggccgtggtctcccttccctccaggccttaccacagactgttcccttggtctggagcccctatccgcttttgttcagctactgaggtcctgcgactcctctggaaagccttcctaggtacccaccaagcttgacttagctcctcttcctcggtgcccctgtggcccccagcttccctcatcactgctggcctgagccaattccacagccgaggccatttaaaggagcccacatgccagtctccataacttctctctgctcccgccaagacagaagacaagtgacttactgctttgggggccacatatgatcctgacagggtgcccacgccactggtcaggtcaaagaggtcactcaggccactgccgatgggtgctccaagattggctggtactgctgctgttggaggtgccacgaagttggtgcccccaatctggaaagggagggaaagagtcagaggtgggcgtcaagaggcaaagacatcagggtctgggaatgagtagagccacctggctctttagaagacactgggggcagggggcaggacagcctccatatcaactctaaattacagaaacaagacagagagaggtgggtggagaagagaggctgagccctcccgtgccctgcaagccttgagccttaggagtaacctctgggaaagggctggggacactcccaaattgacgctcagcctatggataaaaggaggtcccaagacacacggctgggtggagacatgctacgcagatgggtgctctccctccaggacatcagagaagggttgtgggactgagggctggcaatccccgcgatgacaaggcgacgtgtcatggggtggtgaggactgggcaagaatccatggctatggggcccagtggcagccggatgccaggtggtcaagacagaggctgccaggatgctggaccaaggcaggggctcagcaggtggaggctgctgtgacatcacccgcccccgccccttgggatgctgggccagcgctttcgggaggagcaaggacgaaggcttggtgacgcaagggttgaaccataccccttcaggctcatcccccatctccaagcagaagcaggcaggtgaagagaacaggcagccacatgcagagagaaaaagccaggaaggaagacagagaaacaagagagagaagggaaagagggagattagtcaacggtagctccatccgagaggagtgtggtgtgaggtctggcgagaggcccagaccctgtctctatgaaaggcactaccccacacctttaccccaacacctgtcctgcaccacagcccttcctgcctcaccctagcagcactgatcaccagtgtcctgcccccgtgctgccaccgtgcggacctgagccgagcacagccaaatgaagaggtttaggcgcccccacacatggtcctgccagttgcctgaggaagccccagggagatacccaagtcagtctcaccactcccctccctactgtcttcccactcccctctctccccggcctcccatgccctctcaaataggcctggatgggctgctattcccagctggcgctgcataagggtaagtggacacaagtctgattcctcaaagccaggaacaccctagccttacagggcaaaggtgactgtgatgccaggatcagggcaagggctaggatgcgcctccctgcccagggtctcctgggactcgaaggttcaacaagggagtggaatcctgtctgcctctcaggggctgtgcgacctcggagggaaggctgcctggcctctctaaaccttggttttctcatcataagtagggagctacacaatcacctccaagggtaaatggtaaggactctatataatgtacctgaggcactcagctggtgcctggcatggaggggcattcagtgactgctcctctgaggatcattatcaacatcatccagagggggcccacaacataccaggctgtcaaggccaccgccaagaaggtccacagctcccatctgcaccgaggaggtggccaggggtgggccgctcactggggggccgaggtccaggttgaggaggtcacccagcaggtcgccctgggcggggatgacatctggctgctccccaggaggtgctccagtaggggctgtctcagggctctctgcgctctcactcctgccgggacacagaagtagggtggaggcatcaggatgtctcaggaaggtcaaagagaccccagcctccaggcagagctgtcccccaggacaggcactgagtctcctcactgtccccgacagggctgtccacacggccccacttcttccccattcccattcccacagcaggtccatctttcaggtcctccgtgaggatgagtgaagggagagggccgcctgcttctagccctcagcccatgctaagaagaaaactggatgccagtgccctaggacggtgccaccaggccacaccaaccacctgggaacaacagaggaggaggcgcagacagggatctggaatgagacagaactggtctgagtcccagctctgctagctgtgagatcctggaccagtccctcaagctctccttgtctcttgttcccacctgaagaatggggacatttgctctcagcactgtcgttaggctggaatgaggtcatctagcaaataccttgtgtacaataaatagctgataaaaggttgtcagttttcctcagactcaggtcttgctgggggacaacacgccaggcctgagtgcctgtgctgctaaactggggaagcagagtgtgaaggcgcaggccgactggccagtctcactcacgaggccgtgcgaggtggcaggctcttgtgcacgacgccccggcccccctccacaaaggcactgggaggcttatggtagacggaagccagcgtgccgatgtagcagataagctcgtctaacagtgtgggctcgatgaggtccgtctcttcagagatgagtggcttctcagccaacaccacctccttggctgccaccgggtccgtggacagcaggcgccagtagatgtagccacggtcccgcaggtctgggttatctgagtccttgtgggggtgaggagaagcccatgaaactcagagtagccaggtgagaagggaggagaccttcctgcagccatgagccaggtgcggcacaggggtggccaatggggacagcagtcctgagtgctcccatgagcctgcccctataccacctacagggccatgccctggccccgggctcattccccatggtactctactccagcctggccatgcctgtctctactcccaaccgccctctgtggcctgcccttcctgcccccaacacacaccctcaggtttccatgggccctcctcctctgtctagtttgtctcaacttcactacttgacctcactgcactttgtgttgtgttctaagcaccctgaaggcagggagcttgggtaactctggggctggaagccagtcccacccacaagatacctgtcttaggagcgggcctggcttccaggtctagttcctgggacaaaagttcccctgcttgagtgagggctatgctgggcacagcggggaggttggggcacccacctgagtggccaaactgaggacctgctgcaccagctcctgggtctctgttggcttctttagaaagagtttcacaatggctgtcagcagctgcagctggacctgcagggaacagcggtgacgaggaggaagtgtgggcctcacatggggatagagggagaacaaaaaggcttgaagaggaatagggtgttcaaagtccctggaagccaagcatagctattctaggtttggggctgtcacggcacacaggcaaagggctgccacaagtgttggtgccgctgagcagccagacctcggcatcactcactcaggaaggagctgaatactggactatttggcaaacccaagtaggccaggggccgctgcccagccctagggttttagaaacctgttggagctctagaattcacagaactatgagaagctcacatgtgtggctggagtgcttcttatcaggaccatctgtcaacaagtggcgacagtcccatggaggcccaggggactggggcagcagggcccacagagcctgccgtcaaggacctgtgcttctaccagagggttggaactattcctggtggccctccaccggcccctgccacatgcctggacatacccaaagctgccctcatcctggccaacacctcctcacccttcagatctcatgccaaccccacctccagaccccccatgcttctgcagcctcttccaccccgtcacagcgccaccagttgctggctatcctgtacagtgagccccctgtgggctggagtgatgtctgtcttgcttactgtcgtgtcactaattactgcccaatctagtgcctggtgtatagcaggcacttaagaaatacttgctgactgaagaaacatctatgcgagaacaagtctctgcacataatccttccttagtcacggtctcatttttgctagtcctaggacaagggggcagcctgatgctcccggagtcaggggcagtgggagcccataggctgtgccagggacaggtctgcagcaggagggcaggagtggcagtgcaggaagcccagcagcagccgtgctgacggcatctctggcacctgcccagcaggagggcacttgtgcagggaaggctgacagaggcaggcagaatggagggcacgtggtcctccaattctggggtgaaccagagtctgcaatttggttacatgggggccagcagcagatgagcagtaggctggctgtttccaaggcaggaggcagcccagcatctggcttccagactctagccctgcctgggcagccaatgggaagccgtttacccccatctgtaaaggagaggtgtggcctacttcagggattcttgtgagctttaaaaacagcaacttatggcagcttgcttggagctggagtcagatcacaccttatgtgaactccagttctatcacttctcagctgacagaccctcggcaagtcatttagcttctctgagtcagtttcctaacgtataaaacagtcattacacctcacagcgttaatggagagttgatgaaaccacaaatgtaaagaagtggccaggcgtgatggctcacacctgtaatcccagcactttgggaggcctcggtggttggatcacctgaggtcaggagttcgagaccagcctggccaacatggtgaaaccctgtctttactaaaaatacaaaaattagctgggcctggtggcaggtacctgtaatcccagctactcggaggctgaggcaggacaattgcttgaacccgggaggcagaggttgcagtgagccgaggtctcgccattgcactccagcatgggggacaagggcgagactttgtctcaaaaaaaaaaaaaaaaagtaaagaagcattgtgtattctgctcactacagaacagctatcatcatcacagtcattatcaccactaccatcacacagggactcttgaaagagttcttcccagtccagtcagccggatgcctggaattattcatcactgtcagatctgctgtggttccagtcaggtatgcctcaggctgtattgccagagggaggtctggccaggtgcccagggccctggctcaacaatccgttccagttcctctcaacacgctcaacacactcaggccgttagcctgcatatttagggcagccttctgcaataatgccattgcccctgccatccagacaggatgggatggcaggacagggccagacgctgggctgatataccaccctggccaagattttttttttttttttttttttttttttgagatgcagtctcactctcctgcccaagctggagtgcagtgggatgatctcatctcactgcaacctccgcctcctgggttcaagtgattttcctgcctcagcctcccgagcagctaggattacaggcacacaccatcacacctggctaatttttgtatttttagatgggtttcaccatgttggccaggctggtctcagactcctgacctaaagtgatccacccacctcggcctcccaaagtactgggattacaggcgtgagcccagctgctgaccaagactttctaagtctgctgtccatggctagagaggcctaggagccaaggatgagaagattcaacaagacaatataaaatgagttccataattgtcaagcccggtgcagtggtgcaggcccatagtcctagctattcagaatcctttgagcccaggagttcaaggctagcctgggcaaaacatagtgagatttcgccactaaaacaaacaaacaaaaaactccaaatcgtcaagcactaaacaagtattctttttttttgagacaaggtctcgctctgttgcccaggctggagtgcagtggtgtgatcttggctcactgcagcctcaacttcccaggctcaagcaatcctcccacctaggcctcccaagtagctgggactacaggtatgtgccaccacacccagttcatttttttttttttatagagatgaggtctcactatgttgcccaggttggtctcgaactcctggactcaaaagatcctcctgcctcggcctcccaaagtgctgggttacaggcatgagctgctgcacccagttaacaagttttgttttgttttttttcttttttctgagatggagtctcggtctgttgcccaggctggagtgcagtggtgtgatcttgactcactgcagcctcaacttcccaggctcaagcaatcctcccacctaggcctcccaagtagctgggactacaggggtgtgccaccacacccagctaattttttttttttatagagatgaggtctcactatgttgcccaggttggtctcgaactcctggactcaaaagatcctcctgcctcggcctcccaaagtgctggggttacaggcgtgagccgctgcacccagttaacaagttttgttttgttttttttcttttttctgagatggagtcttggtctgttgcccaggctggagtgcagttgtgcgatctcggcttaccgcaacctccgcctcccgtgttcaagcgattctcctgcctcagcctcctgagtggctgggattacagacgcacaccaccatgcctggctaatttttgtatttttagtagagacggggtttcattatgttggtcaggctggtctcaaactcctgcctcaagtgatctgcctgccttggcctcccaaaatgctaggattacaggtgtaagccactgtgcctggccctaacaagtattcttaaaagagctttgaactgtgttgtgaaccaaagatgcaaagtgaacaggctactgaattacatcacacccccactttacaaacaaggcccagcagtctttgcaataactgcactagagacaaggaaatgggtttggtgagttcaagtaactgtgctccaggccacacaacagggaggaggagcttggatctcaaacttcagagctctgtttctgttcacaccaccagactcttggcttacctctccctgtccagcttctctcattctagctttttagcaggcttagctgcaaaagactgaccctattataggggcagaagcacacccctacagcagcggttcccagcctttgtggcaccagggaccagttttgtggaagacaatttttccacagataggggatgcgggttgggggatggtttcaggatgaaactgctccacctcagatcaggcattaggttctcataaggaacacacaacctagatccctctcatgtgcagttcataatagagtttgcgctcctatgagaatctaatgccgccgctgatctgacaggaggcggagctgaggcagtaatgcttgcttgcccgccgctcacctcccgctgtgcagcccagttccttacaggccatggtggcccgggggttggggatccctgcactacaggacatccttgcagtgatcccaggcaggacttgactgcaggagcagaacccagcataggcaagctttgcttctgagacagagggaagaggctggtattgcaagcaaaggcagtctggaggcaggtggcagtgggggggggtgacggtgggaattagtactgtgattctgagatggacatctgttgtttttgctcacccagcatctattctgtcttctgggaacagaaacactggctttccttcagagcctcgcccttctttctgtccctttcagtccacacaaactgggatcggtgcctgagagacctcgccaaccagagtcacagtgcctggctcaggataatgcaaataggtcctgggacttttgctggaactactgaggggaggggaaaaactcttcccatgggagttattgtgccataaggacatagcctggaactgttgattccttacagctcccactgttgggagcctatccatggcagaagatagctcaatgccaccatccaagcaccctcagccaggagtcccagaagagagcatgctacccacacttgccagctaccggaaccagttggtcccctttttggcctggactagtttgcttttgaaaccaatttggcccaaaccaacactaccatgaacgagtgtttattatgggctggccatgtgtcaaggacattacacaaagcaccctaatttaactttcgtagcaagaggatgagggaagatctaatgattctcattttacaaatgaagaaactgaggctcagagagttaaagggataagcataaagttactgagccaggaaggggcagaggaggggtatggactctgggatctctcattctaagtcccacacttggacccacgggattacacaaccccagttgggcagcaaaaatttctgtgctcaccaacagactaacagacagttcccagttaactgagaaaagggaatacaaatgacaaggcagacattcagcctcattcataacagaaatgcaaacagaactacagtgaggtacccctgttagctactggactggcaaaaacaaagcagaagtaaggagagggcaatcccagcatctgagataggagtctaaaccagcacaacctccacaacaggaatctggcaacagctacccaaatctcaaactcacatgctcttttctctaagcatcctgctcctatgaatgtatcctccagctatgcctgcagatgtgcattacacaggttattctcggcagtactgtttcaatgagcacaagactggacacctaaatacccaccaggagaggatggttaaataaagcataaatgaatgagagcatggtctttgcaggtgttggtaacagaaaaaggcaaggtgctaaacaatttgaatttacagagtatgctacagcagtgtttaaaaataaatgagagggcagtgtagatacagttgattctcactacttgagcaatccatgtttgtgaatctgcctacttgctaaaatttacttgtagcccccaaatcaagactcatggtgcctttgcagtcatttgcaaatacgtgcagaaccgtgaaagctttcagttgcctgacacacacattcacagctgaggtcaaataaggcaacactcatgtttcagctctcatcctgtaaacaagcatcctttccaccacctatttagtgccatgtttttcacatttttgagctttttgttgatttccttgtttaaaatgctccctagcactgaagtgcttgcctagtgtccccaagcacagaaggctgtgatgtgcctcagagaaaacatgtccttgataagcttcgctaaggcatgaattacagtatccatggccatgagttcaatgtcaatgaattgacaatatatattaactaaggtgtttttaaacagaaacacacatttaaaaaggttattaactgatcaattgacaaaaacgttgggtctagatgctcacagaaactaaactctatatttctcctaggagctatggttcagtacttgctaattcagtgtctgccatgactatggaacagaagcaccatgaaaaataagaattggttgcatatgtgtgtgtatgtgtgtataggaaggatgggtgcatgtgtgtgtatctgtgggtctactggtgtattcctaaatgatctcctgaactttcctaagaaatcaaaaaagtgatgacttctgggaggagaatttgtgtcctacaaagtgatgagagggaaacttttcactatatatgcttttgtatcaattttaaaccaagtcaatatatttcctattaaaatatgactatggaattaaaacaaaatgaagaacttttgcctgccttccacgcacaccaccacagactctcacgtgtccccgactcgactgtactgcagtgaggaggaaaaggggcggtgtccattacgcgcacatcactcatctgtctgtcagggctgtttacgaggtaataggaagggagggtttcatggcagtatgggccacagtggggctgagctgccagtcatgactcacaccctggccagctcgctggctcacctgtgtgctctcgtcatggaagccctcgaggaagctctccagcagctcatctgcgttgtcgatccgttccgcgtactcgcccacaatccagatcatggcagcccgggcctcaggctcatccagggagtccagattctcacacagtgtggcaatcacactctcatacctgggagaccagggcacagttggtatgggagccctcaaggagaacgggaaacccagggaagccagacaggggccaggagggaaggggacctgcctcctaagaccccaaggtggcaggtaaaggggatctgagttttgtttttttttttgagatggagtttcactctgttgcccaggctggtgtgcagtggtgtgatctcacctcactgcaacctccacctccctggttcaagcaatgcccctgcctcagcctcccaagtagctgggattacagggacatgccaccacatccagctaatttttttgtatttttagtagaaacatggtttcactatgttggctagactagtcttgaactcctgatctcaggcaatccacccgcctcggcctcccaaagtgctgggattacaggcaagagccaccacacctggcctggggatctgagtttcatctgtcacacgttagcccttattttggcctggggagtagaggaggggcagtgtggacgaaataaaaaacaaagggtttcttttgagaatgacgcttgtggccaagaagtaaggaagaggagattcctccttccttttctgccccgccatccctgtccccaggcagagctagatgccctctccctaggagggcgggcacgcacttgttggggtacttgcggaagatgtccttgatgaccacgatggcctcctggaccacatagttgaccttggtctggatgaggtcgagcagcgtgctcacacagcgctccgcagattgctgcatgggaagagaagagtgtgggcgaggtccccgcaccccatttccagtagagcctctgatgtccacgcctcggccaagggctgcaaatcacttctggcacaccttcctcatcacagtgggaaaacaggagaaccctctccccaggtaacaggagagaaccagtaccaaatcatggccctaggatggtggggacatggggaatgagactgaggagaagccagaggaagagttcctgagagccaggagggtccttggagctcctctaagtcaggacctgagggcaaggtgactacgctgcagtccaaccccacctctctttttacttgtttcagaaagggggctcctatgtccaaaaacactcacagaacctctgactgcttctgcctttacttccacacactgctctcacggcctgctctgaaggagatttctcaggacggcatcataggctccagggtgagcacgcctcaaggggataggtcgggggcgaccacctatcctaggacactgtagccaccagtggacccatttaaggagaatctggcttagtggtcgaggaacatctccacagacagagaaaggacggggataaaatgccaggacacaggagtctagagtggccctgggacgctgggacacagaggcacgtgggcagctgaatgatgacaatatttgccaagaagtgttcaacaggcagggcccttaccccagagctctgtgaagtgaatgctaagtccattaacttgtggctgccccagcatcttaacaaatgctgcaggagaaccatgattatgatgggttaatttgatcggcagcaactcgaaggcctaaaggatactatagagtgagaaggaaccccaccagatctgcacaatgcttgccatgggggctccagtgatgagcctcaggccttcccagaccacaagcaagctggcagattctgcttgaatcagactggtttcccggtttcagcccccttttccttctccagccaaggacagagtcccagagcctcacctccaccttgatggcgcagcggccaatagcacgcacagccttccgtacaaagtccacatccacttctgttgcgtactctttcagctctgccaacacctgtggcccaaacagaaaagatggggctggggcacctgatggggcaatctgctggaacactcctgggcagtgaatatacacagactccctaggagaatgggattctgcctcctgctccaggtagaaggcccaagggagagagctggcaggtgcctgaaaaggaaagaaggcctggacaaccttgtttggggttgatttagctaacatatccaacaccacgttgtaagggatgacaggtgataacatggagaaacattctttagtaataaaaacatcagttcttttacttgcttacgaagccccatgtcccatgctaaacactcttcatgagataaaccgttaatggtgagactggtcacctgggccagagcctacagtctggtggtggtggaatggtcccacactgagcccgtgtcctgaccatcacacgcagctgacctgggcgatgttggcctgagaggccaggcggatcatgatgtccagcttctccagcttcacgtagatagggtcgttgtacttcacgaagaacaccttcatctcatgcttcaggatctcaggcctggtggtggggcaggatgcccggagagcaaaaaacaaggcttaagccctgtgagaaaatgccctccacatttgctgggacatttctggggtctgaggtggagcctgatgtctgtgaaggcagagtcactgccatggctgcaagctcctgggtagagggcccagcaaccggcctgagcaaggctgtgactgctcctgtgtgcctgagcacgtcgccggaagggagacggagggcagtgagagacggctcactcactctccagaggcagcaggccccatgggacgggcttgggaatcagacatatctcagtcccagtcccagcctgtgacctcaggcctgtttcctcacccatgaaatgggaatgacgctgtacagaaacatgttactactgcaggtctgggactgctagcctcagaaggcctggcacgtggcaacttggattttgaagtgttctcactgttccctaaatgataaaggtatttaactgtacctagaccatttgtacaaagaatacagtttatgctgaacacatgcttccctactgggaatatggaatttgtgtaggtgcccccaataacaaacttgggtgccgaagtctcaaataggctttcctgggcagaaacattacatacatgttgctgcattttgttgggggaggagtgtgctctgtatgactccccatgggaaggaggaggtacaaggaagcctctcatggaaccctccagactccacctgtgtccttctcccctatgacccagccgggcagccctgctctgctgctgatagatctttgctgtgggtatagctatatgctgagtcctggctgggcacagcagctcatgcctgtcatcccaacactttgggaggctggggcaggaggattgcttgagtccaggagttcaagacgagcctcggcaacagagtgagaccctgtctcaaaaaatatatatatttaaaaaatatatgctgagtcctgtgagtactgctagtgaaacctgagcatgagggtggtcttgggaccccaacatggacaccgacctaatcggcctgctgtgagagtgagacgagaagcatccagcatgatcgatgcctgcctcagagaaggcaccgctaggcaggagctgtcactagctgagccctttcacatgtgtcattgttcctccctcaaaggcaacatccttctgccttccgcgagtatcacccaccacatttttcctgaacaaggaaacttcagagagggtgagaggctggtactaggtcacatggctaatgtcagtaaagacgagagtggggcgagaatcctctgcctctgactcctactcctatgcccttccagaacagagaggaggaaggaaaagatacgaggacagatggtgaggaagggagaagacaggacagagagaaaggagaaaactgggtactctgtgctgctgtgcacactgcggggaggtcctggccaagcaaggagcctttgtcgtgccccatgggagaggcaagaccccgagctgggtagcaggaagatatttctgcgattaggacttggcaaaagctgcccagccacatctcaggaccagggcagggcatgtctcagtgacgtggacaaattcttaagagatttactatgttaaatatagcacagggaatcctgcacgctgatctgctctactagtcactacgccgcattaaatccgtgacccaagggcactggcgtataaagacccacactgcaaccaggaagccctagtttcatcccttggtttaggaactcagaaggctttcccatatttacctccctaataacccaattcgaccaatatctctgggtcccccgggagagtactaagacccagactgaagctacaaccaggaggatgtgctgtcttccaagagaaaatgactaatgaggccccagttctctgtgtagccccactcccagccacagggcctgctgtaacatacgaatgatcaatggttgctactgtcaagtccccacgaatgatcaatggttgctactgtcaagtccccactgctgactgagccatttgaccaaaagctgtgaggagaactcaaggtcaatccccctccccagagctgcagggctctgccactcagagccacttcagaggaagaaggggatcatgccatgaacccctccgatccagcactgctcaatggtttttctgctctcgcctaccccccactaccataccacgtgccctgggagcagcagctcactgctcagccattctcatgggagggaagtgggcggcacagcatttggagtgagtccgatgtacctctcccccagacctcaaggttccaacctcagagagtttgactagagctacggactctgtcccccgaagaaatgtacacagatacacaaaatctgacagcccatttcaggacagctcgtggactatgaagacaatatctagtttaatcaccaagctagtctttacatagcctgcttcctagttaggttaagccagggcttctcaacctcagcactgctgacatttcgggctggacagttactgtgaggggctattctgtgcactgtaggatgctgaccagcactcctagcctctgcccactagaagccggtagcatgcccccctcagctgtgaaaaccaaagtatctccagacaccaccaaatatccctcaggggggcaaagctgccactttggttaagctattctgggttaagctatttgagacttcctgcatggtgacaggtcagtttcctttgagagcccccattcccagcagaagaggctccccgaggggtacgcatggacgtgcgtgtggtgacctcagtaccttttctgcacgatgagattgatgttgcgcagggccacatactgcagctctggctcggctgacagcagtgtgaccaggggtggggccagcttcttgagcagtgtgccgtagtagtccaagtccttagacaacatctccatgaacttcatcagcaccttcacagcagagagcaccacagcggagttggcatgggagagcctgggggtgacccgctcacagatgctggggtccgtccattccaacggggcaaacaggaaagacaaggggaaacattctgtttttagttaccaaaatagcatgtccaggccaggcgtgatagttcacgcctgtaatcccagcactttgggaggccgaggtgggtggatcacttgaggtcaggagtttgagacaagcctggccaacatggtaaaactttgtctctaccaaaaaatataaaaattagctgggcatggtggtaagcacctgtagtcccaggtactcaggaggctgagacatgagaatcgcttgaacccaggaggtggaggttacagtgagccgagatcgcgccattgcactccagcctgggcaacagagtgagaccctgtctcgaaaaaaaaaaaaatagcatgttcagcctgggcaaaatcatgagacccttctctactaaaaataattttacacattagctgagtatggtggtgcatgcctgtagtcccagctacttgggaggctgacgcaggaggactgctttgagcccaggagtttgaggctgcagtgagctgagactgtgacactgcactctggcctgggcaacagagcgagaccctgtcataaacaaacaaacaaacaaacatgttttttgtaggagaaagatctaaatcttggttctgctgcttgataacccctagcaggttcaaatcactctgagcctcagtttcttcatttatagaatcaagatgatgatgcctacttcacagggttgctaggggcttaactgacacaacgcatgtaaagaacaaggctgggtgaggctgagatgggtggattgcttgatcccaggagtttgagaccagtctgggcaacatggagaaaacctgtctctatacaaaatataaaaattagctgctcatgttggcatgcagatgtctgtagtcccagctacctgggagaattgattgagccctgcaggttggggctgcagctccagcctgcagaacagagaccctgccaaaaaaaaaaaaaaaaagaacaagcacagtactggcatgtagtacatactgtatagatggcaactcctcacttcctccgacttggagggtatcttgttggttaagaccatgagtcaggtgagccccagccaggggacctgcactattccctccacctctctaagctggagctccctcatctggaaagtgggggatgatgataaaagttgcattaaagactctaaagtgtggaaagcacccggcagagccccagacacccagtgagaattcaatgagcagtggctctggcgctacccacctattgaactcaaaagaggtgccctgggcttctgccagctccaaggccaggccatgcgtatgcccatagctgcccaaggcaactctcctgtctacctggctctggagaggtgggaagcaggcaggcctccctttaggtgtgtctgagggtgggttatggggcaaagcactagaaaggggcccactaaggcccaaggcccagtgcctggttggagcccctgaggaccagggtcctcaagctgggctggcaagcaacgggcagcccgctcacctctgggcctcgcggtcgtccttgggcatatagttggcgaggcagtccaggatgaagatctggccccactcggtgcactcattgagggctgtcagcagcttgttgatggactgtgggttcagatcgagcaggttgctgctggggtgagactcggcaatttctgagagcgctgccactgcattggccaccacctggttgagagggtgggaggggcagaggctgggggtgctgctcacaggccagggggcagtgcattaatgatgctggctggtcagaggtcaaatatcctgaaaggaatatgacccaatgggcagggtctggagctgcaacgagacccactccaagcactcaccctgctgactcctctgcaaactggaacaaaacaagtgtgcctgccatttagaaaaacaagaaagacctagctccaagggcttagccacagaaagcattctcagcttcctaacacagcagcgcctgtctaccagcaacagcacctcacttcaatgcttgtcagctgtgcttctcagagctaggggattcctgcagagctcctcgaggctactgggagtggatgggggcttgccaggtgaagctccaggccctcaatccatttccactaggaaggtgtttttttttgttttttgttttttttttttgagatggagttgtgctctgtcgcccaggttgcagtgcagtggtgtgatctcagctcactgcaacctccacctcttgggttcaagtgattctcatgcctcagcctcccgagtagctgggactgattacaggcatgcaccaccacactcagctgatttttgtatttttagtagagatggggtttcgccatgttggccaggctagtctcagactcctgacctcaggtgatcctcccacctcaacctcccaaagtgctaggattataggcgtgagccactgcacatagcttgtttttgttgtttttgagattgagtctcactgtgttgcccagtctggagtgtagtggtgcaatcttggcttactgcaacctctgcctcctgggctcaagcaatcctcctgcctcagcctcccaggtagctgagattacaggcacgcaccaccatgcccagctaatttttatatttttagtagagacagggtttcactatgttggccaggctggtcttgaattcctgacctcaggtgatccacccgcctcagcctcccaaatagctgggattacaggcatgtaatcctgtatgagccactgcgcgcggcctcaggcagctgtttttttttttttttttgagacggagtctagctctgtcgccaggctggagtacagtgacgcagtcttagctcactgcaacctccgacttcctgggtacaagtgattctcctgcttcagcctcctgagtagctgggattacaggcacatgccaccacacccggctaatttttgtattttgagtagagatggggtttcaccatgttggccaggatggtctcaatctcctgacctcgtaatccacccacctcagcctcccaaagtgctgggattacaggcgtgagccactgcacccggcccaggcagctgtttttaagggtgttctgcattgtttccaacttttctctgtgaaccatccagtgctccagtacccatccctgtactggccgctcagtactgtgtatggcagttgctcagtgtttctgctcagagtggggaatggctgggtttgtgcattcattttaaacaggccctgccaaactgccctccaaactgctgccaccattgtgggtaaggggactgtggggttccacatccagctacatcctgatgtcctgtcttccaggctatgctacttcaagggtgaccctctacaacccaacaaagatgggggaagggaaaagcaccacacatgcagcatattggcttggtgagaagacagcaacaataacagtgactagaaggggaaggagggcactagtattgatggtgcaccgttaccaggccatcccaggcacgtcaccttcacagcactcctgccagccacgtagaatgagatccatctcactgatgaagaaaagagagcctaggcagcttgccccaggttgcgcagctagtcagagggtgaggagaagggaatctaggtctagctccctccagagagggtgcctgaaccaccaaaaggcacaagaacaactggcacccccagccaggctccgacttctaggtactcaggactgcctggtgaagagtcaagccaatgtcttcccaagcaacccaggaggtggtggaggtagcacggtgggtggcagtggcttaccatggggttagagtcggagatgaggtctttaagggtgtccaggaagccctggtcctccaccagctgggcgttgatgtcgtggagcttggccacgcacacagctgctgtcttgcgcacatatggatcctcgtccttcaggcacttccggagtggctcgcacaggtactctgtgatcttgtcaacgcggatgcagcccatggtccgcactgccagggctcggatgagggggttggggtcctcacagtcctggggggaaccagccatcggccagggcaggggtgggatgagccatctgtggcttcatattctccctggcctgcagctctgagccctgctaggctgagcgacatcagatggctgctgtggatcttcaccaactacagccaacaacagcaaaagtaaatgctatataaccagcacccatgccagctctgcacaccatctcctctgatcctcacagtagaaatacaatacgggtcccattttatagatgatgaaactgaggctctcagaaaggctaggagctcatctgaagccacagagcagagccgtgattcaaacccacatccacctagcatcacagccctcggtctttccactgggccacagaagcctcatttccccatatccgagcacggacaggactcaggggagctaaggttctaaaggtatacaaattcagaggtactgaacattaggagaaaataaaattaaaatataggtgcacagagctgacaatttaatctgaaggacagaaaatggagaaagcagcagtctgtaagggcaacagagaagctctcgggcacctgctgattcctgccctagcaaagcatgcagggcagggtccaatcagggcagtgaggggatcaacaggcctggcaggacctcacacaggatgagttacgcagggtccttagcatctgattttctggagagtgggagccctctgctggaggaagaggcctgcaggctgggcgggcgcgggcagtctgaaggtctggactccatccagtgccacagggccccgccccaaagagactgaggggagacagagccttaagcacccaatgtccccacgcccaccaagcgtctgctcaccttcacaaaggtgttgacggccataatggccatgtcaggctgactcttggcgtaattcatcaagtagaggtatactagcttcttcagctccaggttgtccgtctgcatgcagttgaccacatcggggaagagggcactggaaggtcaaaatggtgtcagcatgggaaaggctgaacaaaggaagaggaagattttcaggctgctaactagtgggtgagaggacagtgggtaggagagaaaggagagacacactggacttcctggtaaaagggagggtttcaggtctgctgttaacaatcaacacctattgatagaaagggaatcccaaagggtaattttaaaagcaggaaagtccttgattcttttcatatagttcaaacatgagttctggagcccatcaaacccaccactgcctcttgctagctatatgacattggagaaattcctttgtcacctgccccctcgccctgagtctcaattttctaacttccaagaaagacgcaacagaaactcacttcacagggcctttatgataactgaatgagacaacatacttaggtatctggtccttgatatctgggagatgctgagtaaatgaaaatgatcctttctccctctctgatacttaatgtggccccttacattgggctgctggttctggagggtcgcagggaagcaggatggctcatgctgctttctccacaagctctggcacccggtaagaaccagcacagcatgcatggagcacacaccatacaccaggcttggtgctaagagctttacatgcttgatctcatttaactgccctcagaagtcaggggatgatccccatttcagagaacactgaggttcataaatgtcaaataacctgcctggaggaatcaggtctgagaacaaggtccgtgctcatgaccactgggtggaacccttctcaacatggtacccgtggtcccagagtcacaggccttcttaagatgtgaaatttggttagagatcaattttctatctctgaaatcatcatatcccctctcaattcttatgtgtttataggaaaggacgtgtcaacatagagacttaggaggtcaaagtgaacttcctgatccccaacaggcaggagtcctgccaaagccaaaatttatgtgtcaccttggaagatgatgcaccaggaagaatggggaggagggaggaggaaaaactgctgatgaggccgactcgctctttggggcttatcatatcagcaaagccagctcttttgagatggaagaacaaagatgtttctcctctgtgaggaggtgacagtggtgtgctgggtgaaggagagcagctttgtcctggaaggaatctgacttggaaggaggcccagttgtccagcaggtacctgtttcctttctgctctggcttccaaagggctctctgcagagccccttcccggagctgctggcaggaggtcctttgcttggggggcgatccatggggacgtctggagcagtgggagcctatcttgggacctggatgggagctgctccacctcagcacccgggttatgaggcacagggctgggcaccacgagggcatgggtgaaagtggcctggatttggatttcagaagaactgggcttgagtcctagttctgccataaaccatgtgactcttaggcagtcactttatgtttttatttctttggcagtaaaactgtcattacctacaatatgggaattgtaaggaactactgagaaaacaaatctcaaaatgttctgtgcagactctcaaatactgtgcaaatatcaagctgttttaaaatccagtctctgcctttgagattttacaatctggtgagcaggtaaacacaagtacacataacaagagaacagtttccatttagtgctgggtgatgggaacagacagcaaatgctttgagtttgaggtagtgggctggggtgatcagggaaggaaacacagggaaggcagaccttgaatgttttttttttttgagatggagtcttgctctgttgcccaggctggagtgcagtggcgtgatcttggctcactgcagcctctgcctcccaggttccagcaattctctgcctcagcctcccaagtagctgggattacaggtgcccaccaccacgcttggctaatttttgtatttttagtagagacggggtttcaccatgttggccaggctggtcttgaactcctgacctcgtgatccacccgcctcggcctcccaaagtgctaggattacaggtgtgagccaccacatccggcctcgaatgggtttttaaagatgggaagacaagctgggtcactgggcgctcccacaggggaagcatgagccaaggtgcggcagccgctctacacacaaccggctttagccatcaggtgcgacagaggctgcacaccggtgacaaattagagaaatccaatctgcacgtgtgttttacttgcaccacacagtgtttgtttaatatcatctggccacttaagacagggagatttaaaatgaaaaatccagatttcccattcttctttttttttttttgagactgagtctcgctctgtcacctgggctggactgcagtggcacaatctcagctgaatgcaccctgtgtctcccaggttcaagcaattctcctgcctcagcctcccgagtagctgagactacaggcatgcgccaccatgcccggctactttttgtatttttagtagagacaggatatcaccatattggccaggctggtgtcgaactcctgacctcgagatccgcccgcctgggcctccccaagtgctaggattacaggcgtgagccaccgcgcctggcccagatttcccattcttttaaaaaccagaagacctggccacactgggtcctcttccccagccagtactgatcctctggagtttctgagagggttcatgccacacccactccattgcctgctgcctttcccacctactccagttaactcactccataaccacctgacctgtcagtgtctgggctcatgattcctgtgtaaacaaaaccttctattgggaagaaagttttatgaagggagctgtatgaggggagacatgggtccctagacaccctaaaggagagactgaagtggacccaagctataaaccctcccctgtcagccagcttctagctgccaccaggcctactcctgcacacctgacatctttgcccacggtcatcgatgcaatcactttcttcactgcctccttcttcttctccttcttgtcactgttgagctctgccttcagctcgaagatctcccctaaggaaaggaggcaagcatgagtgatccctccctaccctggcaggggacaattcccagtatctaacttccaaaagaaccggagggaggcacgtaagacatcctatgctgttggctgagggaagcttcaggcgcctggcctcaggtgggccaggcaacagtgagggatgactgttaggacaggaattaacaagatggaaacttgtaggccgggtgcagtcgctcatacctgtaatcccagcactttaaaatgctgaggattggccagcacagtggctcatgcctgtaatcccagcactttgggagtccgaggcaggcggatcacgaggtcagaagatcaagaccatcctggccaacatagtgaaaccttgtctctattaaaatacaaaaaattagccgggcatagtggcgcgtgcctgtaatcccagctactcgggaggctgaggcaggggaattgcttgaatccgggaggtggaggttgcagtgaggcaagatggcgccactgcactccagcctggcgacagggccaagactccatctcaaaaaaaaaaaaagaggctgaggattacttgagctcaggagtttgagatcagcctgggtaacatagtgagacctcgtttctacaaaataattttttttaattagccgggtgtggtggcatgtgcctgccgtgccagctactctggaggctgaggctgaagaatcgtttgagcccagagatcgaggttgccgtgagccatgacaccactacactccagcctgggggacacaaagtgagatcctgtctccaaaaaaaaaaagtttagaggccactctggattgaagcaacaggaaccatggaagctacaaaggttctgaggaagacaaaagcatcaaaaacatgatggcaggctctgctcagccagggagctaaaaccccagtggaaggcaaagctgtcctcagctaccctcactcaacaaaagacccttaaaaggctcagtgcaatagaacctgagtacttaaggcttgcggggtgagagcaggatttgtggattcccacatgaaggcctttcctgttttcctcaaacctctaattaaaacagcttgttcagggtttcacttcctgagacacaagtggttggttgctcagctctgaaaacaggaattcagctgctccatgagagctcaagcatgaaatcaattgttctgaagaacttcatgacatgaaaaaaacaaatgaggaagcagggttgtctggccctgccatggacagatagtcaggaccctgataacaggttaggagggcagatgtcatttcctgaccccttctcttttattttttatttttttgagacagagtcttgctctgtcacccatgctggagtgcagtggccccatctcagctcactgcaacttctgcctcctgggttccagcaattctcctgcctcagcataccgggtagctgggactacaggcgtgcgccatcacacccagctaatttttgtatttttagtacagacggggtttcaccatgttggtcaggctggtcttgaactgatctcgtgatccgcccgccttggtctcccaaagcactgggattacaggcatgagccaccacgcccggccattttttttttttgagacatagtctcactctgtcacccaggctggagtgcagcggtgcgatctcggctcaccgcaacttccgcctcccgggttcaagcaattctgctgcctcagcctcccaaatagctggaactataggcggacaccatcaaaccctcctaatttttgtatttttagtagagacggggtttcaccatgttggcccggctggtctcaaactcctgacctcaggtgatccacccgcctcagcctcccaaagtgttgagactacaggcctgagccaccatgcccggcccctctaagcccttctctaagcctagtcccatactaacttgttcccacacattttcttatttcatcctcacaactctgcatttccctccgttttgcaaatggaggctgtgagaggctcagtaacgtatagccaatgctggtagggggcagggctgaaactgaaaaccaggtctgctagctccaaagcccatgctctcaatccctatgcttgggcctacccaagatacccactttgctttcctaaacctgtttccttgtctctttggctggagcattgaacccaggcatgtctgtccacacatctctcttcccaaaagaaatccactaaaaaaccccaaccccaaaataaaaaaaatagctgggcatggtggcacgtgcctgtagtcccagctacttgggagaattgcttgaacccaggaggctgcagtgagcagagatcttcccattgcactccagcctgggtgacagagactctgtctcaaaaaaaaacaaacaaacaacaaaacccacccctgggactccaatacactcagcactacgttcaccctgtggctcaccaggctccacaagactgatccctgcgtacctctccaattgctttctctcttttttcaattagttgcccaggctagactcgaactcctgggctcaagcaagtaatcctcccacccaagccaccacctggggcgccactgtgcctggctctaacctcttcttgtatcaccctcctcggtagctcatgcccactaccttcctttccccaaatgtgtcacaggcacagcactcactccttccccttcctatcccccatcgatctggccagctccacccagagctctcccacagtcccccctggacccagtacacttcagtgtggttactactctacagactgtcttccctgctcaaccttgagcaacaccaggtcagaggctctgtttcttttccactgcacatggtaggttctcagtaaaaaccagctagaccaatacatgaaatgcctgatgaggggcagacttcgggtcctggatcagctgatccagcaacagactcttttcatctggtcggcaggcatgtgtcagtatcacttggaaggaaggagggaggaataaagggctggccagaaagatgcttacagggttaaagcacatttgtcagccacgacgacatcctccatttccttaaaagcagaaacaaccaaaatacccaatgatataagcctagcttagcaaatttcagtgtagctactcaatagacttaatagtgagtcattagaattgttgggaaatgtttatgatatcaaaacatcaaatgaaaaacaggattaaaacgatgaaaatacatgcctgaccggccgcggtggctcacgcctgtaatcccagcactttgggaggctgagggggcggatcacctgaggtcaggagtttcagaccagcctgaccaacatggagaaaccccgtctctaccaaaaatacaaaattagccgggcatggtggtgtaatcccagctacttgggaggctgaggcaggagtatcacttaaacctggaaagcggaggttgtggtgagctgagatcagcgccattgcactccagcctgggcaacaagagcgaaactccgtctcaaaaaaacaagaaagaaaaattagctgggcatagcggcgggcgcatgtaatcccagcaattccggaggctgaggcaggagaataacttcaactcgagaggcggaggttgcaatgagccaagatcgcaccactgcactccagcctgggtgacatgagtgaaactccgtctcaaaaaaaaagaaaaacacgtgcccttggataaggacacacacacacacacacacacacacacacacacacacacacacacacaactgctgtgggggtgttgataggattctgtgttttctttcccctggaaaaaaacataattattttaagccatgggaaataaaagggcactttttttccccacacttggagctaatgttcttccctttctgagctctaaaaggagtggtcaatttcttatatcatcaacagttcaattttctagatctaccacaagctctaggccattcctgccacatgtttccaggccttcattcccacccctactccctaccgccataggaggaaaacagaagggacaggaagagaaagcataggacaaggcccattattaaacaagtaatacctttcttggtcgtggtgaaatattttgagtcagtcattttggtcccttatctgtagccaggcttctgcaagagagagaagagaggggtgactttcagttatgctccatcccatcttcagttatggtgcagagggaggagaaggatccagaacacatgtggtacaggaaaacagctgcttatctatttcctggagaaacaaactttagatcatggcagattagattttgaaaagtaattctgaggaatctatcaaccttttttttttttttttcttcagagatgggatctcaccatgttgcccaggctggtctcaaactcctgggctcagccaatcctcctgcctcggcctcccaaagtgctgggattacaggtgtgagccaccacacctgatcccatcaaatttttgaatgtgcctcttctagaaatctttcccacaaaaatatctgcacaaggatggatgggcttacagcagcccctttgtgggacccactttgctcagcactgtcctaaatgcttggcacacattaactcattaggagcctcatcacagcatcatcaaggcacgatattaccctatacagtcaaataagattagaaaataccaagcttaaaaggctagggagacttcttctccccacaacttttctaagctgctaaaatagtaacatgcctgattcatctctggaaagggctagaatctgtactctacagcagttcccaaatctacctggccagttttcttaaaggctctctcaggacatctcctagcgcaaagctcacagcgtgaagtactattgtagacaataggggctgggcaccacagctcatgcctgtaatcccagcactttgggaggctgaggcgggtggatcacctgaggtcaggagtttgaaaccagcctggccaacatggtaaaaaccatctctactaaaaatacaaaaaattagccaggcgtggtagtgtgtgcctgtaatctcagttacttgggagggtgaggcaggagaatcactggaacccaagagactgaggctgcagtaagctgagaccacaccactgcactccagcctgggagacagagcaagactctgtctcagaaaaaaaaaagacaataggacaaagaaagtactgaagctctgccattcatttaacaaaaatcatttaacaaaaatttactgagcatctcctatgtacctcagtagttcttctgggcaacagatgaaagaaaagaagttacacaggaaccaagataccctagatacatttattaagaatctatcatttactgagcccctattaaaggcaggggcttcgcccacattatctcacttaatcttgtcaataatgtaactgctttgaatcccattttacaaatgatgaaacggactcagcgatgttacatgacgtgcccaaggtcaaatggcttgtaagtggctgggctgggagaccatctcaggcctacctgagcttagttcctatgctctattgaaggaattctgtttcccccttctgacgaggaggacagttccctgatagtggctaaaggattcagtcaaaaaaaaaaaaaaaaattgaggccggacgcagtggtgcacacctgtagtcccatctacttgggaggctgagtggcacaagaagcacttgaacccaggaggcagaagttgcagtgagctgagactgtgccacagcactccagtgtggtgacagagcaagactctgtctccccgccccacccccgcaaaaaaaaaacacattgagactttcaagtacagccttccaatcctacctgtagttttatgtggtatagaaaaccacacaactccaaaaaacagacatttgaatggagaaaacccacttcactttatctcttttgttgcgtctatggaagggactcaaacaaataacccaccaatatctcctttcaagtcattactatacgggggcaagatgaaagttactagtgcaacggatgtgagggatcaggagtcatttcacagcctctggaaaccaagccaacacagcacctcctctccagcccaattggatttttccaaattaagcttgtatttatggcaggatggcactgagcaagcctcccaaccgagagacacccatagattttgtttcagtaatcactgggaaacaaatacgtactgtcttggggtcaccttaaatcctttgtggatcctgaaggaataaaggaataaaggcttcactgacaaaacagtacaaaaaaaggcacaattctacttcccttttgctttgcaaagttgaaaaggaaggatggcacttttctatgggagctgcaggaaagagcagaagagcccactgcgtctgatgttgcaagtcccacagtggggactctaaacttgctggtcctcccagcatgagtcatggctgtagacagatccacaaaggaaggccccgcatgcgccaggctcacagctcccgttcgccctcctctttcatgcctggcccaggcccggcacatagcaagtattcaattgatagttgttgaaagaaatgaaaaggggccactgaaaatcccagggagcctcagcctgctctctggcagccctgttacgtaactagttagcatttgtttccaacaggaatttaccgacattaaaaacgatttttttttttttttttttttgcacacacataaagccattttctcaaagaaacctcaccaacctaggggttctttggggacctctgaaaatgggcaggtaaatcagataatgggatttctgtcttacaataaagatctgcatggttccagaagtcacagacttgagagtgtaactgccaaaagtatccaaaataataggataatatcatttctcaaggttgagtgtaagagggataactgaagacaaaaggggctaaaactcacaggccacaaagaaacacagaaagtaacacagaaaccactccaacattaaatctaaaaagaaacaaaagtggccgggcgtggtggctcatgcctgtaatcctagcactttgggaggctgaggtgggcagattgcctgagctcaggagtttgagaccagcctgggcaacatagtgaaaccccgtcgctactaaaatacaaaaaattagctgggcgtggtggcatgtgcctgtagtcccagctactcgggaggctgaggcaagagaattgcttgaactcaggaggtggagactgcagtgagctgagatcgtgccactgcactccagcccgagcgacagagtgagactcagtctcaaaaaaaaaaaaaaaaagaaagaaagaaagaaagaaaagtgaataaaacaaacaaaataccttagataactaatgtgagagctgctcggaatttcttgcctctccagaagaaaaagccgtcagagcctgtcccctcccctgcaggcccaatacaacatcagagggccctaaattcccaggacgcaacctgctggtgacagatgggtgctgtatgcaactgaccaagaggagaaacgggtgagaaagcctttctttctggggatttaaaaaaaaagtgacagagctgcagggtagctggtcaaagcacagctgcagggtagctggtcaaagcacagctgcagataccccaacagcgctgagctttccgtgacagtcttccttttacaggtgctaagcaactactcacaaacttaactgccactcagtgcactggtgctggctgcagcttttttccgcagtatctgtttcacatatccctctgcagagggcccaatgggactgatgatgcagaaatgtatccctctgaagttgtttcatatgcaggaaattaaagtagagaagggaggagatgcggagaaaagtgaaacgctttagaaagccaccccaaaacacagataacaaaacaaaacaaaacacctcacttcaccatgaatgattccctacctacagcttagtgatgtactgagggcagctatctcctcgtgtcctttctccattgtgagcacctaatgctggtacctggtcttgcagttgcctcttggatggatatcagtgcaagagatttctcattctctccgcaggaatggaaaaaaccctacagttcagtcctaacggggctcagactcatagatgccatgagaaagactggtgtttttcctggcacctgcttggctgttatcatgcactgtatccctaccccatagaggccaaaggggctgagaccttgttctctgatgaatctgatcgggtacacgaatcatatttgaaagcaggcagcggctgggcgcggtggcttatgcctgtaatcccagcactttgggaggctgaggtgggcagatcacgaggtcaggagatcgagaccatcctggctaacatggtgaaaccccatctctatgaaaaataaaaaaaattagccgggtgtggtggcacgtgcctgtagttccagttactcaggaggctgaggcaggagaagcatgaacccagaggcggagcttgcagtgagcagagatcgcgccactgcactctagcttgggcgacagagtgagactccgtctcaaaaaaaaaaagccagcaaatttaggcaagaaaaagcttagggtttggattccatctttggaagtgtcagggcaaattttttaaagtggttaattacggggaatttttgattcagaaactgctctggccagtataatgagtcactttgctaaggagacagcattctgggctgggatccccccctcaatttcagcatttacaggccaagaaatgcctcaaggggatggcatggtcaaaattaaaagaggggcatacctggaacaactggtttcacccttgaggagccagtgtggctgtcctctcttaatcttaatatttctcacacccacatttgaaagattatgactttgatgtcacatcccagaaacagttctggttaacttcattttttagaattaaagaaagggaactgaggctgggcatggtggctcacgcctgtaatccgagcagtttgggaggtccaggtgggcagatcacctgaggtcaggagttcgagaccagcctagccaacatggtgaaaccccatctctactaaaaatacaaaaaattagccgggcatgctggcgggtgcctgtagtcccagctactcgggaggctgaggtaggggaatcacttgaacccgggaggcagaggttgcagtgaggtgagatcgcagcattgcactccagcctgcgcaacaagaacgaaactgggtctcaaaaaaaaaaaaaaaaagaaaaaagaaaagaaaaggaactgagcaataaagcctaaaatatagtagctttctctcttatgttttctagatgtataaagaagcccttggtgagacttttggaaacagtgtccagggacaaagatgtaacatgatctaagagagggaaaaagaggtcctaggtcctaaggaaaaaaaagggaagaagaaaaaacatttccatctaaagactttggtttttagctgctgaagttagggttaggcttaaaggaaaaaaagttctcaatatttttcaaattttgtcttcatatatctaaatataattttaggaacaagaaatatagactatctttctgtgttttaagctaataaaatgaatttatatctatttttaaaacataagaaaatcacctcctttgagaatgaaaaaaataaaaacataagaaaatgggtactaagtatagtatttcaatttttctccaatgtctcaaaattggtgacaacctttaaaaggaaagtatgctgaactgagtctacttcatctccatagttcaatttccctctttaaaatggggagatcaagccgggtgttgtgggtcacacctgtgaataccagcaccttgggaggccaaggcggacaaattgcttgaggccaggagtttgagactggcttgggaaacatggtgaaatcctgtctctaccaaattagcatggtggtgcacacctgtagtcccagctactcaggaggcggaggtgggaggactacttgagcctgggaggcaggaggttgcagtgagccaacatcgcactactgcactccagcctgggtgacagagtgagaccgtgtctcaaaaaaagaaaaaaagagtggggggtggggactgctgtacctgctcttctgtgtatttcacatatttcttctgacaagggctaatgtgagaatgaaagcacgttgacaagaaaaaatgtaaacatcataaatatcacaagatttcatgtgtacaaagctctaagaggcaaacctaagctacggtgataacagtcaggtcagtggatgcttctgggtgggaaggactgaaagtgggcatgaagggcccctgcagtaagggaaatgatctgcatcctgatgcagatactggacacactgtacacttaagagccaagcatgtcacttggtgtaaattaaacagacattttaaaaaatgtgctgggcgcagaggcctgtaatcccagcactttcggaggccaaggcgggtggatcacctgcggccaggagttcgagactggcctggctaacatggtgaaacccgtctctagtaaaaatacaaaaattagctgggcctggtagtgggcacctgtaatcccagctacatgggaggctgaagcacaagaatcgcttgaacctaggaggcagaggttgcagcaagctgaggtggcaccactgcactccagcctgggcgacagagcaagactcggtctgaaaaaaaaaaaaaaggcaaggcacggtggctcacacctgtaatcccagcactttgggaggctgaggggggtggatcacctgaggtcaggagttcaagaccagcctggccaacatggcaaaaccccatctctactaaaaatacaaaaattagctgggcatggtggcggtgcatgcctgtaatcacagctacttgggaggctgaggtgggagaatcgcttgaaccccagaggcagaggttgcagtaagccaagatcggcgccactgcactccagcctgggcaacagagcaagactctgtctaaaaaaaaattttgtttttaaaaaaataacaaaataaaactcaaatctggagaagaaaggaagaatgaaacattgcatccagaggaaagtctttggagtgtgacatcaaatctggaaatcttaaaagaaccatgaattcaattccataaaaattgagttttcctgcatggccaaaacaataaaaagccaaaagccgtatgataaacatactcactaacatttgcatcacattgcagacaaggcctattttcctatataaaaagtgactacaaataggagaatggcagaggatgtggacagttcacagaaagtgaattaatataatggttcaagcttatttctaagagacacagaaactgaaactacggtgaaatataacctgtcagctgctgaactgataaagagccaagagtctaataacaccccatgttggagctgacataggtaaataggcgccctcatttgaggctagtgatagtctgaaacgctacaacctctgaagcaaatcggtaacagccattaaaattgcaaaggtccttacccgttgacccagtaattctgcttctaggactttacatgtggaaaactacgtagatacaaaattattcatgcaacatcctttctaatagcaaaatactgtaaatgtccatccacaggattgttttaaaaaatgacagcacagtagagctgggcacatctgtggctccagctactcaggaggctgagtggtgaggatagtttgagcccaggagtttgaggccagcctgggcaacacagtaagaccccaactctatacataaataaaatgatagcacagcatatggacatatggaatactatacaaccatgcaaaagaataggcagttctggccgggcgcggtggctcatgcctgtgatcccagcacttcgggaggccgaggcaggtggatcacaaggtcaggagttcgagaccagcctggccaacatagtgaaaccccgtctctactaaaaacacaaaaaaattagtcggtgtggtggcacacgcctgtagtcccagctactcgggaggctgaggcaggagaatcgcttgaacctgggaggcagaggttgtagtgaggtgagactgtgccattgcactccagcctgcgtgacagagtgagattccatcacaaaaaaaaaaaaaaaaaaaaaaaaaaagcatctcagatttccccacagacttcctcccctaatttgggatctgtcctgttgaatgctgtcaacccagtgactgccacgatgcctggcacattctaggagctcaccaaatgtttgctggcaaaatgaatgaaaagacagtttcccagagaagctacaaaaccaagggcccaaaacagattaagatgagagagctgtgacaagtgccagacagtgatgactgggcagaccagactgggaacataaggctttgcagttaacatggcaaggctgatgcaatgtcaagatggctgccaggaaatctggccctactaccaacagctgtgtgaccctgggcaactacccccatctctgggcctgcctttctccaaatgtcaaacaaaagaatatgattaatcaatggctcaagtccctctctactcttaaaccatttcaaacagataaaagtggaactgttctggtggaaagaagggtgggaggcctagagcctggctcatttcactatgcctacctctccccatcctcaccacggcccttcagacatcccgtggttctatggagcaaagcttgaaaaccagtctactgaatgacaaatctctcccacatctcacattctatgattctctgctggatgaggggcccatttccctaccaatgagtgttcttcccaggtgtcaaacacgaggaagtagagtatgatcattctaagaacatgacataagatgtttccaaagggaaaaaaagagaacaaattcagaatgcagccaaggccagcaaaccccattaggtcttctgtaggaaggaaaacagtaagaagccaaacaacagagtgtttcaatttctccaaatggccagccaatgtcaggggaaggccttttctagtctccgggcaatgattcatgtcagagcagcccatgctcttcaatcagatgagaagtgtgaagttggtggtggcagcacaaggcactgcacactcttggcactcagtgaattaatgaaggagaccatcagtgtggtgagatgaggcagagaaaaagctttaggaaaggaaaaggggaaagagacatttcacaaggtcagatccagttgcatctctatctctgaactcaaggacattcaagcagggaaaactgatctctgaaggtctatgttggtggcttccaactttggtactggaactgccactgttaaacacttccctaatgaatgaatagctgtcagaaacctgctccatagaacctgttagctcatggacagtcaagaggaagttagggaagagtggaaaaaaaggggctggggtgatgccactgtttcttcttcatttggagcagaaaggccaaactttgttcattccatgtgttttgctgctttggttctgtttcaaaggcagaggttaattcatttgacaagtattcctctactctgtgccatgccctggactgtgtacctgctcccacaaagcttagagttcgttagagatgatgacgctattcaccactcctcatttgtctgacaatctccttttaaaaagggaaaggggccgggcatgctggctcatgcccacaatccagcactttgggaggccgaggtgggaggatcacttgaggtcaggagattgggaccagcctggccaacatggtgaaaccctgtctctactgaaaatacaaaaattagctgggtgtagtggcaggtgcctgtaatcccagctactcgggaggctgaggtggaagaatcgcttgaacctgggaggcgggggttgcagtaagccgagaccgtgccactgcactccagcctgggtgacagagtgagaccctgtctcaaaaaaaaaaaaaaaaaaaaaaaaaggaaaaaggtccttataggtaaatacttaagttcactttacagacagggaaacaggtaaggccagctggaagactaaaaggtgagtcagcagtagaaaaaccagatttcagactttctctctgagaaaacgtggttaccaaattcagacaggctcttccaagtcagttcaatcactatgagaaaataatctgtgttctttaggctcagcatgaaatttggaacaaaggtggcagtggtagtagtaatggtaaatggatgtgcaccatgtgacagacactatgtaaagagctttaaagttagtcctcgtggaaaggcgtggtggttcacatctataatcccagcactttgggaggctgaggctggcagatcatgaggtcaggggtttgagaccagcctggtcaacatagtgaaacctgtctctactaaacatacaaaaaaattagccaggcatggtggcgggcgcctgtaatcacagctactctggaggatgaggcaaggagaatcgcttgaacctgggaggcggaggttgcagttagccaagatcgtgccactgtactccagcctgggtgacagtgcgagactctgtctcaaaaaaaaaaaaaaaaagttagtcttcacgataatccatgaaggttttaatattatcacaagtttacagatgaggaaactgaagtaccagggaggtcaaggcatttgtttggagttacacagctagaaaatggcagtgccggcactctccactgctgccccctaataaggtcacacatgtcccactctgtccagcaaggcaactaactgctcctctctgaatgaagccctggcagaaatatacatgctctagggtaaagggtatgtgaaatgggttgccacacatccctgcagagtccctcagatgttgaattacaggttattttagggccagcccagccggtttggacaacagggaacgtcaagtttggtcatgtgcctagtgaaagcctatctgggtgcgcttgccaagttatgggcctcctgggatttggatgaaaactgattagtcaaaatcaatctcctggccgggcacggtgacccacacctgtaatcctagcactgtgtgaggctgaggcagacagatctcttgagcgcaggagttcaagaccagcctgggcaacatggcgaaaccccatctctacaaaaatacaattagccaggtgtggtggcatacatctgtagtatcagctactcaggagcctgaggtgggaagattgcttgagcctgggaggttgacgctgcagtgagctgtgaatgtgacactgcactccagcctgggcgagagaaagaaactccgtatcaaaaaaaaaaaaaaaaaaaaaaaaaggccgggcgcagtggctcacgcctgtaatcccagcactttgggaggccgaggcgggcggatcatgaggtcaggaaatcgagaccatcctggctaacacggtgaaaccccatctctactaaaaatacaaaaaattagctgggcctggtggcgggtgcctgtagtcccagctactcgggaggctgaggcaggagaatggtgtgaactcaggaggcggagcttgcagtgagctgagatcgtgtcactgcactccagcctgggcaacagagcaagactccgtcccacaaaaaaaaaaaaaaaaaaaagtcagtttcctgaggcccactagcaattaaagacttcagaatgaaaaggaactaaaggcagacaaatgtcacatgcaaacgttcttatattggctttgagtctctagaactccattctagaatcaggtaccagttctgaactgatctataagccgtaatgtgcggaaagatctgctgtgaagaaaaaaaagtgatgggcgcagtggctcatgcctgtaatcccagcactttaggagaccgaggtgggcagatcacttgaggtgaggagttcgagaccagcttggccaacatggcgaaacctatctctactaaaaatacaaaaattagctggacatggtggctcgcacctatagtcccaactactcaggagtctcaggcaggagaattgcttgaacctgaaatcgcaccactgcactctggcctgggtgacagagcaagactccatctcaaaaaaagaaaaagttcctctggacttgaaaataaagtaagtaaggcttcttctgaacaatacttaaattaatcgagatgaggagaaagaggccagagactacagaacaacgctctttgtgatctcggttttcccatctatgtaatgggaacactttctgaagatctgtcaaattaacagtgtagagcaccatccgctccatgcctggaactgtgccccacacggaagcatgcacacagtaaacaaaggacagtcttttctcactgagctcttacagatttagaggccaggtaaaggactgcaggggaacggcagagtgatcatgcctccagaggaggagggttctgagataggtggagcagcaagggaagttctcttagatgaagaggggcttggctgacgcaaaaagacaggtcagatttagagaggcaagagtggaggtggcaaagagatgcaccacgaaattgccaatgtgacaacggagggaactgacaacaattaaatcaacactagctggggaacggcttcttgctaagtgatttacaacccttctcatttaattctcagggtaattcagttaaaaaacaaggaattagagacactgagagatgagtgatttacctaaggccaaaacaagaagtctgtgagccccgctgcctggctgaaggaaaggacctggaagggaaaggagcagacgaggctagggaaggaagaatgagattcagaaatggttctggatgccaggtgtgttgggtcctgccaggagaagacacaatggtcatgtcaaatgacaagtctcatgctgataagcatttgacactactgatcactccctccttcctgaaaacctgtcttccctcaaatgctaggatgccatgctctctgcctgccctcctacgccactgtctgcgccttctcagtctcctttgcttgttcctctccttctccttcaacactgtgtgccccagggctcaggcctggtacctcttctcttccccatctatgctattttgcctctttggtggatcatccggtatcacagctttacataccatccacatagcccaacctctccccagaacccccgggcacacatgtccaaactgtgtaactgacatctccacattactgtggagatgactagcaggcagctcaaacaatgggataaaaactgacctcctgcttccttcctttccccaactggctcaccctgcagtctacatcatctagttcctgccagcaccatctttaagagggcctcaggctaaaaacctgagtcactcttaacaacatactctcctttaaatctatcggcaaatcctattggattccgaccttcaaaatgaatctagaatccatgagcagcttctcactagctccatcactaaccccagctccaagccagcatcaccttccatttagagtgctaacaaagctgctcccacactgctttgctgacaccccatctcagcaacagccaggatgatcctcttacagtccaaatcagacagtagcacccctctgctcaacgtcttccaacggttctctgtcttactcatagtaaaagccaaagtccctaccatggcctcatagcccacaggtcctataagagatgcatgcccctcctctctcacgcatgcaccctgctggccattaccctttgaactcttctccccatcattccctcagctccagccgcacaggcctctttactgatcctcgaacacaacatgcatccaccccagggcctttgcccgtgctattcactttgctaggaaggctctttctccagacagcctcatggctcagtccctcacctctttaggtcttggctcaaatgtcatcttctcattgaggccttctttgaccattttatttaaaattgtatacccctcccccataatccccaccacttcctaaccctctttgccctttttcccttcaaagtacttattacctattacctacacactataaaatatacttacgttgtctattctttctccccctataaattccctaatgtaaatgggggtaaggattttgtccattttgttcactatcatattcctgactcctaggctggtacctggcaaacaggtgttcaataagtagctgaatgaccagtgctcaactctcttcttgggcaaatttcatgttttgtaaaccaacctctgctagagcagcttctccatgttccattcacggggttatccaggatcagagatacatctgctctgattgtcaagctattctaactatactgaaattgaacatgccagacccctagcacatttacagccaataaatggaagttaagtgaataaattatgagagagagaagaaatggcaagggtagaagatcaggtggcaacatctccagtgggagaaacgttcagtgaggccaagtcactctcacctgctcccataggtatcagctcagagtgacagagctgcagaaggtggggggctctggcacaggatataagtaccaggtccttgcctccaggcccacatgccttctttgttcctctaacagccaactcttcactatctctacccttgctgatccttctgcttggattatcctctcctaactgctccaatttatccttcaaatctcagcttagatgatctcatttcaaagataacttcccttcagcgtgatacctctgatgcttaaaaaaagaaacaaaaaaaaaatacctttcctacatgtactatcttttttgttgttgttgctagagacagatagtcttgctctgtcacccaggctagagtgcaggggtgtgatcatagctcactgcagcatcaaactactgggctcaagcaattctgcttcagcctcctgagtagctgggactacaggcgtgtgccatgcccagctaatcttttcaagttttttgtggagtctcgctaaattatccaggctggtcttgaactcctggcctcaaatgatcctcccacctcagcctcccaagtagctgggattacaggcatgagccacggcacctggccatgcatgtacaaccttaagaaggtatttctctgtccacatccttcagtgttcttattcatacatttcctgagcatctttcgtgtaccagaaacacttctacatgttgggaatgcaggagtgaaagaaacagacaaaaatccttccctacatggagtttatgtcctaatgggggaaagagaccgtaagcaagataagtgagtaaaatatataacatcttagatagtgataaacacaatggaggcaaaaaagaggagggaaggaggatagggaggggagaggggaggaagggaagttaaaatttaactagggtggccatagaaggcctccttgagaaggtgacaggtgacactgtctgcgaaagagcctgccaagcaaaagagatcgccagtgcaaaggtgagtatgtgcctggcatgtctgaggaacagaagggaagtgaatgtggctgagtgagcaatgaggaaaacagtgggtcaggaagtcacaggagaatgcagggggccttatgatcaagcgtgaggtctctggcttttactgagtgagctggagccactggagggttttgagcagaggagtcctgacatctgacctatattttaataagttctggctgctatgccttttgtttcccttgtggcttattggtttttctaatcattgcatttttttctctacttctttgtctctctctcccattaaaatgaagtaagcaactagagggcttatctgaagcctgaagccatatctggcctgttgacctatcagcataggccagcaccaggcattagcaggcctcgataaatactgaatgaatactggacttagaaagtctctgtcctcagtgtcccagcagccagccacccaatactcggagatcgggcaatgaagaccaccacagcagcagacccaaggctggctctactgaaattgtgttattctgctcccaataggcttaagatcctaaatgtaaggagggtgtggtaaaaagtatctaccacccaagtctattcctctatggaactcagctactgaaatgccaaaaatgaacactgaaggttcagttttaaagcttttgagacctgggccgggtgcggtggctcacgcctgtaatcccagcactttgggaggctgaggtgggcggatcacaaggtcaggagatcgagaccatcctggctaacacggtgaaaccccgtctttattaaaaatagaaaaattagccgggcgtggtggcgggcgcctgtaatcccagctactcaggaggctgaagcaggagaatggcgtgaacctgggaggcagagcttgcagtgagccgagatcacgccactgcactccagactccgtctcaaaaaaaaaaaaaaaaaaaagcttttgagacctgactttcaaacctaccaccttccagctccgagtccacagggtagactgtggtaattggtggtaacctgggggatcagtgactaaggcatcccagtaactgatgaattctgggccttgtggggtcaacccagagttaggccacactcataccacaactaggagaggcctcccttcctgacagaggtcagaggtcaagtccaaggctaaagacccagacagcatgaggtgtaggagtgtagaaccatagccaagtccttcctcagctccactatataagaggggacaatctaaacacaaggagtgggtaggtgaaggcagccattgcaggtaggacaggggctctcccaggttctacaaagcaaacaggcacaactgcagcacaactgtaaaatgggaactacaatgttacatgcctgaagggtttgtgaggctaaaacaagtcaatacatacctagcccttagcagtgcccggcccacaaaatgcctgataaatgttagccactattactactaccgagagagagagagtttaccacttccctgctccgtaccagattcccaggtctctggaagccctgaaacaccctgatggctgtctggtggtaccaactgtagtttgaaagtagtctcagcactgatcagatttctccctgtctctatgaggtgacatgaggatggacaggagataatctagaaagtgctttgaaccccttaggagtcaaggaatcctaacaattcaatgcaatattcattcattcactcattcaacacctgctgagcaccaactatgtaccagacacctcactaggtgctggagacgtagttaaggcaggtcttcgtcaaggattaaaagctatttactggccaggcacggtggctcaaacctgtaatcccagcactttgggaggccgaggcaggcgggtcacttgaggtcaggagttcgagaccagcctggctaacatggtgaaaccccatctctactaaaaatacaaaaattagccaaacatggtggcaggtgcctgtaatcccagctactctggaggctaaggcatgagaattgcttgaacccgggaggcggaggttgcagtgagccaagatcgcgccactgcactccagcatgggcgaaaaagcgagactctgtctggaaaaaaaaaaagagctatttacttagaagagagccaaataaacaatcacaacccactgtgacccttgccagagggcatcaaggaggggcatctagctcagacctaggggtgatgatcagatgggaagaaccaagtagcactccagctaggcaggtaaggttgggagagcaggaaatggtgttcaggcagagggaagagtgcaaagcaaagacagagaggtataaagagttgggaggccaggtgtggtggctcacgcctgtaatcccagcactttgggaggcccagacagaaggactgcttgaggccaggggtttgagaccagcctgagcaatatagcaagactccatctctacaaaaaataaaaacaatttgccaggcacagtggcacccatctgtagtactagctacttgggaggctgaggcaggaggatcgttcaagcccaggagttggagcctgcagtgagctatgacagctccactgtactacagtctgggtaacaagccaagatcctgtctcgaaaaaagaaaaagagttggtgcttgcagaagtagcaagtagctgaggttgactggagcttgggaaaaggtgagtgtggagcaggagagatgacaaaagagagctaggcaggggtcagagtccaaagggccttgaatgccatgctaaggaatgtgagttttagcccgagggcaactaggagccactgatgaattttcaagcagaattttctttaaggattccccaactgctctgttgacattttttctcaggagtatttgttcctctccatgtgaagacataaagaacagaaaaatcacttctgggctgtgataatatcaacgatgtctcttaggcaaaaagacctgctgagaaaaagaaatgtctgcaaggcacagatgtcacctcaaccttcagaaacacagcgaagtgcaaaacccaagccatgtttgcttactgtcagcatgtcaggctttggtgccagacacgggaagttcctgggaagtagttaagacatgcaagagtttcagaggatgactagaaaaagatgcaagcccaagctcaaagccagaaggaccaacaaattgaacttgttctgaactacttttaggaagtgaaacaagaagggtggaaaaagtcctgcgtacattaaggtctctgtttgcagaaggaagtaacgctccagaagccaaggttggcagccttcctcagacacaggcccccagcaggcatcagtctgcctagagtcaaagcacccaaaaatcacaggccctgcacaaattttcccatctaaccctcacacaaaccaggggtagaggagtcagaaagggtggccagtattattttagaactgaggtaaaggagggccagcctatgtcaacggtccaggtcaggtcacactgccaggaagctgctgagctggggttgaacccagggctgactgactgggagtctggtgatctttccatcatacctctgggctcttgaagcagctcagggtgaagcctccactgacctacactcaacagatgatcttcacacaatctctgagggatctgactctttgagacctactgaagatgctcctcatgacagtttctaagaggtcagaggagactggtgggctcaactcaggacagaaaaccagaagctctgagctctgctcatgttcctaccctctgtgacaagttgcttcatctcaaatcctcccttggaaggatgggaatataaggtgacaatattaagtttctgtgaattcaatggaactaggagaatagatcacacagcttaaaaaaaaaaggtattacagtaatatttatatacagctttcttcagaagccatgtggaagccctcacgggttcattcacaggttcatacccctaggagcagacaggaaggcggcaggtctttctcatgttgatgtcagggaaactgaggcagaattgaagcaagtgaatatccgcaatggaatgaggcttagattcatacagcctagtcctccagccaccaaaccgtctcaccacctcccaagtaagacgtgctctgctctggcaagaagccatggggcctgcatatttctcagaaaggcaaagattcttcctctgggtaccttcttccagaacctaggaccaaaagatcccctagaggtcatgtggttcctctctttttagaccaaaacgaatgcagctcaaccactctgaagagaagttctcgacaatcttcaaatagttttcacggatagcctgttttgtgtctcactgttccctaaagtcaggaaaatcttagactcttgccctgaaaggtatcactaatagcaacagcctgtaggattgttttatcctaaagaaagtaagtcgaatgccccttatgaagatcagacaaaaagcaataaggctacatcgtgacataaatccaaataaatacaacggcagctaaaaatcttttttttttttttttttttgagacggagtctcactccgtggcccaggctggagtgcagtcgcacgatctcggctcactgcaacctccacctcctgggttcaagcgattctcctgcctcagcctcccaagtagctgggattacaggcgtacgccaccatgtctggctaatttttgtatttttattggagacagggtttcaccatgttggtcaggctggtcttgaactcctgacctcacgatccacccgcctcagcttcccaaagtgctgggattacaggcgtgagccaccatgtctggctaaaagtcttaaatatcccctacaccccaaccttaactccagtctttcctttgtctctgtactttgcaggtctctgacagcctggcagaaaacctggccttgcctctactacccgaatgaccttacatgtgggatttaacctctctgtgcctcagggtcctcatcgataaaatagggatatttaatccccacaaaggttgctgtgaagtttaaatgtgtcattgtaaggaaagtgcttagcacagtgcccggtacacagaagggactcgatagccactagcaagcatctccctcgttattttgcagcattatcaccggtgtctccattcagttaacttgtcttagaggctccaacaaacaagaccaagccagtgcctagccggaggcgggcggcacgggaccgttttctagtttttttttctttcttctttttcaaccttggcaaagagataacgccctgaacaacgaggaggcctcaggatggccatggaggtgagtccgaaagaggaaatcagagcccgaagagttttccctcaggccagtggggaattcctcggggcctaagtcctgtctctccgggcggaagccccaggaggtgctgcgggtatggggcggccgaggaacaggccggcggccaagtgggcgcgaatgaatgaacgaaccctcagcccttcctcctcctctggctggggacgtcgctcgcgcccctgcagcgccgcgtcctcttcatgacctctgaccccgcaaacccctcacctaggacccctgacccctcgccccacttcttctcctggctcgcccgggtccccgcttcctcacccgcaggtcccaatagctcccggcgccccggctcggttcggcttggcaccaaaatgtccgcggcctccacctctcgctctcccggtgcgtccgggctgccggcggctcggagccccgcggctgtcacctgccgggcggaagtgagctgcccgcgcgcgggtacttccggtggacgcaaggcctgaaggcggggtcaagggtacaaccctggcgggggtggtgcccgtggggcggggcaagaaaaggggaagagcccaacggtattaacccctcggcagccgcggcgctgctatgctgcagtctcccgcagagcccttgggaaaccatcccgctagccaattcagcgtgagggggccgggcaaggtcgtagggagtttgaagtccatcttctgtgtaaagacggcaaatctgaggttctaagaggggcagggttttgctcaaggtcactcattttttgtttgtttgtttgaaatagggtcttgctctgttgctcaagctagagtgcagtggctcgaagatctgggctcactgcaccctccgcctcccaggctcaggtgatcctctcacctcagcctcccaagcagctgggaccacaggtgcgcagcactacgcccggctaattacttattatttacttatttattttttgtagagagagtctcactttattgctcaggctggtctcgaaatcatggacccgagagatcctcccgcctcggcttcccaaagtgctgggattacagaggggtctctctctgtccaaactaggtttacagctctagtttggacccctccattcttaagatgagtgaccttgagccagacacagtggctcatacctgtagtcccagctactcgggagcctgaggcaggagaatagcttgagcccaggaggttgaggttacagtgagctataattgcagcactgcactccagcctgggcgacagatccagaccctgtctcaaaaaaagaaaaaaaatggccgggcatggtggctcacacctgtaatcccagcactttgggaggccgaggcgggcggatcacaaggccaggagatcgagaccatcctggttaacatggtgaaaccccgtctctactaaaaacacaaaatattagccgggtgtggtggcaggcgcctgtagtcccagctactcaggaggctgaggcaggagaatggcgtgaacccgggaggcagagcttgcagtgagccgacatcacaccactgcactccagcctgggcgacagagcaagactccgtctcaaaaaaaaaaaaaaagaaaaaagaaaaaaaccatctgcaatcccactgacctaagacaatcacttttaatattttggtgaatattcttccaaacttgatagatcatttgtttttttttgtttgtttgttttgagacagggtctcgctctgttgcccggactggagtgcagtgtcgtgattttggctcactgcaacctctgcctcccaggttcaagcgattctcctgcctgggcctcccaagtaattgggattacaagcatgcaccaccgtgcccagctaatttttgtatttttagtagaggcgggggtttcaccatgttgaccaggctggtcttgaactcctgacctcaagtgatctgcccacctcagcttcccaaagtgatgggattataggcgtgagccactgttggtattttttaactcaccaaaatattggtaaaagtttcccaaaatagtaaatacatttctacttggcactttccagtatctgcatagtattccattacgtggatggtactgctaatctcaaaaacaatcccctgaggttgttatccatcttttttaatattatcaaaaagttgttaataaataagcttgcacttactgctaagtgcacttattgctaagtctctacgtcctatctaatatagatattactggtttttatatttaatataattttagatgtttaagcagcctcaaagcctttaaaagttatttttaaataattatagacttacaggaaattgcaaaattagtaccaaaattgagtcccatatacccttcacccagcttcccacaatggtgacattttatatatctgcagtataatagcaaaagcaggaaattggtggtgttggtaaaataccgttatctaaattacaaaccttattccatttttatttatttatttatttatttatttattttagacggagcctcgctccatcacccaggctggagttcagtggctcgatctcggctcactgcaagctccgcctcccgggttcacgtcattctcctgcctcagcttcccgagtagctgggactacaggcgcccgccaccacgcccggctaattttttttgtatttttagtagagacggggtttcaccgttgttagccaggatggtctggctctcctgaccttgtgatccgcccgcctcagcctcccaaagtgctgggattacaggtgtgagccaccgtgcccggccaccttattccatttttaaatcctttttaaaagtagtcagggaggccatcctggctaacacagtgaaaccccgtctctactaaaaaatacaaaaaattagccggacatggtggtgggtgcctgtagtcccagctactcaggaggctgaggcaggagaatggcgtgaacccgggaggtggagcttgcagtgagccaagattgcaccactgcactccagcctgggcgacggagtgagactctgtctcaaaaaaaataaaaataaaaaagtagtcagggaacaaatggaatttttttttcttttggcttcaacaatggaatttattttctcacagtgctggggactggaagtctaagatcaaggtgttggcatggctgctttcctctgaggcctctctccttggcttgtagatggccgccctcttgctatgtcctcacacgatctttcctctgtgtgcctggaataattttatgtgtatgtatgtgccatgcagcatgtgtgatatgcaactttctggaggaactgcccttctctgatgatagatgttggtaaatgccacccgcctcagtggaaaacaaaatttcattgggaatgtaacatcagaagagaaaaattatcctacaaaacaaaccaacaaacctaaaggtatcaagctggagagcttatgtgcaagtggcaagtcagtggttgaaggagtcagagctttaagatttccaaggagggagaggtcacagcaccgggcggctcaggaaggacttcctggggaagatggcatttgcgctgtcttgccgaatgagaacagagttgcgtaggctgagagagaaggaaagggtaatccagagaaaagaactgtgccgaggcaggaaaacctcacgggcccacccccacgcccagtgcaagggagccaggtgtctgagtcctgcagaaagcattttccaagcctctggtttcagccaggccctgggctgggtgctggatagtcagatgggtgaggctaaggccctgcccttgctcagcctacagtttgcagggagagggggtgacagaggagcaagtcacaagtgtgactgatgctgtgagaggggacatactgggaggctatgggagtccagagctaaaactgaagttcctttgggttggagggaccagggatgcctggacaagtagaaggtttttgttgttgttgttgttttgtttttggtgagccggggtcttgctctgtcccccaggctggagtggagtggcagcaatctcggctcactacaacctctgcctcccgggctcaagcaattctcctgcctcagcctctcgagtcgctgggattacaggcgcccaccaccaaacccagctaatttttgtatttgtagtggagatggggttccaacctgttgaccaggctagtcttgaactcctgacttcaggtgatccgcccgccttggcctcccacagtgctgggattataggcatgagctaccacacctggctttttttttttttttttttttttttttttttttaagacagagtctccgtcactcaggctggagtgcagctgtgcaaatttggttcactgcaacttctgcctcccagggtcaagcaatcctcctgcctcagcctcccaagtagctgggactgcatttgcacaccaccatgcctggttaatttttgtatttgtagtagagatggggttttgccatgttggccaggctggtctcaaactcctgacctcaagggatccacctccaaagtgctgggattacaggcatgagccaacacacacggccaagtagagtgtatttaatcaggaactgcagaacaacagtgaatgtttatggaacatgtagcgtggcaggtagtgtgcagaaaatctcatttgctcctgacatcggccccatgaggaaggggttgttttagctccatttcatcttggggggaacttcaaccctgagaacttaaatagcatgtgagtgacaaggctgagggcctggtcccagagccccagctgtcatgagtttcattcattctcctaaaatataatcatcactgccatctgagccaggaacactggggatgcaacagtgaacagggtatggcacaatccccccttgggggctcactgttgagtatgggagaaagataaacaaagggacaattataactcagagtggtaggaagtaccagggaggcacaggggatgcaggcaccaaattcagcctgggaaagtcagggaagtcttcctggaggaagtgacacccaacctgaactgtgaagggtgagactactactaatagttaaccattaaccaggcactgtgtgaagcgcctctgcatattaactcattaaactttcccaataattccatgacagttccatgactgtccccaagtagagataaggaaaagaccagtgggtagaactgatttcttccctacttccatgagggcctggacctgctctcccacagcatgatctggcaggagagctaaaaatatactagtaagaggaagtacagttcaaagtaaaaggctggataattacagcttgcagaggtgggtgacagaagtggggaagggagcatctaagggaacttccctctctgcccccaccactaaacccacctagctacactgcctgagtcatccacaccatcaaatgctgacagctacaactggaactgccacacctggggcacatgtgggtgccccggccctctgagaccccaggcccaggagaaactccttgccctaggatgtggggagcagagccaatggtagccaagcccacctggatagagagagagagagagagagggcgctggcttcctcccaagaaatacatacttcctgacaataatactacctcctggctagtttttatttttatttatttatttattttgagacagagtctcactctttttgcccaatctgcctaccacacccaactaatttttgtatttttagtagagatggggtttcaccatgttggccaggctagtctcggaactcctgaccttaaatgatctgcccgccttggcctcccaaagtgctgggattacaggcatgagccaccacgcccggcctatttttatttgttttagagatgaggtctcactatgttgcccaggctggtctcaaactcctggcctcaagtgatcctcctgctttggcctccaaagttctgggattacaggtatgtgcccctgtgcccagccaggacattttaaaacttttctccaagccccagtgtttttataccctgcccgatttgagctggctggtggagacagggctgtccagttctttgtttttgagacagagtttcgcttttgttgctgcaagctccgcctcctgggttcaagtgattctcttgcctcagcctcccgagtagctgggattacaggcctgtgccaccactcctggctaattttgtttgttgttgtttttgttttgttttgttttgttttgagacggagtctcgctgtgtcgtccaggctggagtgcggtggtgcggtcttggctcactgcaacctccacctcctggggtcaagccattctcctgcctcagcctcccgagtagctgggattacaggcacccaccaccatgcctggctaatttttgtattttagtagagaaagggtttcaccatgttggctaggctggtctcgaacccctgacctcaggtgatctgcccgccttggcctcccaaagtgctgggattacaggcgtgagccactgcaccgggcctggccagttctttgggcctcagtttctcttctctgcgaactgtgcacccaccatgggccaagcatcgttgtatgcccttgacatccatcaattcatttaactctcaccgttctcaataggtagatgctaagataaccccattttacagatgaggccactgaagtcctgaaatgttgagggactttcccagcttcccaaagcagcaatgggcctagcggagagtcaaggccagggctgatgacggcaggcctcatgctttcttctccactcacccttacctgcttcatgaggtttcatccaatgccaggaaggttgagagttcgtgcggtctcgtgaaatgacccactgtgacccctgccactggcattctgtgaccctcagcaagtcccttcccctttctgatactcagaatctcagagcaaagtccttcccatcctccctccacaatgaatgggtgcataagtacatgaacaaattaagtattcttcccctctgcgcccactagagtgcgcacaggtgccactaaccgccaccgttcccttcaattgccatcctttcacaggggccgctgtgcctttctatatacattcccagcctttccgcactcttgttcctctgtgattactattcctctactccagtctctgtttgcttgctggtttttgttgttttcatcctgcaaatctctaaaagttgccacagagcctttctaaaaggaggcaggaggtggctttgtccatagcctcaggaacaccagcctccacctgcttgctgagggcaggcagcttcccatccctcccgcccagcccaggcctggcacaacccccagggcagagaggcctagagcttgccagggatcccagcctttgcctccagctctccttgctgcagatgtcctcagtgcaccatttctagtcttcccagtagcaaattcctgctcagcccctcctagctgtacaccacaggctccctcttgaagagctctgctctctcaggtacccctgtgctgaactaccctccgccgatgcatcgaaaaagcccaggctctcagatgggcacagtggctcacacctgtaatcccagcactttgggaggcttaggcaggtggatcacctgaggtcaggagttccagaccagcctggccaatatggtgaaaccctgtctctactaaaaacacaaaaattagctggggatggtggtgagtgcctgtaatcccaactactaggggggctgaggcaggaggattacttgaacctgggtggcagaggttgcagtgagctgagatcatgcccgtccactccagcctgggcaacagagcgagactctgtcgaaaagagaagagaagagaaataagagaaaagagaagagaagagaaagaaaagagaagagaagagaagagaaagaagagaagagaaggaagagaagagaagataagagaaaagagaagagaagaggcccaggctctcaaccccacctgggctcagatcttcagctatgggacttcagtttccagtctgaaaaatgggacttgctatggtttgaatgcatcccccaggaagcacatgttggcagtccccactgcaacagtgttaggaggtggggcctaatgggaggtgtttgggtcatgaagtctgtactctcatgagtggattaatgccaatcacagaagggcttgaggctgtgtgttagatctcttgcactctctctcactctctctctttctgccatgggaatatgcaaggaggcccccaccagatgccgagcagatattggcaccatgcccttggactctggacttcaagaaccatgagccaaatacatttctgtttattataaattaccgaggtattctgttaaagcagcacaagacagactaacataggttggttgtgccttcttgcaaggttgctgtagagattaaattgtagaactaatgtacagtgcctggcatctataagtcccccttaaatgggagcttttgtattaatttaatttgtattaattaaaaaaaaatagaggttggagggaggtcttaccatgtagttcaggctggtctcgaactcctggcctcaagtgatcctcctgccttggcctcccaaagtgctgggactacaggcacgtgcaccacacctggctaatttttgtattttttgtggagacagggttttgcctcatgtgctcaagtgatccacccaccttggcctcccaaagtgctgggattacaggtgtgagccaccacacccagcctgaaacttctttttttttttttttttttttttttttgagacggagtctcgctgtgtcgcccaggctggagtgcagtggcttgatctcggctcactgcaagctccgcctcccgggttcacgccattctcctgcctcagtcctcccgaatggctgggactacaggcgcctgccaccgcgcccggctaattttttttgtatttttagtagagatggtgtttcaccgtgttagccaggatggtctcgatctcctgacctcgtgatccgcccacctcggcctcccaaagtgctgggattacaggcttgagccaccgcgcccggccacctgaaacttcttaagtagttcccacaatgacataagttcaacaactgagacaaatctcttaatctatatgccctggtgtttccgtttctgtgcttgaaccctgactgaattggggggatacactgattcaggtcttcaactggttcagctctaaggcaggtccttagagcgtgaggtctccaaaacccatcagccttgggtcctcctggtgggacttgctcagagtccagttttcctaaccgccctgtagctaccagtggctggacgaggacagacttttcccaagccagtgccaacagcaagaaactgcagttacctgccgaccgatgggccaaacagaacaaaagaaaacccaggattggacctaaaaaccagatcttctgtatcaatagagggtcttttgataagtgggcatcttggaactggggcactctgggaacaaaagtggtgatgggactctgtgggtgagtgttaacccccattctcctattgggatagggttacatgctcccaggagtggggtttgggtctctgcatgcagattgggaccctgcttgagtagtgcccacttctagttgggtaaagaggcatgtggaagctgagcttccatctggggctgagctggacttcatgacacccagactctccagcccgggccttggctagttcccagggggctctgaggccatgtccaaggggacaatgatggccctcagtgtgacagggtggctgggaagtgggaagaatccatggaagggggggttggcatctggcttgcccgaggggtctcccacatcgagcagggcaaattccccacgcaaagcagcaagctgcacctgtcagagctctcagtgctgtggctcatccgctctaccctgggcagctggtggtacgaagctggttagtgccatctgagaccaccactggggctgcactcatgggggtgtgggaaggctggagatggcaggcctcagcctcatgaagatctctgttactcctttgctaattaccaacagtgatccactgaccccagttcaggcctcagtttcccatctgtacaacaaggggactggactggatgatcactcatttggcttccagctaggactcgtaataatggtgatgatggtgatgatgatggcggtgccatttgccaaaaactcaccatgtgccagactccacgcaaaaatcatgaaactggactggctcccttaatctgcaaaatatccccacggggcaggcacagttgttatccccatttcgtagttgagggcatgcaatcctcgtgcagttggaaaggagctgagctgggaggaagataggacagccacatggatctagatcgggacccaggttctgctgtttctagccgtgtgaccctgagcaagtcacttgccctttctgtgcctctgtctcctctgatgcccattcctcggggctgctatgtggcctaaaggaggcaatgcactatgcgtggtgcacaaagaacacaccgtagtcatcaatcattgtgatgattatggtttttcttttagtctcccgtgtagctaggtatggccatatgactaacctttaagccaatgatttgtaagcactgtcctatgtggaacttccagaaaatcttccttcttcttcctgtcctccatcctgctctctggaacgaatatacaaaagctgaagatcaacagccaccctaggccacaaagatagcagggatgggccacactgtctcttgactcccttactagaagacaagttacacaagaacagaaatcttgtttatcttggtcaaagcgacctccagaacacttacaaagtgtgtgtcacgtgttaagggcacaggtattgaatgactattgaatgaataggtgaataaatgaatttacttcagactcaccaataaataaggtttcagcttccttcatagaattaaagtattgattaatttaagtcacattacttctatttgctttcctttgctctcccaaacttgcacctgtcatagaaggatagtgttttgtttttttaaatgtgctccagaattcccctcaaaaaaaaaaaaaagttttaaaatctattttcatgacaatgcttcccagtatagtcctgcttagcaagtttaaaattcttcagttttcttggtcatggatacgtatttttgtgtacgtctgttgttaaatggaggcactgatttggaacaaaatagacctcacctcaagtccataagaatcatccaaaatggtatctaatgacattcctgggacctcagccaatattattattgacatagaatgcagtcactgggtcctgaggatttcatcggatgttggttgctgaaactgaactttatcgggtcttttccccttccactgtggttttccacatttcaacatgtcacctaactgtcctcaaactttacttaaatcttttcaactaaatggaatctttattacccctgctcctctgctttttgaagcaaccgttttcctcctgtgataacactccctgtggccccttttgtggccccttttgtggtcacagggtttgtaaacattcagactttttgcaactacatatacttttattcttatttttcactcttctcgcagttgttgctttttcttttaactctttgagggagttaattagccccctcttcaacttttgtgatgcacctattcatatttgagcctctgggtttttgctcaaattgcttttcaatttactcactgttgaagaaagccattatttggggattgtaaggtgtatcaagcttttcttttctttttttttttttttttttgagacagcgtctggctctgtcgcccaggctggagtgcagtggcgcgatctcggctcactgcaagctccgcctcctgggttcacgccattctcctgcctcagcctctcaagtagctgggactacaggagcccgccaccgctcccggctaatttttttgtatttttagtagagacggggtttcactgtgttagccaggatggtctcgatctcctgacctcatgatccacccgtctcagcctcccaaagtgctgggattacaggtgtgagccaccacgcccggcctatcaagcttttctaaagtgtagacttctctatacataattgcctctttcctagagtagttatctgacaagtctattcagagagctggtcatgaaaagagctttttgtaaacctctcctttagaagaaatgtctctagtcacacagtgctttctcccttcttgattttgtatcagtccgaagctaatctgtcctcactctggattgcatgaacttgtgccttcttgggcatcatgtgttattaattctccctctcttccaattgtaaacatgtttcctttattggttcttaccatttaggataaaagtatactcatctttatggggggggaatgaaagctttcttaaccatatatctcccttcaactgttcccacatctctcttttcagccatacttttaggaggagaagccctcagttgatgtctttactttctcacctctagttcactctttccccactgctgacgctcagcttactcacacacatcctcaatcactgagttgccacaggcaatggcatctgtggcttttctgccttcttggcaaaatatggctctgttgattggggtattaggtataaagtacctactgaccaggccctgtgctaggtgaggccattacagaaatgagaagcagacaccacctccattccgatgagacccaccagatcagccattgctgatgaacactcaggtgccttgactctcacttttcacttttgcagtctttacttcatgccacgtacatttccctattccccaagcctcctttctctccaaacccctccccttattagacacagccttttaaagcagtcacggtcatacccatggcttcaattgtattgtatatgctgttatgacaatagaatttaaatgttgttcttatataacagttttattttacgtgacacctcattcgctacaaccataaattcaaagtttccctaagaaagtaatcactaaaaaattgtcatattcttagtatgtaaattttaggaaatttccttaatgatttgagttactgtgtgtgtgttacttttgaaaacatgagttgggatgtcacagaatggacttagcctacagaggtttatatccaattttcaaccagacggttccatttcaatgtgacacttaaagagttcaaaactgtctcattccccacacctctttctcgtcctacattctctgtctaggggagaatcactgctatttacacagtccatcaaactagggccttagcagcctgtttttccttcccctcttcttccacgtctaatcaccaagcacttcctcttctatctcccagctgatcacaaaacttttccttccacttcagtcactgctgctgcctttttagccttactgttctccagatgaacatagagtatcttaatcagccccactgctttcataaagccctctccactgcgcagagtgacgtcactgcaaacacatcggatagagactcttcacccctgtgtggttcagtgactctcgtttccagaataaaattcaaactctaccccagcatctaattttgggtcagatagatctgcgttttcattccaggttgattcactgtccagcagtgtagcctcagacaattgaatcctctaagcctttgtttgctcatctgcctgaactcacggagggttgggactgtttcacacatgcagtattggcacttagacttaatgttgaatgaaggggaggcattttaaaatccacatcaaaaaactgttattctttaaaaaaaatactaatctacaaggtcactgcccctccaagcatgacgtctacctttactttctgataaccatgatcggcttgtggggatcaagattactcaggattaaatcctagccccatcttgagccgtcatggaaacttggagaaagctacttaacttctccatctagattgattctgtaaaatccataaaatggaatggtttctgggggttaaattagtataccacagctggaacactgtcaggcttgccagatatttactattcatcttcatcaaatgaggacagtggttctcaattttgtataagaaaaacacgctttatgcattgttagtaaaagaaatatctgaatatccctgccatggaagaaagaaacagagggagaaaagagagttggtaggtcctagcatttcagaactgggaaggatgagttcagtccctattttatagacaaggaagggaaagtgtgatgtgtcctagggtttcattcaagtcacagtcatcacgctttatcgagagtgggaccagggctctaggagttgctatggtcaagttgaagacaaaaactaacacttgtaagacaggagagaagcatttacttacaaagcagtccgaaatttgtgtataactacatttggtgagcaaacgaaagctgccagactcagaaaaacagagatgctaatggaactgactttagtaaccagggttttccattgagttcattgcccggggtgacttccaataacaacccccgcccccctgcacttttctcaggactggaaagctcaggcagcccaggacgaatagtgcagtcaccacagagggacagggtggccacaaggtgggcagcagcagggaggtgtgagccattggttgggtctgtggggtcggccattgtgagccactagcctgacttggttgtttcctggtaaccaggtgacataggaggctttgtgggtactagccattgggcagggccagcagccttcagtagctggtagtggaaggaggagctctgactacactctcacgactgttttttgcctcttggttcttgttatgtccctttctttttgaaataagacagaaggtccccaccttcatagacatagagagatcccatcttatttgtttttaaaaataaattgaaaagtgaggcggagccttgtgaggatgatgggagagggcttccagagaggaatttcttctttggaattcctgaaatgggaacaaacttgttttgggaaaaggacagaaagacacaaaggtggctgcagcagagtgaaatgaatatgatgggctaaggcctcgtacacgtagtgagcattgacaaagaatatggactttagttgagatgggaaaccactggaggattacagcctggggattactgttaattctccaagaagaagactgaccagcggctgtgtgagaatgtcctgtaatgcaggcaagggtggaagcagggagaccagctaggaggctggtggcgaagtgcaggtgagagtcaacagtgaacagacagacgatcatgacctgaaataggctgacttgagaatctctagagtcaagtgatcctaaaagtaggtaataaagtgataaatagagaagtcacagaaaaagaaatgcagacgatccttaaacacatcttcacacataagagaaaggcaaatgacaactatactgcagtgtctctcctattaagtgaaattccaaaaacgtggcaatacattctttggtttggctgtaaggaaagttgcatgcatatattgctggtggaaatgcaaaatggctcgactccacgaaggggaatttggcacaatctcacaaccttgcaaatgcatttaaaccggaaatcctactttgaggcattttatcccgagggtatactccataaatatgaaacaacctatgcacaaagtccttgttgcattattttcaatagctcaatattggaaataactgaaatgtctagtaagggactagtaaaattaactggtacttccacctaaaggagaactatggagctgtaaacaagggtaagatgtcattttactgctatggagtgattcccaagataggttacacagaaaagcaaaaagggagaacatgcggtaacatacatgaaagaaagcagggggaataatgtgtgattattaaaacaaacaaaaaaacaacgctggggaattcttgatgctgacctgtgactgttttctccttaacttcagtgggtagccaaagtgcgtgttttctcaaaatgttattttgctatgggttttccaaaggatgttaactgtttacttttcacccagaagctttgctttgtaattgattgtgcattatgtagtaaatagactgctcttgcattttatttgatcctctcaatgttttaagttaggtgtaatatgagaattttccttgtgtcacatatgagaaggctggttctaataagtataaagtgagtttttcaaggtttgaaaaaataagagtcagatcaagaatgtaaattctagacatggcatataaaactagaatttattacaaggtgcatatgagctgctttgaatactacctcttttaaaaaaaatttcctttagtttattaaagtagttaagcctcaggattaaaacagtaacattagataatgagaaataaaatggagatacttgtaactcagtaatgctttttatctttaagagacagggtcttgctttgtcacccaggctggagtgcagtggcctgatcatagctcactgcagcctcaaactccttggctcaaacaatcctcccacataagtcttccacgtacctaggtaaacaagagctcactaccacacctggctaatttttaaaacattttttatagagaagaggtctcactatgttgcccaggctggtctcaaacttctgacctcaagcaatcctcctgccttagcctccaaaaatgtcaggattacagccatgtgccaggacacctagcccagaaatgttcctaaaactctgaaaaatgaagttaaatgctattaacaaatctataaatggataaaaatatactatgatatatcaaatgtcacagctcagtcatggtcacaacattgattaaaacgttaaacagtttaggcaagtctgagaactgagagggaagtacaggattgctttggaagccagaattaggattgtcggagcagggaaagcagaagcaaggcgtgagtgtgcacaggactgggggacgcagcagctccatggtatgctgtgtgtcctcttacatggcaggccacctccaggccagcagatgagaatcacctgatgggtgatttaggtaaaatcacccaaaatagagtggatttaggtaaaatcccagactgtgcatcataactgagagactttaaatgtttgtcttatggggcataaagctaatcaaagtgaagacgcagggataatagagcaggtgagtaaatgcagtaagccacctgccacctctccagggcatcaaccatcccaaagaaatattggggcagcaggatttgacaaagcttttgagaagagctctcagttcagggtccagggcatgatctagaggactcagatgttcctggatctctgtccccagggaaccaactacattcttgccccacatcttcatgcctcactgtggtaactctgggcaagtcactcaaaacgtctaagttttaattcattgaattggaaaatacgggttgtagcccctgctctgcccgtccctcggggctaatgtggggatcaaagaaataacacatctcggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcagagcttgcagtgagccgagattgcaccactgcagtccgcagtccggcctgggggacagagcgagactccttctcaaaaaaaaaaaaaaaaaaaaaaaaaaaaaaataaaaaaaaagaaataacacatctctttcatgagctggaaagcatcatgcccatggaaacagtgaagtcaccttccaccctcccctgcccgggagccatacacgctccctctctgtattctatacactaccaagtatctggattattcttccagacattgaatgattgaacactgttgggcatttacaactcatgagtcttcttaagcctttatctgtatctcatcctttttagccctatagatcttagtaggtctatagcagagatctactaacattcccacatctcagaatagggaactgaggcacagaggggttcatttcactctcccaggtatgtgcagattctaagtagcatttgaacccaggccattcttggtgacttggatctgctgcttttctatattgtctcatctaaataaaggtatctgcctgcacagtctgttttaagtgcaacaaaccttgcaaaatcttcctagaacccaaatctaattcaggtagagttgaaaagcagacggtgcaaaccgggatcaaaactttcatctgtgaataagtttttactaatttctctgctatcctctgccagcaacatgtcaagcactgtctttattataatacatttcctggaatctataagaagtctgctctaccttgcaggtttggacgcccgctccaagcgctggttaaaaataatatggagacggcacgggatttggcctctagaaaatataggtaatgtggaaattaaatcattaagttcatttaagcaaataattccagtttattcattcagtgctccatattagagaaactcagtaaatgctatgtcatgttcttcatttatttcatttgtgccaatttaaatgcattaaatcaatggtagatgatacaactacacaagtaaagtaatattgacaagttagagttgttcttttgtgtgtgtgtgtgtgtgtgtgtgtgtgtgtgtgtgtgagaaaaggtctcatttgtcacccaggagtgcattggtgcaatcacaactcactgcgatcttgacctccccaggttcaggggatccttccacctcagcctcccaagtagctggccataaggcacgtgccactataccaagctaattttttttttttcgtagagatgggatttcaccatgttgcccaggcttagttcaactttgatagtaaaggacatctcaaatatttagacatttgctttcagtttagtcaattatgaatacagctattataaaccttcctgtgtcttgtttggaaacacaatttttaaaatgtaactgaggaaatacttaggattatgattacttgcttgtatggtaagactacatttttctttgtaagaatttcagtagaatttaccagtgaaatcatctgaatatactgttttagttttttgaaaagatattaatcattgatttaatttctaaaataaatataggcctattcagatgatctatttctcctgagttttggtcttctaaaatagattttaacagttagcccatttcatctactgtatccaattgtgagcacagatgtgttcaggatattcctttattatttactattttttgatttgactcttcttaaacagatattattagtatactgtgacttctttctttcctttgtgggtagccaaggtagaggtttatcaatgttactgatcttttcaaacaactgacttttggttttgttgattttctctgaggattttctgtttcctattccattgtattctgcaatcgttatttatttttcctctgttctatatcacactgctgtttttctctcattgcccaagttgaagctaagattatgaatttagacatttctcattattgacacagcatcctgaatgtaactcattgaatgtaatctcattaaaatgcacacttaataattaaaatgataaatatgcatgcttcactacaatttgaaaaacacaacagggtagatgatcaatgtagtggcaggatatgtagatccacagaagttaaatgatcttgtaacatttcataaaattggggatttgcctggaccttcaaatggggaggaggtgtgatgagatgctgtcgctgaaccatacagtgcctttctgtattaaactgttcttaaggtgacattgatgaggttgccctagctggaaagccaaggctctttcatttctttctgcccctcttctttgccttccttcaacaccaaggagaatggtccagcagcagctcagtccatgcctgtcaaccgcccacctccacactccagacccagtccatatcccccaaggctccttgtgggattcctcagcagcaccaatgcactgactgtcactctatgttctcctaggtcccattgaagatgtgcaggcgtctgcacacggcggtgtggaggagaatatgacatcagatattgtaagatgtatttctttctctggaagagaaatgctttttgttttttctggggcttctagaatatcaagtgagtatcatttttgactgccatcatgattcaggcctcagtgtcatggactctagcgaccggtcactggaggttatgaccagctgaggcctgattgaaaatggcagtcaaaggacggcatcacttacaaactgtttggtagtgagtgtatttctcagtagcaaccttttctccttgaaaaataattttgtatttgccagccaacatagacttgctaaatattccaaaaaacccactgcatgttccacaagcatcctctatgctttatttgggggccagtgacttgatcactgtttcacatccggttttttatttcaccaagtgaataaaggcctttgccaacagaacccagcatgatctgatcctcatggtgttttttttttctcttattgcagagaaagtcgaaagcccagcgtcaagtctgtacatatacttttttttttaaacagctttatttagacatagttgacatgcaaaacaactcacccatttaaagtacgtgattcagcgtttttactatatttacacggttgtgcaaccattgttacaatctcatcttagaacctctttattcccccctcaaagaaaccccactagtagtcactcctgtttttcccatctcccatgcccctggatctaggcagccacaaatgtacttcctgtttctatagtacagtgcttttctgtattaaccggttcttaaggtgactatttcgcattgatgaagttgctctagctagaaagccaaggctctttcatttccttctgcccttctcctttgccatccttcaacaccaaggagaatggtccagcaacagctcggtccaagcttgtcaaccgcccacctccacacactccagccccggtccacatcccccaaggctccttgtgggattcctcagcagcaccaatgcactgactgtcactatgttctcctagatttggtcgaagatctcagtgaatacccatctgtccatcttgaagacctcatgacaccggagatggtaagatgcatttctctgtctggaacagaaatgttttttctgggccctcttgccttattaatgaaatgaagatataaaaatctgaccatgtatattatagaagacaaatacaatttttttgttggctggaacatcaagggaatatcatatttgattgccgtcatccaccaggtcttggttgatcatggactctagcgactgtcactggagtttatgaccaactgaggccagttggatgatggtagtcaaaaatgagcgcatcacttacaaattatctggtagtgagcatatttctcagtagcaactttttcttcttgaaaaataattttgtatttgccagccaacaaagacttgctaaatattccatgaaaacccattgccttttccacaagcatcgtctatgcttcattcggggggccagtgacttgatcactgtttgacatgttgttttctactgtcaccaagtgaataatagacctgtgccaacagggcccagcatgatctaatcctcatggcgttttcctttctcctattgtaggcaaaggagagacgcgaagattacctctgtaagtatatctatatatatatatagatatatatatagtagatatatatttgtagatatatatatctatatatatagatctatatatatgtagatatatatctatatatagatatatatatgtagatatatagatctatatatagatatatatgtagatatatatatctatatatatagatatatatattgtagatatatatctatatatatagatatatatattgtagatatatatatctatatatagatatatatatctatatatagatatatatattgtagatatatatctatatatagagagatatatattgtagatatatatatctactatatatagagatatatattgtagatatatatattgtagatatatctatctatatatagatatatatagatatatctatctatatatagatagatatattgtagatatatctatctatatatatatttttttgagacaaagtcttgttcttttcccctaggctgggttaacatggcacaatctcggctcaatgaacccatcagctcccaggtttgaggacttctccggcttccgcatcccgagtagctgggattacggacgcctgccaccacacccagctcaaatcattttatgaatgcatatttccatctgggtgaaaaaaaaatcacaagcctctctctcttcctactgagcacctgtgaacagtgacctgcagtttgtggctgcagccagtcctcatggagcctgctgttcttacatttcattctgaggctcacattctcagtcaccatgcagaagaacacccgccccatcctgggtcattacagagtgggccaatccatctgctgcatctgaggagctgggtccagcttctacggtgaatccatatatttctgtatttcctggataaggaagaggaaaggagctgagctggtggaggaagaagatctaatattaactgactccttattttgtaccaggtactgtgttagttacatattttatctcatgtaattcttaccaaatagtaagggggttgggagtgatggagacaatattgatattatctccattttagggtgagaaaatgaaggctcagaaaggttatataacttgcccaaggtcactcagctgctgagagccaggatatgaaacagaagttttacattagaagcgttcaaatttattttcaatttccctgctccattctgaataggtattggcatttacccttgggctatgtagaacaagtgctttgtcaccaaaacacctattgtgaactctttctgccctagtaggattcatgcattttatcttcttcaaagtaaaaacctttaagagccaggaatctgccacactgactctcaacttaaatctcagccacttttaccttaaaattcagacttgtgtagatatctctagaagacttggtggactaatctttaagagttaatttgcatgagggaggaagaggagcccacatttgcaccaaagacatgcctagaagtcggagcaggagggtcagcaggaagtctgtttcttagagttcctccagcccagtctgagtggtagaaatcaggaactgaaaataaatctgaaagttgtttgaaatgatggtaagacatgggtaacataatatattgggggtttgtgttataaatgaggctattttcttatgtttagtattttgtaattttagtagagatggggtttcaccatgttggccaggctggtctggaactcctgatctcaagtgatccccccacctcagttggagtgagcaggacctggccttcctgtctgccgagagtatggtgtgaacatcatcctaagtgcctcgagaaagcagcttccttattgtaccatgtcttccccatctctttgtgtgatgatggcaatgacaccagcagaaattggtgagaggggcagaacaggaatcaggtccccacttttctgacacagagcagacaggacacgagtcagtagggatggacttcagggtcaggccagacacagagaggtcccagacctgatcttcctgggtctgggacagataagttttcatttttcacctcttctggaagtcacctggggaatggtccttcagtagacactgttggccaatggttgtctggcccagaaatatgtttcaactagacgtagccccccagttcttggccagggcagtggcagcgctcccgagtagcaggggaggtggggagggacacgagttccagggcagggtgagctcagcaaaggggtggggactgaccctagggtccaggtcatcgaatccacaacacctcagtttccacttactttggagatggtttaacatcttcagtatcaaacttggggtcttcccacagatggatagaggaaccctggccatgggtgtttgctgccagggcagtgactgtctcttcctcatttgttcttatcccagagctcagtcctggggaagacacattaggccccatgaatgttttaatgaacacactccagagatgagttctagatcacccctgggctggtatctagtgcaggtgtggaaaggttttcttcacagcctgtccagcctattgagccccacactcatcctggagcctgcccagcttatgattcagggtccctggagatgagggtgagctcctgaggacagcgagttgcccctacctctctgctcctgccgctgtgatcttgtctagacagggtgtgcagggccatgctcttccactgggtgcaagagcgccccctgctggaatccctctggacctggatattgtcctcatggtcatatccccagccccacacagtgactggcccttatgcagatgcccaggaagtaaccttaaatgtatggtaggatcagagcagcaaacgattctgcagaaaaaaacaccaggataggggagtcttgtcttcctcatttctggatctctggagctgtcccatctagtgtggttctcagtcatatatgtgcctcttcatggttaaataaatttaaatatatacaattaaaaattcagaacctcatcaacagagaccatgcaatggcccagcagccacatgtttatacagctcgagttttccttctttccaccctttgatgagaacatgatcttcaggctggtgctggtttaccagaaattctcggggtggtacatgtgctaaaagacttttagttttgagggaaaggaaagtgggagataaatcaagtatataatttttaagaaatggaccttttattttaaatgtagggacatcagcagtggactttatagtccttggtgccttcttactgagaaatttcctttagcacctatttttattagtttttagaccaaagaaagccaaacaccattttatatttgacaatgcttcctgtatgtttataccagataagctagatttcacctttatattagtgttattaatgttaaacagttttaataaaactttgtagacatatttattcaacttttaatgtctgaccataagatttttataggcttttttaaccttttataatttttgtcaaacagcaggttagcgctttaagaaaaacccgttgtgtttttattttaatgtccagttcacagaaaaactggatgatacccctttaactttagccaatgtttacacacagaattttctttacaattaacatttcaaaacttgcttaaaccttcaaaactatttttgtaaccttttaatgtaggtaaaaattcatattcttatgcttccttataatccttttaccaaaggcatattttacttaccttatacaccttgcacataaactgtttcttcaatagttttacattcaggaggactaattaatttaaattatacaacatttcttgcataaatttctttttctaacactttttttcatgactttcacagacaattcttcgacatgcctcaactttctgacttattggaaacatccctttctttaaacaactagttagtttatttcaggacaagaattttccatataacattccttttgcacccccaattttttcttttttcgaagatgataaccattcttttccaaagcaaacttccttcatgtctgtggactagattttctaaggccacagattagaaattaccataatacatgttacactgttaacttttagcaaaacaactttacttttgttgaaaaccttgtaagtgtgggatttcaattatcctttgctataaataagacattgcttagtccaaattaacttagaattggtatagatggctttttttttcctggttctgtaagtacttcaaggcttggctgagtggcaaagttgagcagaccaattattaggcaattttcctaactctgcttctacaagagttttcctcaattacagaatactgattgtgtttttttttccttaatcacctgggaggaactatctatcatcctgtcctgaaggtagttcctcctaggtctggtcagacctttgtatggtaattaagatttaaatcccctgttaggaaatctgctgggttaagggaattttcaggggtttatgttaaatcatctttttctaacggagtagccccatactttaagatttttgagttatgaagctacctttttgctttttttttttttttaattaggatacttctgaactggtgaggtgtgctcacaatgaggtttcctctaaaagttatctttctactttcttctgtcagcaaagcagttgccgctacagactgaatgcatttgggccatccgtgggttagtgggttcacggaattcacatcaaatcagaatcaaaaccaaaaccaaagtgcagataaaggcacgcccgttcgtcaagcagtttaaaccaagtgaaaatcaaaaccaaaaccaaaaccaaagtgctgataaaggcacgctgtgggtgatcaggccatgcttccactcaaatggagtggacaagttcccaagaccggtcctgtcaagcagctcaaaccaagtcaaaatcaaaaccaaaaccaaagtgctgataaaggcacgcccgtttgcctaggaattcaaaccaagtcaaaatcaaaaccaaaaccaaagtgccgataaaggcatgccgtgggtgatcaggccacgcttccactcaaatggagtgggcaagttcccaagaccagtcctaccgtattccagatatctggactccaagcgccagttccttcccggtgttcagccactgcactgatcctctgcgggggcctgccatgcactgctctgacgaggcattgcaccggggcaaatgcctacccaggagcatgctcaggaaccgcgtagctcaagctggccggagtcccctgcagggatgctccacagggcaagcctaagctgcctaagaggctgcctcgcttcccggtcagggaaccaagaaatgtagcaggatgagccacagacaaaactcctcagacaccgggttaaacaaggaagaggctttattcggccgggaaatcggcagacttgcgtctcaagaacagaactaagctccccgaagaaagagttcctggcccttttaagggcttacaactctaaggggtccaggtgacagggtcgtgatagactgagcaagcatggggtacgtgactaggtgggggtaagcaaggcaagtatttctccacaccattgtctgtgatctatagatagcacaagcgattagggtgggggttaatcttcagcctacaggctaaagcaacaccagagaggatggaagtgagacccctggagttgtggttgtggtcagattggaccttcccgtggctgctgagaccctggggcattggagacacctgaggatgcctccctgctcttactttgtggtcaccaagagattggggttaccacaaccctataatgtagagaatccctgtccccttccatgacacttcattctttagggaagcaaacgccctcccaggagctcattcccattcctgggccacagtcaaagggaaaacctgatccagacatgaatttccttgggcctctgcatttccagacatcctgtcattgcatgcatggggctgactgtctcatctcagcttcagaagggcaggcagagttgtggacaccctgctgagcaaatgcccaccggagtcaggggttcagctttcctgcatcactgctgcaggtgggggctggggaggggggcatagggggtcctagggagtagtttttgtatgagcctgtgtcacagcacttgatgtttagcagagagacccagctgaccgtcctaaagaaagatgcaactgaaactcacttcccagggcctttataactgaatgagacaacatacttaggtatctggtccttgatatctgggagatgctgagtaaatgaaaatgatcctttctccctctctgatacttaatgtggccccttactttgggctgctggttctggagggtcgcagggaagcaggatggctcacgctgctttctccacaagctctggcacccagtaagaaccagcacagcatgcatggagcacacaccatacaccaagcttggtgctaagagctttacatgcttgatctcatttaactgcccttagaagtcaggggatgatccccatttcagagaatactgaggttcataaatgtcaaataacctgcctggaggagccaggtctgagaacaaggtccatgctcatgaccactgggtggaacccttctcaacatggtacccgtggtcccagagtcacaggccttctcaagatgtgaaatttggttagagatcaattttctatctctggaatcatcatatcccctctcaattcttatgtatttacagtcaaggacgtgtcaacatagagacttaggaggacaaagtgaacttcctgatccccaacaggcagatccccaaaagccaaaatgtatgtgtcaccttggaagatgacgcaccaggaagaatggggaggagggaggaggaaaaactgctgatgaggccgactcgctctttggggcttatcatatcagcaaagccagctcttttgagatggaagaacaaagatgtttctcctctgtgaggaggtgacagtggtgttctgggtgaaggagagcagctttgtcctggaaggaatctgacttggaaggaggcccagttgtccagcaggtacctgttccctttctgctctggcttccaaagggctctctgcagagccccttcccggagctgctggcaggaggtcctttgcttggggggtgatccatggggacgtctggagcagtgggagcctatcttgggacctggatgggagctgctccacctcagcacccaggttatgaggcacagggctgggcaccacgagggcatgggtgaaagtggcctggatttggatttcagaagaactgggcttgagtcctagttctgccataaaccatgtgactcttaggcagtcactttatgtttttatttctttggcagtaaaactgtcattacctacaatatgggaattgtaaggaactactgagaaaacaaatctcaaaatgttctgtgcagactctcaaatactgtgcaaatatcaagctgttttaaaatccagtctctgcctttgagattttacaatctggtgagcaggtaaacacaagtacacataacaagagaacagtctccatttagtgctgggtgatgggaacagaggcaaatgctttgagtttggggtagtgagctggggtgatgagggaaggcaggaatgcggggaaggcagaccttgaatggtttttttttttttttttttgagagggagtctcgctctgtcatccaggctggagtgcaggctcagctcactgcagcctctgcctcctgggttccagcaattctctgtctcagcctcctgagcagctgaaattacatgtgcccgccaccatacccagctaatttttgtatttttagtagagatggggtttcaccatcttggccaggtggtcttgaactcctgaccttgtgatccaccctcctcggcctcccaaagtgctaggattacaggtgtgagccaccgcacccagcctcgaatgggttttcaaagatgggaagacaagctgggtcactgggcgctcccacaggggaagcatgagccaaggtgcggcagccgctctacacacgacctgctttagctatcgggtgcgatagaggctgcacaccggtgacaaattagagaaatccaatctgcacatgtattttacttgcaccacacagtgtttgtttaatatcatctggccacttaagacagggagatttaaaatgaaaaatccagatttcccattcttcttcgtcttctttttttttttttttttttttgagactgagtctcgctctgtcacctgggctggactgcagtggcacaatctcagctgaatgcaccctctgtctcccaggttcaagcaattctcctgcctcagcctcccgagtagctgagattacaggcatgtgccaccatgcccggctaatttttgtatttttagtagagacaggatatcaccacattggccaggctggtgtcgaactcctgacctcgagatccgcccacctgggcctccccaagtgctaggattacaggtgtgagccactgcgcctggcccagatttcccattctttttaaaaaccagaagacctggccacactgggtcctcttccccagccagtactgatcctctggagtttctgagagggttcatgccacacccactccatcacctgctgcctttcccacctactccagttaactcactccatcaccacctgacctgtcagtgtctgggctcgtgattcctgtgtaaacaaaaccttctattgggaagaaagttttatgaagggagctgtatgaggggagacatgggtccctagacaccctaaaggagagactgaagtggacccaagctataaaccctcccctgtcagccagcttccagctgccaccaggcctactcctacacacctgacatctttgcccacggtcatcgatgcaatcactttcttcactgcctccttcttcttctccttcttgtcactgttgagctctgccttcagctcgaagatctcccctaaggaaaggaggcaagcatgagtgatccctccctaccctggcaggggacaattcccagtatctaacttccaaaagaaccggagggaggcacgtaagacatcctatgctgttggctgagggaagcttcaggcgcctggcctcaggtgggccaggcaacagtgagggatgactgttaggacaggaattaacaagatggaaacttgtaggccgggtgcagtcgctcacacctgtaatcccagcactttaagaggctgaggatcagctgggcacggtggctcatgtctgtaatcccagcgctttgggaggtcgagggaggcagatcacgaggccaggagatcaagaccatcctggccaacgtagtgaaacctcgtttctaataaaatacaaaaaatcagcgcgattttttggtgcaagcctgtaatcccagctactcgggaggctgaggctggaggattgtttgaggccagaggtcgaggctgccatgagccatgacaccactacactccagcctgggtgacacaaagtgagatcctctctccaaaaaaaaaaaaaaagaaaagaaaaaaaaagaaacttagaggccactctggattgaagcaacaggaaccatggaagctacaaaggttctgaggaagacaaaagcatcaaaaacatgatggcaggctctgctcagccagggagctaaaaacccagtggaaggcaaagctgtcctcagctaccctcactcaacaaaagacccttaaaaggctcagtgcaatagaacctgagtacttaaggcttgcggggtgagagcaggatttgtggattcccacatggaggcctttcctgttttcctcaaacctctaagacagcttgctcaggatttcacttcctgagacacaagtggttgctcagctctgaaaatgggaattcagctgctccatgagagctcaagcatgaaatcaattgttctgaagaacttcatgatgtgagaaaaacaaatgaggaagtagggttgtctggtcctgccatggacagatagtcaggaccctgataacaggttaggagggcagatgtcatttcctgaccccttctctctctttttttgagatggagtctcgctctgtcacccaggctggagtgcagtggccccatctcagctcactgcaacttctgcctcccgggttccagcaattctcctgcctcagcataccgggtagcagggactacaggcacgtgccgtcatgcctggctaatttttgtatttttagtagagatggggtttcaccatgttggccaggctggtcttgaaatcctgacttcgtggtctgccctcctcagcctcccaaagccttgggattacaggcatgagccactgcagatggttttttgcttttttttttttttttttttttttgagacgaagtctcactctgtctcccgggctggagtgcaacggtgcgatctcggctcaccacaacttccacatcccgggttcaagcaattctcctgcctcaacctcccagatagctggaactacaggcgggcaccatcataccctcctaatttttgtatttttagtagagacggggtttcaccacgttggcctgggtggtcttaaactcctgacctcaggtgatccacctgccttggcctcccaaagtgctgggattacaggcgtgatccaccgtgcccagcccccctgagcccttctctaagcccagtcccatactaacttgttcccacacattttcttatttcatcctcacaactctgcatttccctccatttcgcagtgagcaaatggaggctgtgagaggctcagtaacgtaaacccaatgccagcaggtggtaggactgaaactcaaaaccaggtctgctagctccaaagcccatgctctcaatccctatgcttgggcctacccaagatactcactttgctttcctaaacctgtttccttgtctctttggctggagcattgaacccaggcatgtctgtccacacatctctcttcccaaaagaaatccactaaaaaaccccaaccccaaaataaaaaaattagctcggcatagtggcacgtgcctgtagtcccagctacttgggagaattgcttgaacccaggaggctgcagtgagcagagatcttcccattgcactccagcctgggtgacagagactctgtctcaaaaaaaacaaacaaacaacaaaacccacccctgggactccaatacactcagcactacgttcaccctgtggctcactaagccccacaagactgatccctgtgtacctctccaattgctttctctcttttttcaattagttgcccaggctagactcgaactcctgggctcaagcaagtaatcctcccacccaagccaccacctggggcgccactgtgcctggctctaacctcttcttgtatcaccctcctcggtagctcatgcccactaccttcctttccccaaatgtgtcacaggcacagcactcactccttccccttcctatcccccatcgatctggccagctccacccagagctctcccacagtcccccctggacccagtacacttcagtgtggttactactctacagactgtcttccctgctcaaccttgagcaacaccaggtcagaggctctgtttctcttccactgcacatggtaggttctcagtaaaaaccagctagaccaatacatgaaatgcctgataaggggcagacttcgggtcctggatcagctgatccaacaacagactcttttcatctggtcggcaggcatgtgtcagtatcacttggaaggaaggagggaggaaggaagggctggccagaaagatgcttacagggtcaaagcacatttgtcagctacgacaacatcctccatttccttaaaagcagaaacaaccaaaatatccaacgatataagcctagcttagcaaatttcagtgtagctactcaatagactcaatccaaggtgggtggatcacttgaggtcaggagtttgagaccagcctggccaacatggtgaaaccccatctctactaaaaatacaaaaaactgccaggtgcagtggctcacacctgtaatcctagcactttgggaggctgaggctggtggatcacctgaggttgggagtttgagaccagcctgacaagtatggagaaacgccatctctaccaaaaatacaaaattagccaggcatggtggtgcatgcctgtaatcccatgacttgggaggctgaggcagaagaatcgctcgaacccaggaggcagaggttgcagtgagccaatattggtgccattgtactcgtgcctgggcaacaagagcaaaactcagtctcaaataaataaataaattagctgggcatagtggcgggcacatgtaatcccagctattccagaaactgaggcaggagaatcacttgaacctgggaggcagaggttgcagtgagccaagatcgcgccactgcactccagcttgggcgacaagagtgaaactccatctcaaaaaaaagaaaaacatgtgccgttggataaggacacacaggtacatggacggaaacacacacatacacacacacacacacactctctctctgctgtggggatgctgataggattgtgtgtcttctttcccctggaaacaaaaacataattattttagcacttggagctaatgttcttccctttctgagctctaaaaggagtggtcaatttcttatatcatcaacagttcaattttctagatctaccacaagctctaggtcattcctgccacatgtttccaggccttcattcccacccctactccctaccgccataggaggaaaacagaagggacaggaagagaaagcgtaggacaaggcccattattaaacaagtaatacctttcttggtcgtggtgaaatattttgagtcagtcattttggtcccttatctgtagccaggcttctgcaagagagagaagagaggggtgactttcagttatgctccatcccatcttcagttatggtgcagagggaggaggagaaggatccagaacacatgtggtacaggaaaacagctgcttatctatttcctggagaaacaaactttagatcatggcagattagattttgaaaagtaattctgaggaatctatcaacttttttttttttcttcagagatgggatctcaccatgttgcccaggctggtctcaaactcctgggctcagccaatcctcctgcctcggcctcccaaagtgctgggattacaggtgtgagccaccacacctgatcccatcaaatttttgaatgtgcctcttctagaaatctttcccacaaaaatatctgcacaaggatggacgggcttacagcagcccctttgtgggacccactttgctcagcactgtcctaaatgcttggcacacattaactcattagaagcctcatcacagcatcatcaaggcacgatgttaccctatacagtcaaatgagattagaaaataccaagcttaaaaggctagggagacttctccccatgacttctctaagctgctaaaacagtaacatgtatgattcatctgtggaaagggctagaatctatagcagttcccaaatctacctggccaaatttcttacaggctctctcaggacatctcctagagcaaagctcacggtgtaaagtactattgtaagacaataagggccaggtgctatagctcatgcctgtaatcccagccaaggcacgtggatcacctgaggtcaggagatcgagaccagatgaaacccatctctactaaaaatacaaaaaattagctgggcgtggtggtgcgtgcctgtaatcccagttactcaggaggctgaggcggaaaaatcactggaacccgggagacggaggctgcagtgagccaagatagcaccactgcacttcagcctgggagacagaatcctgctttgtctcagaaaaaaaaaagaccataggacaaagaaagtagtgaagctccgccattcattcaacaaaaatttactgagcatctactgtgtacctcaatagttcttctgggcaacagatgaaagaaaagaagttacacaggaacaaagataccctggatacatggccaaggcttctaggatggttctaagatttattaagaatctatcatttaccgagcccctattaaaggcaggagcttcacccacattacctcatttaatcttgtcaataatataactgctttgaatcccattttacagaaaatgagaaaaggactcagggatgttgcataatttgcccaaggtcaaatggcttgtaagtggctgggctgggagaccatctcaggtctacctgagcttagttcctatgctctatcgatgaaggaattctgcttcccgcttctgaaaaggaggacaattccttgacagtggctaaggacaaagtaaaaaaaaaaaaaaaaaaaaaaattgaggctggacgcagtggtgcacacctgtagtcccatctactcgggaggctgaatcacttgaacccaggaggcggaggttgcagtgagccaagattgagccacagcactccagcgtggtgacagagcaagactctgtctccctgtccctcccacccccccccccgcaaaattgagactttcaagtacagccttccaatcctatctgtagtttttatatgttatagaaaaccacacaactccaggccaggcgcggtggctcacgcctgtaatcccagcactttgggaggcccaggcgggcggatcacgaggtcaggagatcgagaccatcctggctaacacagtgaaaccccgtctctactaaaaatacaaaaaattagccgggcgtggtggcaggcgcctgtagtcccagctactcgggaggctgaggcaggagaatggcgtggacccgggaggtggagcttgcagtgagccgagattgcgccactgcactctagcctgggcgacggagcgagactccgtctcaaaaaaaaaaaaaaaaaagaaaaccacacaactccaaaaaataaaataggcatttgaatggagaacacccacttcactttgtccctttttttgcatctgtggaagtcacgctgaaccttggtaaacctttctgtttaagaaacgcctttgcagggaacacagaagcagagagaagcactcagttccagcttggggaggccgtgggctgcatcttgaccatggaaaggtcctgggaccaacccttagctcctcagtttctgccttgcaaggaaattaaaaacctattaggaagatacctgcagatggagcaggcctaaaaacacagccaccggtcagaatttcaaaccatattgaattctcatagaaatgaaatgcaaaagcacaaaatgacaacagctcaaactagtgaaaaaaaatgcaggacatttgtgaagcatttgatgggaaacattcttttttaataggaaataattattgatatggctgggtgtggtggctcacgcctgtaatctcagcactttgggaggccgcggtgggtggatcacctgagatggtggcaggtgcctgtaatcccagctacttgggaggctgaggcaggagaattgcttgaatctgggaggtgagggttgaggtgatctgagatcatgccactgcaccccatcctgggccacagagcaagacttcatgtcaaaaaaagaaaattattgataatttttatttaggtttgttatgatgtattttttgtccatatttttagagacacgaatggaatatatggactaatagataggatatctgcaatttgtttcagacaactgtgtaaaagaagttatttgaggccgggtgcggtggcttatgtctgtaatcccagtaccttgggaggccaaggcgggcggatcgcctgaggtcaggagtttgagagcagcctggctaacatggccaaaccccttctccactaaaaatacaaaaattagccagacgtggtggcaagtgcctgtaatcccagctatttgggaggctgaggcaggagaatcgcttgaatccgggagatgagggttacggagatctgagatcatgccactgcactctagcctgggcgacagagcaaaacttcatgtcaaaaaaaaaaattattgataatctttatttaggtttgtaatgatgtattttttgtccatatttttagagacacgaatggaatatatagactaatagatatgatatctgcaatttgtttcagacaaccgtataaaagaagttatttgaggctgggtgcagtggctcacacctgtaatctcagtactttgggaggccgaggtgggaggatcgcctgaggtcaggagttgaagaccagcctgaccaatatggtgaaacactctctctcctaaaaatagaagaattagctgggcatgatgggtgcctgtaatcccaactactcaggaggctaaggcaggagaattgcttcaacccggaggcggagattgcggtgagcagagatcgtgccattgcactccggccagggtgatagagcagactctgtatcaaaaaaaaaaaagttatttgattgtgggtgggtcaacattagctgtattatcctcctgtttccttatttttgtcctgtcagttttctgtaatatcttacaaggcagtaaagagagggcttagtcttgggacagcacccagggggacatcgagagaggagtctggcgttctacccagcagggccattgagaaggtggagacgaacgtggttctctttgctgcagaggctcagcctttacatccatgaaatggggccagaaagagtggtgagaatcaggacccttaagtttccttccaacttgtaagttgtgatttggggttggggtggctgtgattaagttccaaaagaacacatttatctgccgcaaggtggctctgtccaggcctggcctggccacccagcagctctggtgaaggcacctgtgctggaaacactgagggggggcctgacagtgcccaggactgatgaggagggctgggaagtgcatctcccaaagccacctcacctgctgacaggtaccctgggatgaatgtgtctctgacctcaggctgtaggggcacaaggtgggggctgagccacatgagtgagggagaaagtagggcctggtgagatggggtctagggtagctgagtcctgtgaaagcctgttcctgcctgtagccctcaagtcacatttaccctgccttgacctagtgtcacctggccccgattcctaactgaataggattctgacacagcctccatcagacaaccaatggatgcccattctgtgctggggaagatgcctttctcattccaagactagagatgattcaacagcttgtgattctcccttatttggaatcccactgggcccaatctgttttccattgccaatgccctgctgctaaaagtataccatatcaagcatcctccctaaagactgagggcccatcgtggaagaggagggcacatgagattgtaagagctggactgggggtgggggtgaagggtggaggccaaagcaactctatcttgggtgctgatatttgccatgttggcctctgatgaacccctgttccaggaggcctctaagagttccagtttacctgttgttctgtgtaagagcaggtacttgccatgaatcctgccctttggtcaaacaaccttgatgttactctacttcaattatcctacacatcccttgtaattcaccctttctatatggtatataagccctagagggtctgggggataatggtgcagggattcactatcttctcttaccacaaccggagacatagacagggcttctgttcataagtccctattaaatgtttctaagaaagtggatttgtcagctttcttcagcctctcagcctcctgggacttttagggatacgttttcacagccctgtcccctaagaaacagggattcattgctaatgttgaaaaacgaaaggttcaccaaaagcatgcaggagtagctacacttgtgtcagacaaaatagacattaagtcaaaaaacataaaaagagacatagcaggtcattatataatgatgaagagatcaaagcagcaagaggatataacaattataaatatatatgcacctaactcaggagcaccagatatagaaagtaaatattattagagctaatgagactctaatacaataataattagggagttcaacaccccagttttagaaatgcctagatcatctaggtaaaataaaataaagtaatgtaaaataagtcagattgaagctgcattataggctaagtagagctaacagatgaacagttgcagaatctacattcttctcctcagcacatgggatcctctccaggatggaccacatgttaggtcacaaagcaagtctcaaaaatatttaaaaattgaaatcatattaagtaatcttctcagaccacaatgaaatataacaaaaaatcaataacaaacagagttttggagcctacaaaaagatataaatcaagtcacatgctactgaaccattgggtcaatgaagaaatgaagatggaaattgaaaaatgtcttgaaacagatgaaaatgaaaacataatataccaaaatctatggtgtataataaaagcagtactgacagggaagttaatagcaataaatgctgacagcaaaaaagtagaatgctttcaaataaacaagctaacaatgtacctcatagaacttgaaaagcaagaacaaaccaaacccaaaatgagaagaaaagagataataaaagatcagagcagaactaaacaaaatagagacttaaaaaactcacagtgaaaggaaaagttgggttttttgtctttcatttttttgttttagatagggtctcgctctgtcacccagtctggagtgcagtggcatgatcatggctcactgcagccttggactccaggctcaagcaatcctcccaccccagcctctaaagtagctgagactataggtgcacaccatcatgccctgtgaatttttctattttttgtagagacgagggtcttactatgttgcccgggctggtcctgtactcctgctgcaagcaatcctcctacctcagcctcccaagtgctgagattacaggcatgagccactgttctcagccaagaagttgattttttgaaaagattaacaaaattgacaaactgtgagctaggctaactaagaaaaaagaagaagaagaagaagacccaaataaattaagaaatcagaaatgaaaaaggagacattacaactggaaatccagaaatacaaaggatcattagaaactattatgagtgactatattttaatactgacaaattgggaagactagaggaaatgcacagattcctgggcacatataacctaccaagattgaatcagaaagaaacaaaaaacctgaacagaccaatctcaaataataagattgaaggctctcaaattggaaaagaagtcttactggccttacttgtaaatgatatgatcttatatttagaaaaacctaaagaccgcaccaaaaaactgttagaaatgacaaacttagtaaagttttaggatataaaatcaacacataaaaatcagtagcaactgtatatgccaacagagaacaacctgaaaatggtgaaatcccactctttgcctgttcccacatttattcccagtatggtagccagaggtcacccaaggagagctcagggtgcaaattgacttggtgaatctctccggtctctcttttatttctattttgaatgcccactttggacattcctgaggttatcagaaacaatgtttccagcacgttggatgtatcagtatactatagaaatatgatgtgactcgtctatgtaattacatgttttctagtagccacgttgaagaaagtgaaaaaaaatcaagtcacaattattttaattggcaaaatgttttgccatttaaacatgggtttacatgatgcagttttcaaagatgatttttggggggcagtggggtggtctcagtatgatacccaggctgggcatgaactccacagctcaagcaatcaccccatctcagcctctcaagtagttgggactgcaggtgcctgacactcaaatatcttaatgagataatttaattctttttcagcctttcaaatccagtgtgcatttaaacaaatgtatccatacatttgtttataaatgtatatatacgcatttaaatatgtatacttttatatttatatatattgtgatgtaatggaaacagtaaaattatcaaagtttttaaaaatcttagtattaatactgtaactaacaaaacaacaacaaaaacaggatcttgtaaggctctgcttgattgtatgtgaacagttttagggtttcttttaaaccaaacttctaaatgtgcattttcacgatcttggagaaaaagtccctttaaataaatggtcacatgagtgtgattttagaaaaaacatcttagtaagtttgatagatttctttgatcaaaacatgaggagatattattctcatgagaaaactacttgaaactagccctattcatagattaatcttaatgccagatatttcattgtaacagtttcagccctaatcctgaatctttttatttttcctaagcagatagctacagaaatcccaaatcttatcaacacccataatatacatggcctaatttagaatgagatggcaatattagtctgtatcaattttaaaaacccttaagttaaaataatctttacttggggtaaccagtttacaacctcagttaaaattacggcatgattaaatcaaaatctgattgggttaaggaagataagcaggatgtaaatgagaggggaggagaggctcttgtaataaaaaccccttgtaagtggagctcactcaaaactgagctgtcggtggaagctactggaggccaggggagaacctaatggaggagacacacatccaggcttatgtagtttttctcgacttactagattcctaccaagggcaggtattagagagcaagggctgcaggatggagtcactatgaattcggcaacattgtttgagggcagctcaatgccaggcacagtgtgtgcacttagagagaccctgggtcaccttctaaaagcagacagcagaacttaaattttcagtacccagtctggagaaatgacagtcttcattttccttaatcatagtgtggccaactcgatgagatgatgatggagtttctctctttgacctattcaacctttcagctacttaggaggggcttttgccacagccagattagaacgattttgcaggggataggggtgttggagggtctctgagtctagtacatagctgtccagtagaaatataatgtaatccacatatgcaatgataagttttctagtagccacattaaattacaaaatgtaaattttaatacaaaaaagttatttcagcgtgtaatcaatctttaaaagttctttttttttttttgagatagagtctcactgtgttgcccaggctggagtgcagtggtgcgatctcagctctctgcaacctccatctcccggagacgattcaagtgattctcctgcctcagcctcctgagtagctgggattacagatgtgcgccaccaagcccagctaattttttttgtatttttagtagagatggggtttcaccatgttggtcaggctggtcttgaactcctgacctcgtgatctacccacctcggcctcccaaagtgctgggattacaggcatgaaccaccacacctggccaaagttcttaataagataacttacattctctttttctcatacctcttcaaaatccagtgcgcattttacactgaaggtgtgatacgctaacttacattaacttgattgactctctcttagctaagaaagctggatggattccattcggctccttcatttgcaagacattaagggctccttacccactccctccctcaaggacttaacttgtgcaagctgactctcagcgcgtcaaagagtgcaattaactgataagatactgtggcaaactatgtccacagttcccaggaatttgctcaggtgacagtactctaaagccccctgcatttgtgtctggagcccccctcctatcaccctgtgatgaatttaaagcccctgcacctggaactgtttgttttcctgtaaccatttgtcttttcaacttttttgcctgttttacttctgtaagattgcttcagctcaattccccctcccctttctaaaccaaagtataaaagaaaatctagccccttcttcagggccgagagaattccgagcgttagcgtctctcggtcgccggctaataaaggactcctgaattagtctcaaagtgtggcgtttctctataactcgcttggttacaacaaaggcacatcccaattccaataagccccatttggggtgctcaagaaccacatgtggctggaccgctgggcctagacccttcacaacaccagcttctcaactgaagaatcatgtccttcattccaactagcatttccgatattagaagttcaaggccatgactcttcttatatgtattttatagtgtttttatcacctatcactagtgattgtttatagcaggcactgatatgtctctatgcatgtaaaagtgaaagagcctaaaggagtattgtcattcagttaattgaactccaatatcatgtaccgtttctgcagacattggccatggcagaacattttaaagaagcaagtcgatgtgtcggctgcctatcttatcctgaaaaacccacttactagccaggcacattggctcacgcctgtaatcccagcactttgggagtctgaggtgggtggatctcgaggtcaggagttaaagaccagcatggccaagatggtgaaaccccgtctcttctaaaaatacaaaaattagccgggtgctgtggcagtgcctgtaatcccagctactcatgaggctgaggcaggagaatcacttgaacccaggggcaaaggctgcagtgagccaagatggcaccacagcactccagcctgggcagcagagcaagactccgtctcaaaaaaaaaaaaaaggaaaagaaaaaagaaaataataaaaacccacatacctagagtgtggatatctctgctgcttccgctgtatcagttcatttccaaaggagcccaatggggatgatgtattgtgcgccatctgctctgtggtcactataaaagacatcacgccccatctcctgctgggaaaactggtttccaaaatcaaggaagtggagccccagctgagaagaattctatattaaaacccaaggatgcggaagtttcaaggtcagaaatctgtataacctgcgctcggcccaccaacagccttggaaaaagcaactgttcaaaaggctctccattaaataggggcattagctgaattctggcacctaaaatgtgtatgcccacccaacaacagttctcagctgtgagtatagattagagacaacagaagattttgaagaaaatataacatttaagtcataccctagacctgtgctgcccaatatggtagccaccagtggctatggggcccttgaaacatgggtgtaccccatgtggaagtgacaataattctggatatacaagcttataatatgttatttaaagtattgttgaattttttttaatgtctacagaaaaatttaaaattacctggagatcttttataaaatgcaaattctccttctattggactaggctggttgagaatctggatttctgacacacactcacacacacacacacacacatacacacaaatttttttgagatgtggtttcatgttgcccagattggtctcaaattcctcagctcaagcgatcctcccacctcaatctcccaaattgctggtattactgacataagccgccgtacacagcctgatctaatagtataataaatagtttttccatcatctagatattcattagatatctatatttgaacagagtctgctaaattttatgattttgagagtaaacaacagacatggtttctgccttcatggatctcaagaaatcttgaataatcaaaatgtaaaaagaatgcttactatgaacaagagggatttgttacaattctatttcaatcttctctaagaaattctacggaatcagggaatgcagggaagtttctatttgctgatttaccttttttctttccacagtggatatgacgtcagatattgacacagccaacaatcgactcatcatttctgaagacctgtggagtgtccattgtggatttcttagaaccgcacagagtatgccgagattcaaacaagtcatctgtgtcctgggctcccctcgcttcacctctggacaccattactgggaggtagacatggggacaggcaaataatgggatttgggtgcctgcaaagaatctgttaatcgacaagagaattgtgtggtcttcagaacttggcttctggactgtgggtatgaggaaagaaaagctctttgcagccagcactgtgcctttaaccaccctctgggtgagtccggggctatgcagggtaggcattttcctggatatgggtatgacaatgatttccttttataacattaatgatgggactcatatctttacattcactaagatttctgctgcagagccactgtgcccattttatgctcttgcagattcaattatcgatgaccaaggcttcctatctgtcctgtgattaatcttggcattgacaaatctacagtttctcctgagcagggcaaataaacttttagccacaaaaccatttagacaatcactttatgctcaatgcaagaaacttttctgcttgccacaagataatggaacaaagttacagcagaaaaatatggaacatctcaaaccatgaatgtcaattaagtagattaataagaaattgccttttaaatactaaaaagtattgttacagttgtcctttgggttttatgggccgtggctccgtgtccctcccacacctgtccgagtggcttttgctggctctctgtgccctggctgcctcaccctgcaccgtgctgctgtctcattgacatcacatctcttctgcaaatctatcttgttgtctgttccttcttccctggagcatctgaaaggatcatcttgtgaatttgactcatttcctaagtcattctcacactctttacgttgtatccagcctggttttggcagaaagtttttctcacatacaggatacaccagggctggactctgtctttacatgtggttgtggagtgacccagaatccagcagagagcaaaccccaaatgattgctttatgaccggatccaattcattccaatcatgtaaagttaacttggctccctacacactgtctcccaagctttgttttcttgctcagacactgaatcccaaggagtgatctcatcccattgtacataattttttaatagaactaaatgtaggtctttcaaaaatatatatacaaagaaaaaaatctttatttaatatgtgatacattttaggagcgggaaatagattatattcaagttatttgaaatttgaaaacaaagctgttattttatgaattaagtacaagttaatcactaacttgtccatttccatgatacatgcagattcatcagttttctggtcaagacctgagtctcagcctggaggacattatgttaagcaaaataaatcaggtctggaaagataaataccacatgttctcactcctatatgggagctaaatgaaaaatgctgagctcacagaagcagagcatagaattgtgggtatagaggctgggagggtaaggggcaggggagcttggggagaggttggttattggatacagaattatacctagatgggagaaatgggctttagtggaggctgggaagggtaagggggaggggagcttggggagaggtcggtaattggatataaaattacagctagatgggagaaatgggctctagcacaactgtggggtaaatatggtcacttgtacatgattgcatattttcaaaaagctaagaggattaggaaggctcccatcacaaagaaataataaatacaggcggtggctcacgcctgtaatcccagcactttgggaggccgaggcaggcgggttacctgaggtcaggagttagagactagcctggccagaatggtgaaatgctgtctctactaaaaatacaaaaaaaaaaaaaattagccaggcatggtggcacatgcctgtaatcccagctgctcaggaggctgaggcaggagaattgcttgagcccaggagccggatgttgcagtgatccaagtttgtgccactgcactccagcctggctgacagagcaagaatctgtctcaaaaaaaaaaaaaaaagaaagaaatgtttagagtgtgctaattatcctgacttgattattacacactttatgcatgtatcaaaatattactgtgtgccataaatatgtacaattattacatgtcaactgaaagtaaagaggaaaaaaaagtaaaccaaaacaagacctgagtgtctcagagtcctctaatcccatgaggaatcatatttaaagccgaccaaaattaggtctttatttttaattatgcaaaaagagaaaattcctttaatatgtgccaaagggaatagggaaaatgataagattatattcaaattatttgaaatttgaaaacaaagcagtaaagatcccactacacagaaaggcatgaaaatgaaaagattcggggttgattcaaatggaagaaagcacaactcacttcacgggtaacaatttttatttgagaacacaagtttcacaagaaaatcatcttttttttttaaattgtgacttttatcttaacactgtgtgaagtactcaaggtccaagaagcttaatggtcatttgtcaaaatagtaattatccaattttttcctatgaattatgaaattttttcaaaaccagaaataaaccaatgaaaataaataaaaattccctagaatttcctcaatggaatgcatgcccctattacctttgagtctgatgtatatgaatttaaaccattttgtaaaattgcaaatccaatcatacttaatacttcaggtttccaagcaaagcttgaagcctacaacatattacaggaattatctttactgacaactgatggaaacatctctaaaataagcttttgaagttagtacattaagcctaatttaatataaaggcaatttaatcttatcttcatatgaaagaaaaatacactgtcaggatgaaggatttactaaagttacaattaactggagatatatcaccagtaaaaacctaattccctgttataattaaatcaaagcctcattaggttagagggtgtggaagggcatgacccagtgggaggtgggaatctcaccaataaaacgccctcatgtgccccttccgcacaagacctgagcgcccagtggaagcagctggaggacagaggagcttccagcagaagaggtgagcccatgcctgtgtgtgtgtttttcctccttagatgcctagaaatgggggttatgccttgggggatgaatgagagaaattcgtaattaatgaattcaacaaaggctgtctgagtgctgcctcagagttgaaaaccagtcaccctggatccccagatctccagtctaggagtggtggcagtcaatttggtattcatttccaaggctggagaaggatgtgatttttttttttttttttttggtgagacagggtcttaactctgttgtccaggttggagtgacctggtgtgatctctgctcactgctaatttttctattatttgtagagagggggtcttcctgtgttgcccaggctgatctcaaactccttggctcaagggatcttccagccttggcctcgcaaagtgctgggattacagatgtgagctactgcatccagtccctctctttttttttttttttttttttgagatggtgtctcactctgttgtccaggccggagtgcaatggctggatcttggctcactgcaacctttgcctcccaggttcaagcaattctcctgcctcagcctcccaagtatctgggattacaggcgtgtgccaccacgcctggctaattcttttgtattttcagtagagatggggtttcacccatcaggctggtctcgaacttttgacgacctcagatgatccactcacgtcagcctcccaaagtgctgggattataggcctgagccaccacgcccggcctcccagcccctaattcttatgttcatcaatcaatctcttgctggggttcccctaggaggaggtgaaatgaccccagctcgctgttcctcacatgggtgctgccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacacaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaaggtgagggatctgtatacactgcccccttcctacgaccagaccaggaaaaatcatctgtgcaactggcccctcattccatatggggattagctgctgtctggcacctaaaattgagatgcttcttcatcatcagattctcagccctgacaacatacagaatcacctggtgatctccaaaaaaaaggctggctgggcatggtggctcatgcctgtaatgtcagcactttgggaggccgaggcgggtggatcacgaggtcaggagatcgggaccatcctggataacacggtgaaaccctgtctctactaaaaatacaaaaaattagccaggcttggtggtgggtgcctgtagtcccagctacttgggggttgaggcaggagaatggcgttaacctggggggggcggagcttgcagtgagccaagattgcaccactgcactccagcctgggtgacagagtgagactccgtctcaaaaaaaaaaacctgatgtctatgtcatgggttagacaagggattctctaaacttagtgtgctcagattacctggggatcttgttaaaatgcagatgctgaactgggaagtctcaggattgatcccgctggcttggggactttgctgagtagcaaaaacacagagcaacttaatttgaatttctctctagcaaaggttcccaggactctgacatttaaatgggcctggtaattctaatgcacagtgagtattggcacccactgtaccaaacaacctcaccccagggttgggaagagtttggaatggagcacctatggtgtttgtttctgtgagtggggcgagttgcagacgctggtctcctcatcggtgtgccatggacttcaacaggggtcctggctacagaaaatactatcactctccataactctggggaatagggacatttaaatgaagaggttatggtcagcctgggcaaagaattacacctataaatggtggtggcttctgccctgacacccatgatctctactcatccacctacccatacctgactgtgtctctgctgaaatatggaggacagattcaccctgcctaagtcatgtttggaaccctcttcctccttccttgtccatgtccactcatctcatttcattccctaattcaccatcaaacagcaatcagtctcctcaagtcttactgtaatctataaaatctatattggtgatcatcagttttttgacttgaaggatcatatgttctgtagatttttttttcagaatgctctggacaattaattttctttaggccagatcacactgcctcctccatgagaattggcagcttcacctatcaaccacatacccaatgcattaaattattgacctttgtatttactgcccttattctctacgatcagtcagttatgacgaacaactttctttttttttttattttttgagatggagtctcgctctgccgcctaggctggaggtgcagtggcatgatctctgctcattgcaagctccgcctcctgggttcatgccattctcctgcctcagtctaccgagtagctaggactacaggcacccgccaccatgtccggctaatttttttgtatgttttttagtagagacagggtttcacgtgttagccaggatggtctcgatctcctgacctcgtgatccacccgtctcggcctcccaaagtgctgggattacaggtgtgagccaccgcgctcagccaacaaacaactttcaaatacctttctcttcactccaaaatttaccattgttttgcttaaggtttcacctcccatgtaggatggaaaacattctttcatctaaggcccccctcttcctcctggccttggagcctcctaatgtccaggaccggcacctctgtcatcacattgtcagctgcagagataccctacctgctgtcagaaccatgcacaattaatttgcttacaaacatggaaaacaaaggcctggaatcatgctctatatactgagttgagcaatacaagatggaagcagaaacatatttaacatcgaccatttgcattgtcttaattatcattcattttttcatgcatcaaggtggtagaaagggggtcatggtgtctgccttcagagaccctccactctaaatgaagaaaagtccaatgaagcaaacacgtgacataaagtaaaataattgctactgtgaataagagttgggtattgccacaaagcatacctatgagaatttgaactagtcagggaagttgcctcatgaaaagttttgattttgggggaagaagagaattaaagaaaccaaagtcaagagatatttgggcctttgaagtagaggagaggcatggggttggcttctgtccattttctgatcaactttttttccttttcacagtggatatgaccttggatgccgacacagccaacaacttcctcctcatttctgacgacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttacagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaaagtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatcacctaatggattatgtgactttctttcctcagcctcctgagtagctgggattacaggcaactgccaccacgcctagctaattttttgtatttttagtagagacaggatttcaccatgttggccaggctggtctcgaacccttgacctcatgattcacccacctcagcctcccaaagtgccgggattacaggcatgagccactgcacccagccggattatgtgattttctaaatgataggagtacgatagattttattcatagtaaatgcgtgagcgtgtgtatgtgtgtgcgtgtgtgtgtgtgtatttggacagagagctggataaatgcctatgtcctaaccagaactgaaaaaacaagttgttgccatcattgctcagtataggtaacattttcctggatgtgcattcatctacattaacaacgataattccccccaattaattattataattattaattataattgttaacaattaataaacctctgcaggctaacaaagcaaaaaaaaaaaaaaacaaacaaaccacacattactcatattagaaatgaaagaggggccacgtctaccaaactgttgagcattaaaaggataatcagggactgttatgaatgactctattcccacagtttgataacacagtctctcaattccttgagagacataatcttcccaaggtcacactagaaacagacaatctgaacagcctctgcctattaagtgaattgacattaagaacattccaaaaagacaacaccagaaccaaatgatttctcttatgaaatccaccaaattcttatgaatcctaacatattttcacaatataatccaaaaattgtgctcctaggtatgtactcagctgaaatgaaaagttatgtccacacaaagcctgcacaggaatgtttacagcagctttatctataaccacccaaactagaagcaagatgttcaagaggtgaatgaaaaaaaaaatcatccataaaacacagtattattctgtgatttaaaggagttctccaacaaggcatagaaaagacaatggcatatatcagaaagactgtgagggcatgccttcactggatgagacacacagaaaggcggcagagcagggtgactttatgttaattagtgaagtaagttcatctgaaaaagctacataatactgggttggtgcaaaactagttgcggtttctggcatttaaagaatgggaaaaccgcaattacttttgcgtcaacctaatacatgactccaactacatgacattctggaaaaggcaaaaccaaggggacggtaaaaatatcaatagttggtaaggtttctggagaaagaggacagagattcacaagtaaagaagagggaagttttggagcggggagagtattcctcctgagatcaaaatggtaaacataacatcataaatatttcaaaattcatagaaatgtgtaacaggaagaaagaacactatgtgaatgacagactttagttactaatgtatccctttggcctttctcttcaaggatccctgaggagacagagccccagtgccctcaggcatccatgcttagaatgaagccacaccccacccctggtatccagaatggtccggttccaaacgtccctgggagaactgtgagcagaaggtcctgtgcggcagaaccccaggccggaggggtggcagggctgaccctgcacatccagcagttctgttttctctccctcccaccccaggctcttctcctgtcatttccctgcatctccctgtttcttcctgtctggatctttctccttccctccctctctctctcgcgttgagtgtgcgtggtctctgtcactgctgccttggccacctgcagacgtctctctctgattccacccatgggttcactgacatccgacatgggatgctcttggtgcttcctagcacaccagcccagtcctgagagggaactggcagccacaggcacacagactcatagggcacaggagcctacgaatacatggccccctcttccgagctgcaagtggactattctatttattttttttattttttgagacggagtcttgctctgtcacccaggctggagtgcagtggcccagctacttgggattacagaattgcttgaacctgggagacggaggttgcagtgagctgagatcacaccacagcactccaccctgggtgacagagcaagacttcacctcagaaaaaaaaaaaaaaaattagccaggcatggtggccacacctatagtcccagctacttaggaggctgaggttcacctgaacctggaaggcagacgttgcaatgagccaaggtcatgccattgcactttagcctgggtgacagagtcagactcatctcaaaaaaaaaaaaatctcctttaattcccacaaccaccctacaaagtaggtatcattacttcccccatcttacagagggaaactgagactcagggagggaggcgattcacccaagatcacacagctggctagaggcagaacctggctgcctggttccaaagcccatacccttagctgtcatgcagtacagcctctgcctattctgagctcctcaggaacacagacgacatctttcctgactgtgggtgccactccccagcatgagaattgtttgccaaatgaatccgtgaatggtcgtgcagaagaaggtgcgctccaagagggcacaggctatattgttttattcctgtgtctcagcaatatccaaaaagagccaggcacagtgagtgcccattagacatctactgaatggatcaaaaaatggtttgggccaggtgtggtggctcacagatgtaatcccagcactttgggaggctgatatgggaggattattcgagcctaggggttcaaaaccagcctgggaaagatggaaagactccatctctacagaaaaatttttaaaaaattagccaggtacagtggagtacacctgcagtcccagctactctggaggctgaggcaggaggatcacttgagcctggaagttcaaggttacagtgagcaatgatcgcgctactgcactccaacccgggagacacagtgaaactttgtctcagtagaaaataaataaataaataaacaaatattttaaaaacttaagaaaatgaatggtttgggggctcagtgaggtggtgggacttgtgggacatccagatgaaagagcaaacctgaagggtggcccagaggccaggactaaggatcagggaagccacaggtggatccaggacagtggatgagacacacgaggtggatgggagtgggggtggcagagttgagtgggggacaggagaccaaaagacaaccgcagtcccccccattgtccttgggggatacattccaagatccccagaggaggcctgaaaccatggatagtactgagcccatatatactatgtttgctcctatacacccatacccgtgaaacaatttcatttataaattaggcacaataagagatgaacaacaagagtaaccaaaaaggacaatgataacaacatcacgttcataatttcacagatagatttgttcttaccataggtcttagcaacctcagcatataatttttttcttttcttttttttacaaattcaacttttatttagtttcaggggtacatgtgcaggtcggttctacagataaattgcatgcttggtatacagagtgttttgtcacccaggtaataagtaccatacccaataggtagtttgttttggtttttgagaaagagtgtcactctgtcacccaggctggagtgcagtggcatgatctcgcctcactgcaacctctgcctcctgggttcaagcaattctcctgcctcagcctcctgagtagctggaactacaggcactcaccaccacacccggctaatttttgtatttttagtagagatggggcttcaccatgttggccaggctagtctcgaactcctgacctcaggtgatccgcccgccttggcctcccaatgtgctgggattacaggcgtgagccatccagccaggcctcaataggtagttttacggctctcactctccaccttcaagtaggcccatatctattgttctttgcatccttctttgcgtccctgtgcactcaatgtttagctcccagttctgagtgagaacatgtggtgtttggttttttgttcctgcattagtttgcttaggatgacggcctccggctccattcatgttgctgcaaaggacatgatctcattctcttttacttttttccctagagtgctcagcagattttctttctttttttttttttttttgagacagtcttgctctgttgcccaggctggagtgcagtggcgtgatctcagctcactacaacctccgcctcctgggttcaagcaattctcctgcctcagcctcccgagtagctgggattacaggtgcgcaccaccacgcctggctaatttttttttttttttttgagacagagtctcactctgtcgcccaggctggagtgcaatggtacaatttcggctcactgcaacctctgcctcctgcgttcaagcagttctctgcctcagcctcccgagtaactgggattacagtcacccactaccatggccggctaattttttatatttttagtagagatggggtttcaccgtcttggccaggctggtcttgaactcctgacctcgtgatccacccaccttcaccccagaaagtgctgggattacaggagtgagccaccgtgcccagcctaatttttgcatttttcagtagagatggggtttcaccatgttggcaaggctggtcttgaactcctgatgtcaggtgatccacccacctcagcctcccaaagtgctgggattataggctggagccactgtacccggcgattttcttcttttcttattgagaacttttatcttttcatttaaaggaagcgcttcacaacttctctttggcatatctgaattgccagcatcacgaatcttgctctttggggctatagttaagtcagataaggatttcttgaacacaagcactgcaaaactgtgatggttgatttgataactgggagggctactacgtgattatggggtagtgaaaaatagcgtgggtacattggacaaagggaggattcacaccccagtcagctggagatttcatcacactgctcacaatggggcgcaatttaataatatgtgcttggtaaacattttaatgatggggttagtaaggggtggagcagggactcgaacctgcatctgtaaggctcttttctggcttttaacagccactcctaagctatgtgtacctggccctcccatgtcactgtgtgctctttttttttagagaccactctgtcacccacccaggctggagaacagtggcatggtcatagctcactgcagccttgaactcctgggctcgactgatcctcctgctaattttattattttttgtaaagacagggtcttgctatgttgcccaggctggttcttcatctcgtgatctgcctgcctcagcctcccaaagtactgggatcacaggtgtgagctatgctcctgtcttagtggttggaagctcaggatctggttttgagaacggataatgacaggtgagctgaacaaagaaatggtgaaaaaacagcagctcagggtggtcaggactcagaaatgcctgtggtggacccaccgtgggagctacaggtggacaaatgtacacactttgggatgcgctcagacaccccctggaatgcctgctgagatgaattctgagtatacgcttggctcctgctagagggttgagctggacttcctgactgctcaccagtcccatgccaggctctatctgatgcatttctttttattttattttatttgatttgattataaaccaccttttgaaaatatctaatgcatttcaacccccaaaaatgtgctgagctacccagggctacccagcgctgccactgccccttcagctctctctaccctggcaccctctctccttcactcctgtcactggctcacctgggccctgcctccctggcctgggtggcattaacagcctccaacgggcttctttgccaccagcctccccatcttcctggccaaagcaatgagccttccagtagagccccaaccagatgcccctcctgcttacgacccgctgaaatccctggataaagtgcaaagccctctctgaggcctcaaggcccctcagaacacagccctgtgccccatctggcttcatatctccaccatccctcctggagccagtcccaccatgatgaagacagttggccccaccacactgaactgcttgcagtgtccccacacacatcaccaagtagaggcaggccctgccactctggagtcctgtgatataggcccacaatacttacttctctgtgtctcagtttccccatctgtaaattgggggtaataacagaacctagaggcaaagttgcagggaaggcttcctgggccgatgcatgtgaagagcccaatagggtgtgagctctcagtacgcctgagctgctgttattagtaactctatcatcactgggttggtgcctacttctcaaggttttgagggagaacaataagaattagtaccaggggctaggtgccgtgactcgcacctgtaatcccaccactttaggaggccaaggcaggtggatcacctgaggtcaggtgttcgagaccaacctggccaacatggtgaaaccccatctctactaaaaatacaaaaattaggcaggtgtggtggtgggtacctgtagtcccagctactcgggaggctgaggcaggagaatggcatgaacctgggagtaagagcttgcagtgagccaagatcacgccactgcactccaacctgggcaacagagcaagactccatctcaaaaaaaaaaaaaaaaattagtaccaggatctccgggtatccccacatgcagggcacgaagaggttagcctcaggcaggaaggcagcacaggctggctccaggggattggtgggcaggcggccaggtagctcttacctgaagcccaggtgcttgtgcatgtgcttaatgtagtgtccatgggatgaaggggtctaagtgggcttcagacatgttgcaggatgggcagagggtgtgctaccctctcgtggctagctgagcagccatcactctggcatagatgagtgggatgctgtgcagggtagcctggctgggcaccaccgagtgggtctgtggggggaagcgctggcatcggagctctgatgtctatgggagaggtggtgccatgaaggccagcagggcccatggaggcaggctccactgcgcatgggatggagcatcccccttagctcacgcaggcctccggagagtttacccacatggtccagccacacagcagatgggtatatgcctgaaatgcaaggatataaacatggtttactagcacgaagagatgttcgccacacatcgttgttaagaaaagaaaaaagggccgggtgtggtggctcatgcctgtaatcccagcactttgggaggccgaggcgggcagataatgaggtcaggagttcgagaccagcctggccaaaatggtgaaaccctgtctctactaacaatacaaaaaattagccgggcgtcgtggtgggcacctgtaatcccagctactcaagaggctgaggcaggagaatggcttgaacccgggaggtggaggtttcagtgagccgagatctcgccactgcactccagcctgggagacagtgagagactctgtttcaaaaaaaaaaagaaaagaacagaaaagaaaaaagtaggtttgaaaactttacatacaacatccaaaacgtggaaacaactcaaatacccgtcaactaataaatggacacaatgtggtctatccggacaaacagaggattattcagccttgcgaaggaataaagcactgacacatgtgacaacacggatgagcctagagggcattatgcaaagcgaaggaagccagacacaaaggacaaatattgtgtgatcccattcatatgaaatgcccgaagtaggtaaatccatagagacaggaagcccattgccagggagtggggaacagagggtgggaagtggctgctaacgggaacagggttcctttggggtgatgaaaatgtttcacaactagggaggtgatggttccaaaatgttataaatgtcctcaatgccatagagttgtacactttacaatgagtactttcatgatatatgaattttacttcaattttaaaaaattaataaataggccgggtgtggtggctcatgcctgtaaacccagcactttaggaggctgaggtgggcggactgcttgagcccaggagttcaagaccagcctgggcaacacagggagacctcatctttacaaaaaattagctgggcgtagtggcatgtgcctatagtcccagctacttgggaggctatggtgggaggataccttgagcctgggaggcagaggctgcagtgagccgagatcacaccactgcactccagcctgagcaacacagtaagatcctgtctcaaaaaaaaattaatacataaaagccgagaccatgcagtgtaattccagttttgttaagtacacacaaacacaggcccacatgttagcaggagtgggatcatggataacatctatattcttttttttgcttatatacatttcctaaatcatccacaataaacataaagaaggaaaaaaaaaagttttaaaaatatttggcagagtgcggtggctcaggcctgtaatcccagcactttgggaagccgaagagggtggatcacttgaggtcaggggttcaagaccagcctataatcccagcactttgggaggccgaggcgggtggatcacttgagatcaggagttccagaccagcctggccaacatggtgaaaccctgtctctactaaaaatacaaagattagctgggcgtgctggcatgcacctgtagttccagctactcaggaagtcaaggcaggagaatctcttgaacctgggaggtggaggttgcagtaagctgagaccatgccactgcactccagcctgggctacagagcaagactctgtctcaaaaaaaaaaaataaccaaaaaaaaaaaataaataaaaagtacctactgtatgcccagcttcatgtgaatccaagaaataatatctgatattggcacagcccttgacagtcacagaataccttcagcccctcaggaagccatttctgcatcctcagtttctaggtgagacaattaaggctccatcaagtcaagtcactctgggtcctaggcctggacaccatgaatgcatggacaggtgagaataaagagacacccccaagaactacagatgcagagcaagattgctttctttttcttcctctttttttagagaaagagtctcactgtgccacccaggcaagatcataggtcactttaacctcgaactcctgggctcaagtgaccctcccatccagactcctgagtagctgggactatagcgcatgccatctctgccatctcacccaggtgcccagcagtatttctcttttctcttttttctctttctttctttcttctttctctctcttccttccttttcttcttttctctttttctttctttcttctttctcccttccttttcttttctctttttctttctttctttttctctttctttcattcttttttctttcttttctctttctcttttttttttttgacagagtcttgctctgttgcccaagctggagtgcagtggcacgatctcagctcactgcaatctccgcctcctgggttcaagcgattctcatgcctcagcccactgagtagctgggactacaggtgcgtgccaccacgcctgcctaatttttgtatttttagtagagacagggtttcaacatgttggccaggctggtctcgaactcctgacctcaggttatccacccacctcggcctcccaaagtgctgggattataggtatgagccaccatgcccggcctatttctttttgttgttgttgttgttgttttttttgaggagtctcactctgtcacccaggctggagtgcagcagtgtaatctcagctcactgaaacctctgcctcctgggttcaagtgattctcatatctcagcctcctaaatagctggcattacaggctcccaccaccacgcctggctaatttttgtatttttagtagagacaggatttcaccatgttggccaggctggtctcgaactcctgacctcaggtgatctgcccaccttggcctcccaaagcgctgggattacaggtgcgtgccaccacacctggcccccagcagtattacttataagcctctagtgcatactgggccctcctgggacaatcttcttattcccaacaacagctcacactcatgcacacttctgagcctttttctaggctggacacctggcctggaaggtctctctgccgctccccaccgcacctcacccccaccagcctatgagcttccccatctgggaagcctgccctgctttgaagccaagaacactgtggaaggagtttctcccagccctaaggatgggtctaagaaaggaggtgcctaggagaggtccccacaggcaggaggcctgcagcaccccagactcagctgggctcctgctaaccatttcagaaatacagatttttagaaaaagtttgtttttcctcttaactataaaagtgacacatgcttgtggtttaaaaaaaaaaaaaaaaaaaagccaagcgcgatggctcacacctgtaataccagcactttgggaggctgaggtgagtggatcacgaggtcaggagattgagaccatcctggccaacatggtgaaaccccatctctactaaaagtacaaaaaattagccgggtgtagtggcgggcgcctgtagtcccagctactcaggaggctgaggcaggagaatcacttgaacccaggaggtggaggttgcagtgagccgagattgtgccactgcactccagcctagcgatggagtgagactccatctcaaaaaataataataaaaaaaggttgaggccgggctcagtggctcacacttgtaatcctagcactttgggaggtcgaggtgggtggatcacctgaggtcaggagtttgagaccagcctggccaacatggtgaaaccccatctctactaaaaacacaaaaaattagctgggtatggtgagatgcatctgtaatcccagctactcaggaggctgaggcaggagaattgcttaaacccaggaggtggaggctgcagtgagctgagattgcaccactgcactccagcctgggcaacacagcaaaaactccgtctcaaaaacaaacaacaaaaaaggttgaaacagaacaaaacccctctgctctcatctcgcagaggtcatccctgagtcagggtggcagtccctccccggggggcagaggagagtgcctatggttgaggctggggactctgcaactgggggtaccagtattaaatcaacacctgctgatcccatgggccttggacaggtttcttggctttttgggggccactgtcaagtggcgagtataaaagcacctccccacagcaaattaaaatctggcatgtgcacatacagtgcttggcgcagggctcacatgagaaacctgctttctgggtggtggctggtgttcttggtaaatcttacatcctcccatagcagccagaaaagtcctgggcagtctgagatccataaagcctgctcgattgcacaggtaatactcaaagtgacagtaacaaaatgtagccaagtcctgtgtttggcaccctccccatggtctgtgtgctaggtgtgccggggtcctggcccagagagtacactctctcccctgcccctcacccacccttgtgccccaagcctgtccctcagaggcttccctgaccctggagcaggcccacagcaggcgcggtgctgcaggcagtgtcctcccaagtgctgcgagaggctttttctctgtaaccttcccaagctcccggcggctgtaagtcttctcctggcagggactgcagaggctcagcctggtgcttgggcaggctgcctctcttgtcctccttctggctctgcagaatgcagctcctctccaaggccagggcaggatgcccagggccaggcgactgcagcattcttgtcctcatccttcaaggccagcccgaggactgagtcccttccccatctgaaatcaagggtcttgggtctgaatctttcctaagattctgatgagaatcatagtcactatttctaaagaatgctcacatacacacaacacacaattttgcataaaactttaccagctacttctcccaccaagtttgtcatgaatcagccaggtaaagaatttccacatttcaggagctactgctatttgcaaaagcaaactgcaaaacagaatgtatagtgttaatcttttaaaaatataaattttaacatataaatgcatagaaaaatctgaaaaaatctgtgtaagtggctctaatgcttatctgtagacagtggctttcaagagctttcattgtatacctcaggcatttttgtatatgaatttttttatttttgagacaaggtattgttctgtcacccaggctggagcacagtggtgtgatcacagttcactgcagcctcacccttctgtgctcaagcaatcctcccacctcagcctcccaaggagctgagactacaagtgcacaatgacatgccagctaattttgttcttttttttagagatggggtctcactgtgttgcccaggctaatctggaactcctaggctcaagcgatcctcccacctcggcttcccagagtgctgggattacaggcaagagccactgtacccggccttaatatagttttttttaacatgcgtttaacttttaggaatttctttcccatttaaaatagaatcctataatgttatcaccaactatctcaaattctccaggccactgatccttctgttgagcaaatagagtcgaccatcaccccagaatagtaatgaggactccagcttctgaagttcaatctacaattgatcaatctgacatttacatttaccactgggttcctctgggaaaggtattaacctatctaggcctccgattagccttcaacgtggattagttgcagctcctaaacttcaaagggtttcttacttcggtaaaaataaaaaaaaaagatcaatgtgttttgttaatttttttttttttttgagatggcgtctcacggtgttgcccaggctggagtgcagtggtgcgatctcggctcactgcaacctccacctcccgggttcacgccattctcctgcctcagcctcctgagtagctgggactacaggtgcccaccaccatgcccgactaattttttgtatttttagtagagaaggggtttcaccatgttagccaggatgggctcaatctcctgacctcgtgatccactcgcctcggcctcccaaagtgctgggattacaggcgtgagccaccgcgcccagccttgtttttttaatttttaaagaaaagactcgagtaagtcaggctctcagggaccctgcctgagtccccagtggaaatggttcgtcttagggctgcatcatttgccccagccaacttcttaccaactggagggtctcaaggtgggcccccagaaggtcctgcagggctgggagcccagaggacaaatatggctaatggaatccagcctggactcttacatctggcaccagttcagcaagtgaggatataaaaaaccagacatcacctcatcgctgtctcatcaaaaaaggagactttctcgctgcacattcctgcagaggacaaattcctgctcatgtattgcttgggagggagcaagaagagcagagtagggaatctgaggagttctccccttcttgggaatgggagagcagcccaggtcatcacagcagccctgagactggcctcttggtaaccatgacaacctcagctcccaggcactgtgtggacatctgacatgcggagaccctcctccactccttcctacaactctgaagaagaacctggttctgcgaggtgagggggcttgtctgaggtcactgagctgcggttggaacttgcccctgtctgacgaactcccacgccgatgctctcagcttcccaggagccaagaggcctgtggtctaagcgcagctcttctcaaactgtgtgagtgagcttgggcaggtctaagacccctcctgagtgcttcagtatccctctcaggatgtccagaggaaaactccaggctgccccacctcttcctccaggatagtctgtcatcagtttacacgttgggctttcctggaaaatttagaacacagggcctgacagtgtcagaaagataactaaaatgaacaaacacaaccctcacagttgcgttaagaccagacagtctctaaaagctacaataggcgtggtggctcacgcctataatctcagcactttgggaggccgaggcgtgtggatcacgaggtcaggagttcaagaccagcctggccaagatagtgaaaccccatctctactaaaaatacaaaaattagctgggagtggtggcaggcgcctgtagtcccagctactcgggaagctgaggcaaagaactgcttgaacctgggaggcagaggttgcagtgagctgagatcgcaccacggcactccagcctgggtgacagagcaagactgtctcacacacacacacacaaaagcaacaataggaaggtccccacagttccagatccccaatgtgctctctctagaaactgatggccccattggatcccctggccctgcctgctcagcccacctgcctcagggtcctcatggcttctcctcctctgatcccaccctgaaggatatggggtcccctcatgcccctcaccctgtaggcttctcaggactcctcagcagggctccccaaggacaatgtaaacagcaaaactaggctaagatgttggactcaagggagtggagcctttggtgtttcaggagaatctataaatccagatttttatgctaaatcgcccagtcatttcatgttgacaactataaccctcatttgccatatgatgttttttcttttttttttaagagacagggtcttgctctgtcacccaggctggagtgcggtggtgcgatcatagctcactgaagcttcgaattctgggcttaagccattctccacctcagcctcctagtagctgggattacaggtgtgtgccaccatgcctggctaattttttaaaattttttgtagagatgagggtcttgttatattgcccaggctggtctcaaactcctggcctcaagtcatcttcccgccttggcctcccaaagtgctgggatttcaggcatgagccaccatgccctgcctgctgtatgatttcacatccatttgctgtccctcctctgctcaccatctggaaaggtgggggaactaacccttcaaactacatttcccaagctcctttgcaaaccggcgttgattaggtccagccaatgggaggcactgaagggagactggcagatagaagaggcccgggtttttccagcctttgggcagtggctgggtcttctccaaacttacaattccctccagatagacctctgtggtcccaggccatgggtttgggtaacccacctctgtccagcctcctgtttggctttccaaaatttcccccattggaccccctaaagtgggttctgtttttctgactgatagggcaactaactcaaatcctctttttttttttccatatttaaaatggctgtgtaaggccgggcatggtggctcacgcctgtaatcccagcactttgggaggccgacgcctgtggatcacttgaggtcaggagttcgagaccagcctggccaacatggcgaaacctcatctctactaaaaatacaaaaattagccgggtgtggtggtgcatgcctgtgatcccagctacttgggaggctaaggcaggagaattacttgaacccgggaggcagaggttgccatgagccaagatcacaccactgcatgccagcctgggcttacagagcaagaccctgtctcaaaaaaaaaaaaaaaaaaaaaaaaaaaagatgggcaaggaaaagaaaaaaaatctatacacaaaactgcccatttttaccattttaagtgtacaggccagtggtattaattatattcaaaatattgcacaatcattactactatttccaaatcaaatccctttaatgtcctctgtggttctgcaggcctgtggatgcctgcttgccacctctgatttgcagatggcaaagatccccagccaggtgcagtagctcatgcctgtaatcccagtaatccctacagtttaagaggctgaagcaggaggatcacttgaggccaggagttcaaggcaaagattctctcatgcattctctccccagagcatcccaaatcccatgaagttaatggggagagggatgatcaccctaatttcatagaggagggaactggattcaggcagacccagggctcctatgtaagaggggaaccccaaaggcctggttcctagccctgtgctctgtctgtgccccacccagcctcctggtagcctcctccccaccctccaaacctgtgcacatattcactgctgccctgccctccaccaaagctaccctgggcaacagggtggaggtgggagtcctggtttcctattggacatcataagactggacaccaataagagtaacaacaacagggctgggcgtggtggctcacgcctgtaatcccagcactttgggaggccaaggtgggcggatcacctgaggttgggagatcaagaccatcctggctaacacggtgaaacgctgtctctatgcaaaatacaaaaaaatagctgggcgtggtggcacatgcctgtaatcccagctactcaggaggctgaggcaggagaattgcttgaacctgggaggcagaagttgcggtgagacgagattgtgccactgcaccttaacctgggcaacaagagcgaaactctgtctcaagaaaaaaaaaaaaaaagagtaacaacaacaatcccccaaatatttatgcacacaggggaagggactgggtcagagccctgagcacaggccccaagggtcttgtgtctctgcttttcaggggtcacagggaagtctagggtggtggaaaagcccggagcctccctaactataacactccagtcaccacttctggagcgcttactgcattctccaagcaattccaggtactgtctcttaatcttcagagaaaagaggctgctcggggagctattatgcccactcggttcccagcagaaaggggtggagccagcatccctgccctgccctgccgtgatgtgccctgtgtgccccgcctgcccagtgcctcctcactctggcccctgcctttgctgggcttgtttccccacactgggcccgttctgtgaggaataatgaaagcaagtgtcagactgcctgaagggaggccccctcagcccaaagcagcccttcaccattgtagccctgccgggctgtgggcctgagcccagcctctgctgcagcctggggagcagatccaggcaggcagctccgttgaggaggcacagcaacagccggaggggacctgggacagggaggggaccccagatggggagatggaggcctctggtggcccgatatctttgccaggacatggtggaccctgtcccaagccctgagcagccccaggtgagatgggcatcccacaggcctgggtttaaacctggttctaaataacacatgctgggtttgtctgggaacacacacactgctgagaaggacacctgagaatcagatcaccccggctgcttccctaggaggatttgggtggctggggacagaagagaagggagatttttcactgtctacccttcgcgccttcagacttttgagccattaataaataattcaaaaaatttaagccctggtttggtaaacccttctaggagcttgttctgaaatggaggccattccaacaaatgccagctctgtcaccactagctctgtgagttgcgaaaatcatgtcacctctctgtgcctcagtttcctcctctgtgaaacagatactagaacttgtccactattcacaaggttacgaacgatcaagatttggtcatctgaccaggcatggtggctcatgcctgtaatcctagcactttcggaggctgaggcagacagatcacttgaggtcaggagttcgagaccagcctggccaacatggcaaaaccctgtctctactaaaaatataaaaaattagctgggcatgctggcacacatctatgatcccacctactcaggaggctgaggtggggggattgcttgaacccaggaggcagaggttgcagtgagccaagatcatgccactccagcccggggaaacagagcaagactccattaaaaaaaaaaaaaaaaaaaaaggccgggcatggtggctcacgcctgtaatcccaccactttgggaggctgaggcgggtggatcacctgagtttgggagtttgagaccagcctgaccaacatggagaaaccttgtctctactaaaaatacaaaattagccagctgtggtggcgcatgcctgtaatcccagctactcgggaggctgaggtgggagaatcacttgaaccccgggaggcggtggttgtggtgagctgagattgtgccattgcgctccagcctgggcaacaagagcaaaactctatctcaaaaaaaaaaaaaaaagatttggcccttcaaaattccccagtgatctcctctgtaccacaaatggtgccaggcacagtgggtgtcaaggtgaggacgaggggcttacagtctggtagaggaggtaaacacatgaacagatgcttgcaacaagatggatgagtgccggacaggggaaactgagagaggccagtggaggagcctaattcagcctgggacaggaagggcatcaaggaaggcttcctggaggaggtgatgccacagctgagtcttatttttttatttttcaagacagggtttcactgtcgctgcccaggctggagtacactggtgcaatctcggctcactacagcctgacctcccaggctcaagtaatcctcctgcctcaccctcctgagtagctgggactacagacgctgaccaccacacctggctaatttttgtactttttgtagagacagggtttcaatcatgttgcccgggctggtcttgaactcctgacctcaagtgatcctcccacctcaggctcctaaaatgctgagattacaggtatgagccactgcacccagccatacagctgagtctagaaggctatcagtttgttgttcaatcagaggagaaagggagtcaggaaagggggcggtgcggtgagcagcaagagcgaaggccagagcggggatgcaatgctgcttccagatgagcaggaagcaggctggtgctgagggcagtgcgaagctgagaaaaggcgtttgccatggacttgaaaggatggcccggcttcagaccctgattctaccatttatcagctgtgttaccttgagcaaaaatgatgtgaccagtgcttaccctgtagggttgtcgtgaggataaaagcaagttaatgcatgtaaggtgcttagaacggtcctctgcagacccaggtgcagagtggccatcaggaagatgctggctaggccaggtgcggtggctcacacctgtaatcctagcactttgggagcccgaggtaggtggttcacctaaggtcaggagttcaagaccagcctggccaacatggtgaaaccccatctctactaaaaatacaaaattagccgggcatggtggcgtgcacctgtagtcccagctacttgggaggctgaggcaggagaatcgcttgaacccaggaggcagaggttacagtgagctgagacccagcctgggtgacaagagtgaaactccgtctcaaaagaaaaaaaaaaaaagaagaagaagatgatgctgactaaatatgtctgagtggatgcacacatgagcaaacaggccaccaagctctcgacagttccacgccctccttgcagacacccagtgttggggaccactgtggcctccccacttcctgctcatggatcagacagatgacctggaggcacagtgatgaccgccacccccacccccacgctggccacaaaatgcccacccacagcccatgctcccactgtctgcagtggcctggacttggcagcccctgggaaccaggcttgaggatgctgagccaggccttgaagggaaaagagacccatatttattgtcacccgctcaagctgtgtctagcacagggatccacctgcaatagctcaggtccgactctccctattttatggatggggctcagggaggcaagagagtggcctggaaaaagccagcggtcctgcccaaggctgtggggctccaaagatgggtgtctccagtacccatcacccacccaggcctagttctttcttgctcacctggcctggttgctggggtctccatttagacacatggaaggcccagttccaggccagacatggtggttcacacctgtaatcccagcactttgggaggctgaggtgggcggattacttgaggtgaggagttcaagaccagcctggccaacatggcgaaagcccctctctactaaaaatacaaaaatcagccaggcatggtagtacacgcctgtaatcccagctacttgggaggctgaggcaggagaatctcttgaacccaggaggcggaggttgtagtgaacaaagattgtgccactgcactccagcctacgcaacaaagcaagacgccatctcaaaaaaaaaaaaaaaaaaaaggagactcagttccaaggcaaaagacttgggaggcggtggggccatgtgaaggaaactcagaagcatgggtatcagtgaggataccttcaagatcattcaatgtgcaaacagcaaacctgaggcccagagaggttccataagccactttaggccatccagcccacccatggcagggctgggatggaactttgtccttcttctcaaggcacaacctgccctgatgtcccaggtgcctggtggttggggactgggggtgtggtggggtggggctgcaggctgtggcctgaggcaacctgtctgcaaaccaggacccagaaaagaacaggccaggagtggtttgcaagcagttttgctggagagagcccagagggagccataaatcaggcactgcggctactggtcaggagcagggactagcatccagcagggatgcctgccccccatctgggcccttcgcccaccacagtgacagggatgctgcagaggctgtggaggcccaggccaggtccccagccctgctgcggctctgcaggtggaggaatgcgggaggagattctgagttgggctcaactggctctcgccgcagagagagtagaacgcccagaaaggctggctgggggtggcctgttgaccttaccctgcagccaggtggaaggagaggacaggacaggagggaggcttcagtctcgggctggccagagggtcatgccttctgcagctgggcctgaagaaatgggggcaggaaaggggctcgaggctcactgaggagcctacagcttctttgggtgcgtgggctgggtctgaaaagggagcatccaggctccaccctggaagttggttgatgctctggggcagggacagagacaggaaagctagccctgacatgattcaccatgcgacaagttagccaaggggagggggggaggggacaaaaggcacctgatggctgatgatattgatagccatagtgacgacaatggttcctgtgtatttactagagatgctatgccagccactgtgagcctcagcacgaccctagcagggaggtaccatttattcccctttttacagatgaggtaactgagggccagagtgatgaaatgatggcctgcacagccagcagtgctcccatcagccctggcaaacccttgcgtgtcccttttctggggctctgagctccaggcaggctggggcacaggctcttgcggtccctcctccatctcctgcatggtgccttgctcacaaaacacactcggtatgcaaccatgagcggatgtgtgaagtcagcccctctgggtgcagacggagagaacatccaatccccccactgcccttctctacaactggccatgtaactatatctagcaaagcccatggtctgatctgagcagcacagtgtccaaagaggtggccaaggcctggaaaaccgcccccacccatttcacagatgagaaaactgaggctcagggaggttatgtagcttgcttggggcccctagccagctagtaggggcccaggccccttccccttctcccggaacctatcagccctctctggaggagggctggaagagctgccaggagtaaataacaccagtgacagccaacatttagggagcgtggaacatctcgtctgaacctcttggttttttaataacagccttattgagagataattcacatcccatacaactcaaccatttaaagcaacaatgccatgtttatggagttgtgcaaccatcacaatcaattttagaacatttttatcaccccaggccaggcacagtggctcacacctgtaatcctggcactttgggaggctgaaacaggccgattacttgaggtcaggagttcgagaccagcctggccaacatggtgaaactcttgtctctactaaaaatacaaaattagacaggcatggtggcatgagcctgtagttccagctacttgggaggctgaggcaggagaattgctgcaacctgggaggcggaggctgcagtgagccaagattgcaacactgcactccagcctgtgtgacagagtgagctctgtctcaaaagaaaaaaaaaaaagaaaaagaaaaagaaaaaaagaatattttcatcatcccaaaaagaaacctcatactctttagctatcactctccaagtcccttatcctctcaggtttaggtagccactaatctattttctgtctctatagatttgcctattctagacatttcatataaataaagtcatataatagccaacaaccttttgaatgtggtatgattatcacccatttcccagatggaagtaatgaagcttagacagatgaaacccttacctaggggtccttaatgaagcaatgtcaaaaaggattcaaaccgaggccttcctggccccaagggcctgctctttgtcaccagttaagagagccttggagcaaaggggcagctctccccgaccctccttctctcctccccgagcccagggccccatccccacattcctccatcacccctagaggttctaccagaaacacttcgggaccagggaacccatccagttatttccccactcttgctctcaatccttcaggctgcagctatgccacctcctttgggaggctctccctggctgctcacctttcttggtacccccgctgctcatatgtatttgtccatagaagatcaggcagcctggcctcctgtgtgtgtgggtgggaacctaaggccctcggtaaggtgtctgaggttggccagtgaggccaggcagagccctggggcccagggccagatctctgacttcctcaccagtgttcttcctctggcctgtttcaaacgggaaatgctccagctccaacaaagtaaagggagcactgtgctgtgagcctgggtgcccgggtggtgtcctggctccatgggagccgaaacacagccacatcccctttgaggaggctccaccaggcccgcatctcctccatcctcaccccattctgtcaagtggtcccatcaaggagaggggggtaaactgaggctcagcaaggctagtggcctacccaaggccacaggcactgagccaggactcccctgctgactcccagcttgccccccaccacatgctgggtcaggagccccagtttgaagctctaacaacccctggacttgccccctctatcagttcttacaaaattggccccaaacttgctggggagctgggagcctgtcttcttcatggctgtattcccagtgcagggtggggcctgaaacacatcttaggaaatgtctgttgaatggatgagacagaaggagggaaggcccaggtgcagtggctcacacctgtaatctcagcactttgagaggccaaggtgggagaactgttcgagcccaggagttcgagaccagccaggcaacatggtgagatggggtgtctctaccaaaaaataataataaaaaaataacaaaattagccaggcatagtggtgtgcacctgttgtcccagctactcgggaagctgaggatgaagtgggtggatcgcttgagcccaggaggtcaaggctgcagtgagttgagattgcaccactgcactccagcctgggcgacacagcaagtctctgtctctaaaatgaacgaacaaatgaacaaatgaaagaaagaaaggaaggaaggaaggaaggaagaagaagggtggaagaaagggagaaatggggatgggatctagtgagcaggtcttctgactcctaaatcaagaactcttttgacatttttgggtcttatgcctctggagaatcacccacacaatcctgcacagttttgggggttcctgatcccttgtacaggtctgcagtagtcgaatccctatactgctcgttgagaaccctgtatcctatgccactcaaccctgtcctgaggacacaactgatgcaaatgcacttcataaaagcccaaagcacggcacacacttcagttaactcacctggaaccacaaggatgcgctgagccatagtccccggcacacactgcaggactcctaacaccattcctctgcctccctattctcagcggccgctgcccctccccaggagctgctgccagctagggacatgctagaatgcccattaatgccactttaggccagaagctggtgttggcaacctcagaggtgggggctgcctgagtcctaactctggatcctccactgactcagcaggatcctgcctctcctcccctaaaatcatcttagggcatagaggatgggtggggtccaaggcttaggaactcccccagtgcccagactggtgctgcccagactggtgctgcagacacaactagtaacagttgtgtttactgagaattttctaggccaaaaaaatggtgttagatttttccccccatgtttactcaccaattcccagatgaagctggtaccattagcatccttttgttttgtttgtttttgttttgagagggagtcttgctctgttgcccaggctggagtgcagtggagcaatctcggctcactgcaacctctgcctcccgggttcaagcgattctcctgcctcagcctccctagtagttgggactacaggtgcctgccaacacacctggctaatttttgtatttttagtagacatggggttttaccatgttggccaggctggtctttaactcctgacctcaggtgatctgcctgcctcggcctcccaaagtgctgggattagccaccgtgcccagccagcattccatcttatacgggggaaactgagatacagaaaggaaaggtcacttgcctgagatgccttaccgagaagtggaagtgttggcgttcagctgtgggtccgtctgaccttggaggtgacttctgaactattaggggactaagcctccccaagcagttactgctgattgctcaaaggcagctgctccccttcacacagagggtctatccttggaaacttgtgccagggacattctgagtaaggtagcagatttacgttcattagactttctcagaggatgcagtttgctgaacctcaggttgtctcttcatctgcagtcataaaatattcaagccagaaggcactctggtgattggaaatgctaatctctgtaatttttttttctttttttttgagacagggtctcactctgttgccaaggctgtggcgtgatcatggatcactgcagtctcaacctcctgggctcaggtgatccttctgcctccacctcccggatagctagatagctggaaccacaggtacatgtcaccatgcctagccagttttttgtatttttcgtagagacagggttttgccatgttgcccaggctggtctcaaactcctgggatcaagtgatcctcccacctcagccacccaaagtgttaggattacaggtgtgagtcaccgtgcccagcccattttctttttagagacggggcctcgctctgttgcccaggatagagcgcagtggcatgattatagctcactgcagcctcaaactcctgggctcaagtgagtatcccacctcagctctccaagtagctgggacttcaagcatgagccactgcacctggctaatttgaactttttaatttttttttattgtagagacagggtcttgttttgttgcccaggctggactcaaactcctggcttcaagcaatcctccttcctcctcagcctcccaaagttctgggattacagacatgagccaacatgcctggtctagtcttaccttttactaatgcggaaactgaagcccagagatgcagagatgtgcctaaattacagttaattaggaacaaatgtaatcctcaaatccagatctccaacattcatgtcaaaactccctaaaatcaaacaacatcggctggggaaagaacattcaaagtctcccagtccaagcctctcatttcacagtaggagaaagcttgactcagagaagagtggaatatgcctaagagtgacatgcaggcaggcagaatgcaccatcaatgaatcgaaaagttagttttttactatatgtgccctaaggcatataaagtgacttctccgagcttcacctttgaaatggaaataaaatttacagtatagggttcactgtcaggaggataaatgattcatgaaatgcccttgggccagcacccagcacttagtgggtgctcaatgcatggtatctattattaatactgctagaaccttgtcatttccccctctgccattctgccttccaggtcaaacctttctcagtacagtatagtaggtaagactggggactactgcttcagctacttgtcagcagggtgactttggactggttactacccagcaactctgggcctcaaatgtctcatcagtaaactggggacagaatagcagtacccaccagacaaggctgtgggagggggaaataatgcatgtgactggccttcacacaaagccaagcacatagtcagtgctcaataaatgcgggctactactgttaccaattacttccacagccatgtctcatgtctgtcaccatcccagactgcagggagtctggtccaccagcaagtggccggtccccaacctccagggctctccagtctcaagagtgctgacgcagcaagggaaggagctcccagtacatccacaccggctctcctgactcagctctgatttctcaggtgcctgtgtagggtcgacaattctgagcatgctggacgaaatcccgatttttgcattcatgtaagagtcttggaagagcccccttttcacacgtgcagaaactgaggtctggggaggaggaagaggctgctgcccacggacacacaggtgccaggaccaatgtctggggaggaggagaagggcgctgttcacggaaacacaggcgccagggcttgatgcaccggtgtcctcgcttgtggctgggtccttctgggacgatcccctttcccaggatcccgcccctaggaagagcaccggccatgcccctacctgagccccaccccctgagttctttgagcaccgctgcccccaggccgttacgatgagggaagccacgacagccaaggctacggctaccttcctgcagcccctggggatgccactgatgcgacgccgcggcggccaaggcggggctgaaggcggcgcgcccggcttccctgagccagtttggaggagcgctcttcaatcttccgaggccggatgaagcattcgggcgttcccactgcggaagggcggggatggctgtgacgcaggcgtgcccgccgtcgcctgcagggggcgctgttgctggcgcgattctatcaagcgcagagccagccgaggcagtatgccgaggcagagaaaccggttctgcagtcccagggcctcggtttccccctctggagagtgttcgtttgtgacagggtctcgctctgttgccgaggctggagtgccgtggcgtgatctcggctcactgcaacctccgcctctccaggtttaagcgatcctcccacctcagcctcccgaggagctgggaccacaggcgcgccaccacacccagctatttttattttattttattttttgtagaaatgaggtttttctgtgttgcctgggctggtctcgagctcttgggctcaagcgatcctctcgcttggccgcccaaagtgctgggattagaggtgtgagccactgcaccgccgaaagtgggtttgatgacaatgttgtgaggctacagtggaacccagataaatttatgaaaggaaccagaagacactgataaataaccaaattacttaacctccctacacctgtttgttgatctgtaaatggggataattgcacctcccttccctgtggatatgcaaacgtggaaaaacacataaaggggctggcaccttataagcacctagtaaaaggcaatgactgtgatcacaggcaaagcaccctgccaagccagaaaacaacatccaagtcctggttcctgtcctcacggagctccagtcgcagaaccagaggcgaggcagtgagaaccaggcctgccctcggtttcctcatctgtaccactgatggtctctaaggctctctgagcccagctttcttcaatgctggcttgtgaaatgcagcccaagatggattacagtgacatgaataacatggagtagcatctatgggaagtcaccgctgaatcgcatttattcattcaacaagctttactaatactctggtaccaggccctaggaatacaacattaaataagagatggctcttgcccttacaaagctcccaacagtccagtcaggagagaaataaatagcccttcaaataccgtgttgggattagaacgagcaactgtgggagcctaaagaaagcagttatcacaaccttggggttagcaaagctcctgagggagcaggtaacctggaacgtctcaaggattaagaggagtgagctgaagagtcggagagtgaatactggggcagagaaaggatttcagacagaaagccagggtgcaagagaatgtggcagaatgaataatttcatggcggtggacccagagagtagaagaggttcaggtagggaaggacacaactgccccctctgcccagcccctgccccctcctaagctgccaccagggaacattctgtgtccttctgcctgggcctcaaatgtccccccatttgttcacccactgtacacaccctgagccccccaggtgcaagagccactctctgtcccctcagctcatggtctaggaggagtcagaaggcatgggcaccagggactccagtatatgtcatcccctggatcccaggacatgtacttagatatgggcagggcacacggctccacagagaaaggacatggaggatgagggagaaaggaattcccaggagagggccagtcctgaggtgggacggggtggcattctagagccagactgcaaagttttgaatcctggttctgtgcttggcaaatgatttcacctcttcaggcctgtttactcaccaaagcttcttagagttgtggagcctagggccgggcgtggtagctcacgcctgtaatcccaacactttgggaggctgaggcgggtggatcacgaggtcaggagatcgagacattcctggttaacacggtgaaaccccatctctactaaaaatacaaaaaaaaaaaaaattagctgggcatggtggcacgtgcctgtagttctagctactcggaaggctgaggcaggagaatctcttgaacccgggaggcagaggttgcagtgagccgagatcgcgccactgcactccagcaagactccatctcaaaatactagatagatagatagatacacagatagatagatagatagatagatagatagatagatagatagatagatagataaagagttgtggagcttaaatgagatcatgtttgtaaaagtctatgtgaaagactctgtgggagctcgaacgatgagcctggaaggttggctgaggccagatccagagtcagttctcctgctctagggacactggctcagaatgcacatccccaggctccatcagagattctgacttggatgatctggacgagcccaggaatttgcaatgaaattctgtggtgaccaccacacaagcaaaacgtttaataaaaagtatattttctccactaactccccctaacagacagcaaagacctcaagccctgcttcctctttcctctgccacttaacctccccaaatgccagaaggtagttcaggcgcccagcagagctgtccctgctgtgtgtggccaggtccctggttcaggttcactctgggctcctgcagttttccatgcacacggagtgcctcgctcggggctgaggcagaggtttcagaaactttcttggcatgtctctctcatgctggcatctgctgtctttggcagtgccaggctgcacccgagtcctccatgtccccacacagctgcagagagacaagccagggtgcagctgcccctgggcaggggaagcttcatgtccaccaagcctggggccatgcccacttgcaggggcttttcttcttttctttttttttttttttaagagacagggtctcactctgtcacctagactggagtgcagtggcacaattatagctcacagaagccttgaactcctgggctcaatgatcctcccagctcagcctcccaggtagctggatctacagatgcacacaaccacacccagctaatttttaaattgttttgtagaaacagggtctcactttgttgcccacactggtctcaaactcctaggctcaagcgatcctcccaccctggcctcccaatgtgctgggattataggcgtgagccaccgtgcccagcctggggggcctcttttagggctcagtaatgccaacattggccatcaggaatgaacttttatccaactgttaattctccctcaagtcccaacatcccgtttttttttgttttgtttttcaagacagagtcttgctctgtcacccaggctggagtgcaatggcgtgatctcggctcactgcaacctccgcctcctgggttcaagtgattctcctgcctcagcctcctgagtagctgggattacaggcacgcaccaccacacccggctaatttttgtatttttagtagagacagggtttcactatgttggccaggcatcttgaactcctgacctcaggtgatccgcatgccttggcctcccaaagtgctggaattacaggtgtgagccactgcactcggcccccaacattccaatttaaactctggcatgaatctttctctcaaatgtactatgggctccctccttctcccccagaataaagagatgaaacagcactgaaaccttttcttatttttttcctgagagtcagtatggatagtgggaggtgcaagggtcctggacaaagcctagatgtgagccacagcccctccaccacctcactctgtggccttggcaggtcactttctcagtgtcgatgttctactctgtagaggacagtgaccttgcacagctgacagagttgttgcagacaccacgtatgtacgtggagcacagcaggcaggtgcccaccacgtaaaggatgacaaagctgttttctccattactcaagatttaaactgtgagcccaggtgcagtggctcacgttagtaatcccagcactttgggaggtcgaggcgagtggatcacttgaggccaggagttcaagaccagaccaggctggccaacatggcgaaaccccacctctactaaaagtgcaaaaattagccaggcatgtggtacatacctgtaattccagctactcgggaggctgaggcacaagaatcacttgaacctgggaggcagaggttgcagtgagctgagattgtgccactgcactccagcctgggcgacagagcaagactttgaaaaaaaaaaaaaagatgtacactgtgaacatcaatcactgtccaatgacttctttctacttatctatctcttcagtcaggatcatccagaaagctgagctagtcatcattttaacttcctgactatactgcttgggaagcctccttccctcaagacaaccagagagagtataaaaacctgggggaaaagaaacaaattttgattgagccaattttcaatcccccttgcttccaccaaggcaccagaaggaagccctagagcaaagaccctggccagctgtgatggaatcaggaaagtgctgggtccagttgggcctgccttgaatgcgagatgtacagtcttgtagttcagtattcctcctgcagagcccatcagacctgagttcaaatcccagctccaccacttatcagatgtataacctggggcacgttattcaacctgagccatcattttttaaaaaacttatttattattattattgagatggagtcttgctatgttgcccagcctggtctcaagctcctgggctcaagtgatcctcccaccttggccttccaaagtgctgggattacaggcataagctaccatgaccagcctctcttcatttctcaaaccatgacatggggatagtaatggtatctatttcataggattgcaagaataagagaggccaggcatctcctcctttccttagatgacagccttcattcccattgctacttagcctcttgctctaggtaagaagagtaatgacagccctggggcacttgtaacttggcaagccccagttactagatgaaagtccaataaaccatctcactctccatcttgggaaccacagcccaagaatcattcatccataatctcccacagcaggaactagagcaggggagatagggtggacctgtgaccccatccaccagttcctggcctttggggtagaatccagcttcccacctggtgcagtcccagggcggcagatgggcgggcaggcaggcaggcagacctgctgcaggcctgagtctgcggtggctggtccctgggggttaaggctgtgggtggaagctaggagggggaggcttatgcaaaactgcacacagtttagttttttgctgtctgtgtcctaaacggagtagacatggggagactgccgcccttttattataaatcagattcaaacgcggcaaaaagacggcatctctaaggagggagaggagaaaaaaggagggagaggaaggaaaaggggaggaataaagaggacagagaaattggggggaaagagggagggatataatagagggagaaggaagggaatgcagtggagagaggggcaagaggagagacggagaatgtgggacatgacggacattcacggggaaaggaagcaagaagaaaggctcagcacttcctaaaaggaattgctgaacataaaaaggaacaggctgtgcaggagcagggtgagtctgcagacaacaaagccagcaaggttgagcctcagcaaaggggactacacagctcgggctgggaggcttcaggccccaggatgggggccacactttcaagacctccttctccagtcaacctgcgggcagcctccctagggcctggaactgtccagatgcccagtgctaaaatgtctgggtgatcacgggcctctcaggcagagcctcgcagtcatcctgaaactatttgctacgcacccactatatgccagacaatattccgagcactggagatgtcagcagtgaataaaacaaacaaaaatccctgtcctgatgaagttctatttagtggagaagatgcatagtagcatgtcagaaaacgtcaagtcctatggagaaaaaacaagcaggaaaagagaacgaggaatttagcatctgcacctcaaacagtggtcacatgtagctcccacagaggtgacacagtgtcagagggtacccaggccgggaagtaggttctcacatacaggctatgctgatgttgggtcatgggccacagagactcacagatgggtgatctgtcagaggccagaccccaaccccagccccagaaagctgcccatcccctctctgaaggcctctcaatcctctaccctcagaccatctaggcctctactatgcaagagaaacaagtttccaccctgtgtcctgtgccagctcaggtctggatgagttgagacactgggctctgctgtgtcactgagtcaactcaggcaacccacttcctcactcgggtctcagtctacttgcctataaaatagggacaatgatccctgccgagtgaacagtgagtagcagcgaggctggtggctgtttaagcgcctactgctttatccttcaccctgcaagtatgttcctgaagagcaccagccttggggtccacaaaagcccagggacagcaggggctgagacccaaatctcagtgtgcctttcagtgtgagccactggacccttgtcctggagacacttggggacaagaagggcccaagagcagttaagtttgggaaactcagcacactctacttgcctctgggagattcacaatgctcactgccaagtccaggctttgggaagataactccaagaactgcgggtggatggatggatggatggatagatagatgaatatatcgttctactcacttccaaatggtaagaatcacagggaggaaagtgaaagcgattcgagccccaaggactcagggcagaaccattcacagcccctccagaccacaagtttggctggaaaacagacggaacttattcattcattgattcatttacacaccacagagtggtaagagcagcattagagattagcactgggaaccatgggaaccaccaggaggggacaattaactaaatgtgggggtgaaggcggccagggatggctttctggaggtgagcctgaagggtcctttgggggaactgacctcagggctccagccctcatgccattttctccagccacaagagtcatgcttggggcttcttggactacataggcagcttcaatctgatggctgtggccccttggcctcaacagaatacatcttggagccccctttttaccccaaacccccattcctccttgctgtcagctgcttgtgagccttctcacatccagagaatgtatcagcattgtgcagactgaaaagacccagaggaacaaggctccaatggcaaaattccaagtagaatgacaaataaatggggagccatctgagagcaagggagtcctgcccaacacccgccccatgcctttctcagggacctcagaccagccactcacctccatcctcccagcaccacctgcaaccagccccttgccctctgcaaactggagcacgactggatctttagatgggggaaaaatgcttcatcatgttctgctgcttcatgcaaaaccagaaactccctccccctcttccctcctcccagcgcactctccttccagtaaaaagtggttaaagggacagcgccatcaatttcccagctctgagggtctgcttagaactagggggctggaaggagacagagggcaaagagaaaggaactggcagaggtctttcctgggggatatgtctgttctgtcctggggatcctggagcaggaaaacccgcgtaaagtaggggtgtagtgggtgttgagataactgcctgggggaggttcagagtggaagtacgagtctacaaactctcaagggcgtctcagggctcccagcatccccaggggtcctttcgcaggggtccctaagcaggaggggaacagcccagaaaacacggaactggacccccgacaggaagtccagggaggggtccctggctcactatgtgaccctgctggatcacttgcctcccctctcgggtcccctcagcacagtgtccctcccttccttcccctaaagtaaaagcagagggttaatctctttccccgccccacgcccaacaaagagcaggccctgtccccggtgctgaagcgccagccgcagcaccacccccactcccacagcataaaacatgagccaaaaccaataaagagccaaatgtcacagccgttgcagggccccctaaatcctggggaccccttcttctacctgacatcctattggggtgagggactttggtactcagaaagcatctcatcacttccctgtaagagagaagggatgccgactcaggcgcctgcttgtctgttacaggagtgggggaagagaggacaagttgaggctgagaagatggggagggggagggagaaaagaggacttcctagtgttgacagaacggcaagatgtgggttccccatccccagttcagccagagacccctcaaagtggaacttcctggggcagtcgggggtcaggagttggagcttgtctctggggcaagaccccttcgttgtacagatggaaaaacaagggtgggaggacacagcttgtccaaggtcattcgaccagcaaactgcctagctgaccccagtgtgcagaagctggctcgggtgacacccatcatttccccccaccccacacaggggccagctctctcaacttcatgcccaagccctcctacggtacccccactgtaggttctctgcccctcaaactcagcccagctttctcctgcctgttcaggggaccttctgcccgcttcgctgagggtccgtcccctttactggggctggcagcagggtctcccatctcctctctcgggggccactgcagactttttagagaacgccttgcctccccccaaccccacccatccggggttccctctctccatcctctgcagtgtctcccatacccccattcagggtagccttgctattctccccaactccaggtcccccttcatctattccggggctggccgcggagtttcctgagcgctctccaagtgggtcctctagatgttaggagaacactgtacctcccccggtcaggggtctcctgtctccgttctatggagcgtccatgctcccattcaggactgccttgctccctcctctgttccggggctggctgcacagtctctgcaccccctatcctgaaagcctctcttaactatttggaaagcctcgtgtcctgtctcatacagggatcccctcatcctaatgactgcaatcttccattgctccatcccgagggcatcctgcccctattcccatcaggtttctccttgtcctctccctgtttcaagtcccctttcttattccgaacacactcgcaggctcttccgacgcgcacccgggggtcctcactggcccactccgggagtcctctgcccgcttccccgacctcgagggtctcctctgacgcagcgtcgattccccttccctcctcggtcccctgccccgcccctctcactgcggcggagccggtcggccggggggccgcaggggaggaggcggagagggcggggccctcctccccaccctctcactgccaaggggttggacccggccgcggcggctataaaagggccggcgccctggtgctgccgcagtgcctcccgccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccggactgcgcgtggagtggcgcgctgctcaccttccctctgcaaagtgcatgcccctagttaaatcgcagttttactctgggtctcttgtgggacgccccaactctgggttgtccttcggttccccctttccaggttctttacggctgtacttcaactctgggccccctgctgctctctaccccaagcttaggcgaccccactctgagatccctcccccgtcaagaaaaaaacaagtttcctctacaggaaaaaagtggtgcaggattctggtctgcaagcgctggagactcttagcccttctaagtagcaaggcttccccgccaatgctgccatgccctctcctacaccccgcaagaaactctattcctctcacccctaccaggctccttcccactacctgctcagtgcttaacgttcctaccttaaatcttccacgtgggggtgggtcaggaccttttcgcatcctttcttcctagagggaaccattactacagtcagttgttgcctgtggcggaggtggctggtgggccctttcatgttttaatgtcccctttctcctttagggaagctgggagcctcccaagtctgcccctcccccaactccttgcagccctgagtcagctagattgcgctgccctgaggctgtgcccagcagctgcagggtgaccttgaccaacacttgccctctctggttttcatttctttttgagttgaaagaggagggtagatcaactgggctgcttaatccggggagttccatgatgtctcacgaaactgtctgtaaaactttgcgttgtttttgagagagagggcagaggcttcagtgattttccaaaagcatctgtgatcgacaatagttgagaatctccaaccacctggatggtttctaagtctttgccagcactagcagggaaagctgggattttgatgcatagctttttctgttccttttccactcctctgcagagcagaaccatcccctcctccatctccgcagcaaggcccctccctgcgcaaacctcttttgggtttgccagtcgtaggggcagacgtcccaggattgtactggcccactcagctggcttccttcctccccgccaagacttgtgccctgagtgccactatctggggattcaggatgttcacttttacgagctaaagaccagtctccagacctccactgcctctggaaggtttcctgggaaccacgagcgggttgctggcgggggccggggtgtggctaccaatgctcaggggcaatgctcagctaggtggagaaagggacaggggttggcacccaggccacgggctctgcactgaccttggactgtgcgcagaaacctgtaaggaagggaccatggctacaaggtgacctgattgctcacggtaccctcatgcctcctaaaggtcacaagctcattaacttgttcagccacaaacctgcagcctccagctcagtgttaagccccatgggccaggtatcacatctgaaccaccagcactgccaggcccttgctagggagctggaccaggcattaggaccagggtttcctctgccctgcagggtttttggatcccacactgggggagacagagcatgatctttggggatttgagtcccagctctgccactcactagctgggtggccttggggagtagtcacttgcctttatctcacaggacagagtgagtcaagcatacaggatggtgtctggcacacgcagtaggtcaatccacatgtgtcaccttcaaaatctgggcattaggccgggcgtggtggctcacacctgtaattccagctctttgggaggccgaggtgggcgaatcatgaggtcaggagttcaagaccgcctggcgaatgtggcaaaaccccatctctactaaaaatacaaaaaattagctgggcgtagtggcaggtgcctgtaatcccagctactcgggaggctgaggcaggagaatcgcttgaacccaggaggcggagcttgcagcgagctgagagtgcaccactgccctccagcctgggcgagagcgagaatccgtctcaaaaaaaaaaaaaaagaaaaagaacaaagaaaaaaatctgggcattagaacccagtccaggtgtgtctaaccctgtgccctgctaccttctcccccagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggtgggcaggggcaaggcagacagccagactgccttacctgattgggtagccctggacaagttactgtccctcactgagtggggttgtagtggttaagattgtggcccttggagtcagacataccagcactttccagctgtgtgaccctaggaaagttatctaattctctgaatctgagttcctttccagccatgaaaaaaaaaaaaaaaaaaaagcctgctttgcagagctggaaagattaaagagatagacttttatttatttatttatttatttatttatttatttattttgagatggagtctcactctgttgcccaggctggagtgcagtggcatgatctcagctcactgcaacctctgcctcctgggctcaagagattctcgtgcctcagcctcccgagtagcggggactacaggtgcatgccaccacacctggctaacttttgtatttttagtattgacagggtttcaccatgttggccaggctggtctcaaactcctgggctcaggcaatcctcccacttcagcctcccaaagtgctgggattacaggtgtgaggcaccgtgcctggcctaaagagatatactttaaatgagattagtgtgaacttgtgaatgagctcggcaaggtcttcaacattcgaatctttctagatttgaatcccagctctgccactcactaggttggtcttggtcgcagtggacattctgtaaacagcaaccagtgtcttgggtggccaggggaagaccttagcagattccttcttttaaagataactggcggctgggcctagtggctcatgcctgtaatcccagcactttaggaggccaaggcgggtggatcacttgaggtcaggagtttgagaccagcctggccaacatggtgaaaccctgtctctactaaaaagatacaaaaattaactgggcatggtggtgcgtgcctgtaatcccagctacttgggaggctgagacaggagaatcgcttcaactgaacctgggagatgggggttacagtgagccgagatcgtgccactgcacccagcctgggcgacagagcgacagagcgagactctgtctcaagaaaatttaaaaaaattaaaaaaattagctgggtatggttgtgtgtgcctacagtcctagctactcagaaggctgaggcagtcatcaatgcctaccaaaccctgactgtgtggtggacactgtggcacactggagaaagacaggagcaaaagcaggcaaggccctgctcccactgggtttttttttttttcttttttgagacacagtctcacgctgttgcccaagccagaatgtgacagcgagatcatagctcactaaagtcttgtacttccgggctcaagtaatcctcctccctcagcttcctgagtagctgggactataggtgcacatcaccatgcccagctaattatttaattgttttgtagaaatgaggtctcactgtgttgcccaggctggtctcaaactcctgggctgaagtgatcctccttcctcagccttccaaaatgctgggattacaggcatgaaccaccagagtctcgctatgtctcccaggctggagtacagtggtatgatcttggctcactgtaacctccgactcctgggttcaagcaattctcctgtctcagcctcccaagtagctgggattacaggtatgtgccaccacatcccgctaatttttgtatttttagtagagacagggttttaccatgttggccaggctagtctcaaactcctgacctcaagtgatccaccctcctcagcttcccaaagtgttgggaatacaggcttgagccaccactcccggcctcactgagcactttctaagctcaagatctctaaatgttatcccattatcctgccagccaaaccagcaggaacaactgttgacatctgatgaatttcatttcagaccttctccagtctgaggtcactatacagcaggatttttgctccagattgttccacgtccactaatgaggaccctacagctctggcagggttggggttggccccagtgagcctggctggatgggcctgctctggggtcgcacagcccgccgcagcttctctggtactgagggccagacactggctggcatgtgatgtgtgtcacctctccttcccaggaagccattcagcagctggacgctgagctgaggaacaccaagtgggagatggccgcccagctgcgagaataccaggacctgctcaatgtcaagatggctctggatatagagatagccgcttacaggtgagacgcacaggggctgtcacatggtgaagaaagcttgtgttcctgcgagacgctaagccttgggtttcaagaccccgtttaggcagcctacctgtcttagggacaaaattctttttaaattgcggcaaaatagacaaaacatacaatttaccattgaaccaatttcttttattttttatttattttttgagacagacttactgtgttgcccaggttgaagtatggtggtgcgatctctgcccactgcagcctctccctcctgggttcaagcgattcccatgcctcagcctcctgagtaactgggattacacgtgcccgccaccacgcctggctaatttttatttttttttttttagtagaaacagggtttcaccatgttggccaggctggtctcaaactcctgaactcaagccctctgcccacctcagcctcccaaagtcctgggattacaggcgagagccaccatgaccagccccattcaacaatgttaagtaggcagttcagtgatattaagtactttcacattactgtgcagccataaccactgtctgtctccagaactgttttcatcatcgcaaactgaaactccatacccaagaaaccgtcattatcattctctccttccttcagcccctggcagccactcttttactctgagagacatgagtctttttttttttttttttttttgagatggaatctcactctgttgcccaggctggagtgcagcagcattatctcggctcactgcaacctctgtgtcctgagttcaagtgattctcctgcctcagcctcccgagtagctgggattacaggcacatgccaccacacccagctattttttgtatttttagtagagactgggtctcgctatgttggccaggctggtctcgaactcctgacctcaggtgatccgcctacctcggcctcccaaagtgctgggattacaggcgtgagccactgtgcccagccaatgagtcttgagagtgacttactttcattctgaaatgatttagacggtggaagttccttatcccctccccagatccagccagccagaggcctgctttgaagggaaaagaggtgcttgagtcagggacctttcaaactctgtcctttagagtttcttagctctgcaagcattcatttcttggggatataaagtggagatgataataagggcaaccatgtcatagggttgtcaggaagatgagctaatcccattcccaagctaatccaggaagcacaggtaccactgggctgctacagagggaacccttagtcagtggcagccttgagaaatccagtctgaggaataagaccggggggagcagggctagggagcaggactgattccctgaggacttgtcccagttctgactggtgacctgtggcttcctacctcttggctctcgtctgtaatcttgctactcaaagcatggcacatgaaccagcagaattggcatcattcaagagcttatcagaaagatagtctcttggttgggtgtagtgactcatgcctgtaatcccagcactttgggagaccaaggcagacagattgtttcagttcagagaccaagctgggcagcatggcaaaaccccatctctacaaaaaatacaaaaaaaaaaaaaatagctgggcatggtggcacatgcctttagtctcagctactcaggaggctgacgtgggaggatcacctgagcctgggagttggaggcttcagtgagctatgatcgtgccactgcactccagcctgtcatcacagagtgagacactgtctcaaaaataacaacaacacaacaacaacaaaagacagacgctcagcccctccccagacctgctgaatcagaatctgcattttgataagatccccggtcatctgtgtgctgctaaatttgggaagtactagtctgaggggtaacccccacacttactctgagacaagcattctgccaagtcttttccattcattgtctcactgaaacaaccctctgacgtagggactctaatgaccctctttttccagtgaggaaattgaggctcaaagagttggtgtgtcttggccaaggtcacccatctagtgaggagcaaagccaagaggagaaactgcggcctctaccctattcctgaaactcaaaagatggtaatacagggtgatgagagacactcgcgattcaaatgggagcgttctaagacctcttaaacccaaatttataaaagtagaattgtggtcgggtgcggtggctcacacctgtaatcccagcactttgggaggcctaggcgggtggatcggctgaggtcaggagttcgagaccagcctgaccaatatggtgaaacccccgtctctactaaaaatacaaaaattaactggacgtggtggcgtgcgcctgtactcccagctactcagtaggctgagacaggagaattgcttgaagctgggggaattgcttgaatctgggaggcagaggttgcagtgaactgagattgtaccactggactccagcctaggtgacagagcaagactccgtctcaaaaaaaggaaaaaaaaaagtggaattgtttgctcaggctcccagggttctcttgaataatattttagtttgagggacaataaatttaacttttgttaaatttatttaggagctttctcttgagggccattttttatggggcaaaagttgttttatttcaaaagtttcaggcttagctgtgttgaagaagaccagctgttccagcctgggcaacacagtgagaccctctcaaaaacaacaacatcaacaaaaaaagaccagtcccaccggggtacacattctgggtggtcactggaatgatttgccaagtgactttctctagtctcataatgcccaccattcacattcctgttccaccaaaacccatatcattcgatgtcagtgaccttcaggatagtctaggaagaacccaaatagtgaatttgccctgagtttatactaatgtgttccgtgatccatcctgcagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaatgttgctgctgttattctctttccctgggaaggctgggggcagggcaggggaggtctggatgtgacaccccagactgcatgggactgagcaagcatcagttccctcgtgggtctagagcgacttgcatggtctctctagtgctgtttcctgggcacaaaccatgtgccaggcagtgtgctaggggctttatttttatgatctgtacaggtggcctggtatgtggtttctcagtgtggactgtggactgtcttcagcagcatcacctgggagtattataaaaatgcacgcttggccgggcgcggtggctcacgcctgtaatcccagcactttgggaggcccaggtaggtggatcacgaggtcaggagatcgagaccatcctggctaacatggtaaaaccctgtctctactaaaaatacaaaaaattagccgggcgtggtggtgggcacctgtagtcccagctactcgggaggctgaggcaggagaatggcgtgaacctgggaggcggagcttgcagtgagcggagatggcgccactacactccagcctgggcgacagagcaagactccgtctcaaaaaaataaataaataaataaaaatgcacgcttgcccaggtgtggtggctcacacctgtaatcccagctttgggaggccagggtgggcatatcacaaggtcaggagttcaagaccagcctggccaacatgatgaaaccccatctctactaaaaatacaaaaattagccagacatggtggcgtgcgcctgtagttccagctattcaggaggctgaggcaggggaatcgcttaaactcgggaggtggagcttgcagtgagctgagatccagcctggcgacagagtgagactgcgtctcaaaaaaaaaaacaaaaaacaaacactccagcaggacatgatggctcatgccaatgagcccaacactttgggaggccaaagtgggaggatcacttgagcccaggattttgagatcagcctgggcaacatagaccccatctcttaaaaaaaagttttttgttttttgttttttttttttaattagctggagctgggcatggtggcttatgtctgtaatcctagcactttgggaggccaaggcgggtggatcacttgaggtcaggagttcgagaccagcttggccaacatggtgaaagcccatctttactgaaaatacaaaaattggctgggcgtggtggctcacgcctgtaatcccagcactttgggaggctgaggcaggcagatcacttgaggtcaggagttcgagaccagcctgcccaacatggtgaaaccccatctctactaaaaaaacaaaaattagctgggtgtggtggtgcacgtctgtaatcccagctacttgggaggctgaggcaggagaatcgcttgaacccagaagggcagagattgtagtgagccaagattgtgtcactgcactccagcctcggtggtagagaaagactccatctcaaaaaacaaaacaaaaaagctaactgggcatggtggcaggtgcctgtaatcccagccactcaggaggctgaggcatgagaattgcttgaacctgggaggcagaggttgcggtgagccgagattgtgccgctgcactccagcctgggtgattgatagagaaaaaaaagaaaaagaaaataaaattagctgggtatggggcacacatctgtggtcccagctactggggggctgaggtgggaggattgttttaacccaggagttcaaggctgtagtgagctatgatcacacactgcactccagtctgggtgaaagggtaagaccttttctccaaaaaacagagagagaagggctttgattgattggctcttgattatcaaacatgcccaaggactctatgaaaacctaagcattaattttctgagcagttctgccctagggaaatcagacggacctccacaggcccaggcacacagtatagcatctgaatatcaaactgggatctaagacccaggaaattcccatgtgtcttgtctgaaaaaagttacagttggttgagaacctcaaaatacttataatgatgacagtaccatttgttgagataaccatgttatgtttttgtttttgtttttgagacagagtcttgctctgtcacccaggctggagtgcagtggcgccatctcggctcactacaacctccgcctcctgggttcaagcaattctcctgcctcagcctcccaagtagctgggactacaggcgcatgccaccacgcctggctaatttttgtattctttagcagagacagggttttgccatgttggccaggctggtctcaaactcctgacctcaggtgatccacctgcctcagcctcccaaagtgctgggattacaggtgtgagccaccatgtctggcagagataatcatgtttttacataaattctctccaatccacatgggcatttttcaatgtagagattctgatgcctattttagtggtgagaaaacaggcgaggtgagttgcccagagccacaaagctagtaaatgatagtgccagaatctgaatccaaaacttaactccagagtccatgttttctgtactaccatgccatagaatcctgagcaagctgcattggtttaattttggtcatcaaataactgctatgtcaggtgtcaactgtcctaattcacctgggatataggagtttcccaagatataggacttttagtgttaaaaccaggaaagtcctgggcaaatggggatgaattgttccccctaatgtttgggcagccattctagcacatttcagaatattgcatatgacaaaacctaatggcaacattcaagggctgaagtgaagtcactggactcagtcacttcttggctctcaggtctgtttctctcagtattggcttttgtgataggcttcctctaaaatggctccaatggccaagtgcctattatcccagcactttgggaagctgaggcaggaggattgtgtgaggccaggagtttgaatccagcctgggcaacaaagcccctgtctaccaaaaattaaacaaactactgggcatggtggtgcatgcctgtagttttagctacttgggaggctgaggcaggaggattgcttgagcccaggagttcaaggttatagtgagctatgattgctaccactgtactccagcctgggtgacagagtaaaaccctgtctctaagagataaattaaaaattaataaaattgttcccaacaattcccacctcctgttattcatgctgttttgtaatcccctccccttcaatgtaggcctgacctagtaattcgttctaatgactagcatatggcaaagtggtggaatgtcatttccgtgagtagtttacaagaagattctggcttctgttttgcttgctctcactctgatggaagccagctacgatgttgagagttgccctaaggagaggcctacatggtaaggaactgaaggaagcctttggccaatagccagtaaggaactgaggtcctaaattcagtgagaaactgaattctactaataaccacatgagtgagaatggaagcagatcctccccagttgagccatcaaatgagactgcagccccatccaacaccctgattgcagccttatgagaggctttaaggaagagccacccagctaagctgtgcctggatataaatgtttgttgtttgaagtcaccaagttttcgggtaatttgttacacagaaatagatgtaatgaagcttctctttcagaaaggccttctcttcatggagatcctcagctatgataggcttatattattccaggtacaaatcacaggaaagagattctgttcctaccagttcaaatcaaagtgtgagaagtgagtctcagtggaagactgggtcatgcacccatcctgaaattaattactgtggccagggaggatggaacacactgactggacctgctgggtcacatacccaactctagatccagggatggagtcagcccatctgaacctatctcaaccacataaactagacctgacatttcagaacccaaggatagagagaatcctaagagcttccagagagagagaagaaaaagcagggtcaagaatcaaatggcacagccaggagcagtggctcacgcctgtaatcccagcactttgggaggccaaggcaggcagatcacgaggtcaggagatcgagaccatcctggctaacacggtgaaaccccatctctactaaaaatacaaaaaattagccaggcgtggtggtgggcgcctgtggtcccagctattcgggaggctgaggcaggagaatggcgtgaacctgggaggcggagcttgcagtgagccgagatcatgccactgcactccagcctgggcgacaaagcgagactccgtctcaaaaaaaaaaaaaaaaaaaaaaaaaaacagaatcaaaatggccccaaacttctcagcagcaatgatggacactgcttagaagtctatactgataaatcaagcatgagggtagaaaaaggacaatttcaggcttacgaagtctcaaaaaattactttccataaattactggaggacatgcttcaacaaaaagtgagcataagccaggaaatagaaactctgggaatacagaaaacaggggctacacaaagatgagagaagggactccttaggttgatgacaaagagaaattgatggacaatagctgtgtagcctccatccagattggagtgagtctgggggaagagggggagttctgaggcacaaaaaaaaaaaaaaaaaaaaaacctgacaaattatttgacatgaatgaccgtgggtaaaattgaattgaaagtcttttactgggccaggtgcagtggctcatgcctgtaatcccaacactttgggaggctgaggcaggtgaatcacctgaggtcaggagttcgagaccagcctggccaacatggtgaaaccctgtctctactaaaaatacaaaaattagccaggcatggtggtgcgcacctgtagtcccagctgcttgggaggctgaggcagggagaatcacttgaacccgggacagggaggtttcagtgagccaagattgcaccactgcactccagcctgggcaacagagcaagactccatctggaaaaaaaaaaaaagaaaagaaagtcttttattgaactactggagactgcgggaatatttagtcaatttcaaagacaaaacaagtaataaaagggaggaaaacattaactccaggagaagtgaaaaattgtgtgtaagaagaagttgtaattattatatactagccaattcaacaggtaacaatatttacctaatagtaataaaagcaatgaatatggattataccagaaagtaagctaaataaatgggaaagatggggaaaggggcaaagggatgtgtgactgatcaaaaatagtcatctcagctggatgtggtggctcatgcctataatcccagcactttgggagactgaggtgggcagaatgcttgagcccaggagtttgagaccagcccgggcaacatagcgagacctcatctctactaaaaaaaaaaaaaaaaaaaattagctggccatggtggcctgtgcctgtagtcccagaggctaagatgggaggatagcctgagtctgagagtttgaagctgcagcaaactatgatgaagccactgcactccaccctgggcaacagagggagactctgtctcaaataaaataaaataaagcttccctgggtgacccttacttagaaaaacctacattcattcattcattcatttatcgagatagagtcttgctctgtcacccaggttggagtgcagtggcaccatcttggctcactgcaacctacacctctcaggttcaagtgattctcctgcctcagcctcccgagtagttgggatgggaccacagttgcgtgccatcacgcttggctaattttttatattttggtagagacgtagtttcgccatgttgtccaggcaggtctcaatctcctgagctcaagcaatccactaacctcagcctcccaaagtgctgggattacaggtgtgaaccacagcacccagcatcatcagcattatttctgttgcaagtgaccaaaacagaattaaactagtttgtgcaaaatacttactaatgctgctgctgctgataaatatattagcttacataaccccaaggagttcaagaaggttgaatcgtagctgggcgtggtggctcatgcctgtaatcctagcactttgggaggccgaggtggatggatcgcctgaggtcaggagttcgagaccaccctggccagcacagtgaaaccccgtctctacttaaaatacaaaaattagctgagtgtgatggtgcatgactgtaatcccagttacttaggaggctgaggcaggagaatcacttgaacctgggaggtggaggttgcagcaagctgagattgtgccactgcactccagcctgggggacagagtgagacactgtctcaaaaaaaaaaaaaaaaaaaaaaaaaaaaaaagagaagcttgaattgcttcaggaatggctggatccaggggaactctcaaatgatgttccccaggaagctgtcactcatttctccatctctcagctgcttccttttgtgtcagctttaacgtcaggcagaacatctccatgtggtctccagaagctttgggcttatatcctaccaggttagcaaactcaggggagaaaaaagaactcttgttcaatattccagtaaaagtccagggtttggttctcactgggctggtagggccatatgatcctccttgagccaatgcatgagacactgatgagctagacagagttcacctgctcatccctggagctagggaatatgtcagacccctcagtctgaaattgagagtttgagaggggagtttcccaaaggaaaatagaagtactcttagcaggagaaaaaggagtgaatgttggacattggtaatgataaatgtccacagtggatggagtgcaggtagcagaagatccaaaagaatgataatacccagtgttagcagctatgtagagaaacctgaattttctggagctaatgcttggaatgaaaatcttccaggaagacaatctaacgaaatatatcaaaagccttaaaaccttagtcttttttttttttttttgagatagaatctcactctattgcccagcctggagcacagtagtgtgatcttggctcactgcaacctccaccgcctgggttcaggcaattctcctgcctcagcctcccaagtagctgggattacaggcacctgccactgtgcccagctaatttttgtatttttagtagagatggggtttcaccatcttggccaggctggtcttgaactcctgacctcgtgatccacccacctcagcctcccaaagtgctaggattacaggcttgagccactgtgcctggcctcaagcttagatagtctttaaccaaggtatgccactttgaagaatgtatcctaaataaatacttaggtatatacagaaatattcaaatatgaaatctatgtacctcagttttggttataatttggaacaacagaaaatatactgattatacactaataggagactggctaaataaattacatctatattagtaaacatgttaaagcaaaaaataaaactagtttgtttttaatttttattactttatttttccataagttattggggaacaggtggtgtttggttacatgagtacattttttagtggtgatttgggagactttggtgcacccatcacccaagcagtgtacattgcaccatatttggagtcttttatccctcacccccctcccactcttccttccaagtccccaaagtccattgtatcattcttacgcctttgcgtcctcatagcttagctcccacatatcagtgagaacatacaatgtttagttttccattcctgagttacttcccttagaataatagtctccagtttcatccaggtcactgcaaatgctgttaatacattcctttttatggttgagtagtataccatcatatatacatatatatattcacacctgtaatcccagcactttgggaggctgaggcaggtggatcacctgaggtcaggagttcaagaccagcctggcaaacatggagaaaccctgtctctaccaaaaatacaaaatttagccaggcatggtggcacacacctgtaatcccagttacctgggaggctgaggcaggagaatcacttgaacctgggaggcagaagttgcaatgagtggagatcacgccactgcactccagcctcggcaacagagtgagactccatctcaaaaagtaataataataaatgaattaaaaataaataaaaataaaaaagccttaattagggctgggcacagtggttcatgcctataatcctagcacttgggaggctgaggcaggtggatcacttgaggtcaggagttcaagaccagcctcacaaacatggtgaaaccctgtctctaccaaaaaatttataaattagccagatgtggtaatgcacaccggtaccaggtcccagctactcaggaggttgaggcaggagaatcacttgaagtcgggcggcggaggttgcagtgagccgagatggtgccactgcactccagcctgagcaacagagcaagactccatctttaaaaaaaaaagcctcaattaaaaaaaaatagcttccataaatttaaaagaattgaaatcgtacaaagtacgttctctgatcacactagagtaaaagttaataactaatctgggaaagtcacaaatatgtgaaaaacaaacactcctaaataaccaatgggtcaaagatgaaatcagaggggaaatcagaatatttttagatgaacgaaaatgaagatataacatatgaaaacttacggtatgcaagtaaaacaatgcttagagggaaatttaaagttgtaaatgtctacatttaaaaagaagaatgaggccaggcacagtggctgacgcctgtaatcccagcactttgggaggccaaggctggaggatcacttgagcccaggagttcctgaccagcttggggaacatagtgagatcccgtcactacaaaataaaaattaaaaaattaaccaggcacagtggcgtgtacctgtagtcccagctacttgggaggccaaggcaggagggttgccagagcccaggagttcaagactgcagtgagctacaatcacaccactgcactccagcctgggtgacagagcaagaccctgtctctaaataaataaataaaggaaaagaagaatgatctcaaatcaataacctaaatttctaccttaagacattgaaaaaagaagagcaaagtaaacccaaagaaggattagagtggaaattaatgaaatagagaatataaaaatgacacagaaaatcaatgaaattaaaagttaggtcttggccggacgcagtggctcacacctataatcccagcactttgggaggctgaggagggcggatcacctgaggtcaggagttcgagaccagcctggccaacatggtgaaactccatctctactaaaaatacaaaaattagccaggcatggtggcgagcgcctgtaatcccagctacttgggaggctgaggcaggagaattgtttgaacccgggaggcggaggttgcagtgagccaagattgcactccagcctggatgacaagagtgaaactctgtctcaaaaaaaaaaaaaaaaaaaggtcctaaaaagaccaacaaaattcacaaacctttagctagactgactaagataaaagaagaaaagactcaaattactaaaatcaagaataaaagagaaggcattaatgccaaccttacagaaataaaaggaattataaggcaatactgtgaacaaccgtatgtccactaattcaataatttagattaaatgcataaattcctagaaatataaaaactactgaaactgactcaagaaaaatgagaaaatctggccaagtggggtggctcacacttgtaatcccagaacttcgggaggccaaggcaggtggatcacaaggtcaggagatcaagaccagcctggccaacacggtgaaaccccgtctctactaaaaatacaaaaattagccaggcatggtggcacgtgcctgtaatcccaactacttgggaggctgaggcagaagaatcgcttgaacctaggaggcggaggttgcagtgagccaaggtcactccattacactctagcctggacaacaagagtgaaactgtctcaaaaaaaaaaaaaaaaaattcagtctgggcgcagtggctcatgcctgtaatcccagcactttgggaggccaaggtgggcggatcacaaggtcaagaccatcctggccaacatggggaaaccccatctctactaaaaatacaaaaattagctgggtgtggtggcacgcgcctgtaatcccagctactcggggggctgaggcaggagaatcgcttgaacccgggagacggaggttgcagtgagctgagtttgtgccactgcacaatccagcctggcgacagtgggagacttcatctcaaaaaaaataaataaataaaataaataaataaatagcaagcaaaaattagccaggcatggtggggcgagtacttctagtcccagttactcgggaggctgaagcaggagaatcgcttgaacctgggaggcagaggttgcagtgagccaagactgcaccactgcactccagcttgggcgacagagtgagactctgtctcaaaaaaaaaaaaagaaaagaaaagaaaagaaaatcggctgggcgcagtggctcacgcctgtaatcccagcactttgggaggctgaggcaggtggatcatgaggtcaggagatcgagaccatcctggctaacacggtgaaactgtctctattgaaaatacaaaaaattagccgggcatggtagcgggcgtctgtagtcccagctactcgggaggctgaggcaggagaatggagtgaacccgggaggcggagcgtgcagtgagccgagatagcgccactgagtccagcctgggtgaaagagcgagaatccgtctcaaaaaaaaaaaaaggaaagaaaatcaattaatgtagtacactaccttgccttaaagaatgaaggggagctgggcacgatggctcacacctgtatttccaggtacatgggaggctgaggtgggagaattgcttgagccctggagttgaaggctgcagtgagctttgattgcaccactgcactccagcctgggtgacagagcaaaaccctgtatctaaaacaaaaaacacaaaaccaatggtgaaaagctgaaagcttttcccctaagatcaggaacaagacagagatgcccactttcacagttgtattcaacacagtactggcagtcctagccagagaaattaggcaagaaaaagaaaaggcatccaaattggaaaggaagaaatagaacgatctctatttgcagatgacattatcacatatatagaaaatcccaaataatccacagtaaacccttttatttatttatttatttagagaccaaggtctcactttgtccccaagactggagtgcacctgtgtgatcatagctcactgtagcttccaacttctgggctcatgtgatcctcctgcctttgccttctgagtagctgggactacaattatgcgccaccatgcctggctaatttttaaatcttatttttgtatagacagggcttcactatattgcccagactggcagaaaagttttttttaattactagagttaataaatgaattcagtaaagcagcaggggacaaagtcaacacacaaagaacaattgtatgtctactcaccaacaatgaacaatcagaaaaagaaattaagaaaataattctatttataatagtatcaaaaataataaaatacctagggataaatttaaccaaggaggcaaaagacttatacactaagtttcatttaaataggacagtgaatgtaaaagtgtgattagcacagggcctgacccaaaatagatgcttaatgcctattctcatcagagacactgctgaacgccatagaaaggacagagtcggctacaccgacagggacaaagttcctttggaagtctggcagccctgctccttcctagggatagagttttgcttagctttgcggagtgatcagcaagaacacccttaagtttatgaaaagagtctgtggagttatttgcagagaaaatagtaagggataagctaggaagaaaataagggagaaactagaagataccaataaatcaggaatgtggacggcagctttaaaaaggcaaggaacaggcctgacatggtgggttcacgcctgtaatcctagcactttgggaggccgaggtgggaagattgcttgaggccaggagttcaagactagcctgggcaacatagcaagaccttgtctctacaaaagaaaaaaaaatgttttaaaaaaattgtaaaggggaaaaaaaaaaaagcaaggaacacaggctgagtcccaggtacaagagagcgacagatgggctgcggtctgcgatatgccccagagtataatctgccaaaagtccgtggacaattccagctgaggaggaagcttctaggtcctcccaagccagtccctttccccctaatctgcccacccttggcatgaatggctaagtagctcacaggggagggattgacctgggcttctcgcttgttttaaaatcctccttaaagccaagggattcttttgttcagtctgcttctctggaaagggaaaatctcttctggagggtgacaggctctgatatcccctgtctaagaagcaaagcctcttcccagccctcacaagccctctttgaaatcttgtcccggcttctggagatgagcttttgtgctgagtcagtttggctgccttccagccaagaacagagaagtgcaggctgcaatgcaggggccattaaactatttttaggctctatttcaatcttattcagcacaggcggtgagacacaaggcctgaaggtggacagaccagggggatgccgcctgggacaaagtcccaggcaagtaggtcagggaaaagacaaggagatctcgctatgtggagagaaatacttagccaggcgcggtggctcacgcctgtaatcctagcactttgggaggccgaagcgggcagatcacgaggtcaggagatcgagaccatcctggttaacatggtgaaaccccatctctactaaaaatataaaaaattagcatggtggtgggcgcctgtaatcccagctactcagaaggctgaggcaggagaattgcgtgaacccgggaggctgaggttgcagtgagccgagatcatgccactgcactccagcctgggcaacagagcgagactccgtctcaaaaaaaaaaaaaaaaaaaaaaaaaaagcacccagatgctcatgctgctacccaagtgcagaagacagaagaaagacagctgcccagagaatttggccctgtagagtcatcaagaaaaatgaagaaagggaagggaagggaagaaagtacagtgccttccataaagagaccagggcagcctatacccagggatccttgttaaaaatacacttcctggctgggcgtggtggcacgcacctgtaatcccagcactttgggaggccaaggtgggtggatcacccgaggtcaggagtttgagaccagcctggccaacatggtgaaaccctgtctctactaaaaatacaaaattagccgcacacttataatcccagctcttgggaggctaaggcaggagaatcacttaaaccgatgaggtagaggttgcagtgagctgagattgcgcccttgcactctagcctgggcgacagagcaaggctcaaaaaataaaaataaaaaaatacacttccttggtgcatctcaggtcaattgagtcagaatatttggaatgggacttgggtgtctgtgtttctaatcaggtgccaggatgggtgactcccacacaggctgaagttcgaggacctctgagctagagagtacctgcctttggaattcaaaggactgatgtggactgagggtagcggtggtgatttaacagccaccaaaggtaccattctcttctccttgctaggctcaggtttcttttctttttctgaatggggactcactatattacacaggctggtcttgaactcctgggctcaagcaatcctcctgcctcagccttctgaatggcttggattataggcatgagccaccacgcccagcaaggatcaggttttcatccgtaaaatgaacggccctgctaggggcaggaatttattacttagctcttactcttaaaatccttatccctgggatactcagtggtcggcagagagacctggaggaatagcttttatactggaggtctgcattatccatggaaaatcagtaaaagtccacttagggggaatatgcttatgatgggaaccaagcttaacagcatgttgtggggggataaagtttcatcaggacaatcacaaaaaataaaatgtgtttcctcttggagttagcaaactatatctgcaactatgtaataattctcaaatatttttacatttctacatctttttttttttttccaagacggagtcttgctctgttgtccagatggtgcagtggcaccatctcggctcagtgcaacctccgcctcggggattcaagcaattctcctgcctcagcctcccgagtggctgggattacaggcgcgcaccaccatgcccagctaatttttgtatttttagtagagacggggtttcaccatgttggccaggctggtcttgaactcctgatctcaggtgatccgcccaccagcctcccaaagtactgatattaaaggcgtaagccactgtgcccagcccatcttattttttaaaatgaagaatggagtactgatggtggggtcaagatacactttttgacaaaactgtccaagaatagtctatgccatcctttactttgacttgcaggagtattacaaaggatgtaattttatgaacattttaaaggttgttacctatcttcccaagacttctcttaatcaaataattatattttgaggcacttttgtcattaccttaaagactctactcaggccgggtgtggtggctcatgcctataatcctagcactttgggaggccgaggtgggaggatcatttgagcccaggagtttgagaccagcctgggaaaaatagtgggatcccgcctctacaaaaaatttaaaaattagccagaaatggtggcacacacctgtggtcccagctacttgggaggctgaggcaggaggatcacttgaacccaggagaggttgaggcggcagtgagctgtgttcgtgccactgcactccagcctggacaacagagcaagaccctgtctcaataaaaaaaaaatattctcctcaaatgttacctggtctcactgtcctgtatctctgtatgtgattgattctccaacaccactctcgccatctccatgaaatcctgtaagacttagaattactctctgtgaagtacagttgatctctgaacaatagtttggactctgtgggtctattatatgcagatttctttttttaaaattttttagagatagggactcgcattgtttcccaggctggagtacagtacaggcacgatgaatagctcactgctaccttgaactcctggactccagtcatccgcccacctcagccttctgagtaactgggactattggtgcataccaccacacctggctgatttttaaattttttgtagatacagggtctctcactacgttgcccaggctggacctgaactcctggcctcaagggatcctcccgccttagctttccaaagtactaggattacagtcatgagtccctgcacagattttgttcaataaaaataacagtggtgcctgcctccccctccacctcccccactttttctgcctctgccatccctgagacaccaagaccaacccctcctcttccttagactattcaaccctgagacagtatgtgaagacctttatggtgatccacttctacttaatagtagatatatattttcttccttatggctttcttatttatttatttttgagacggagtctcactctcgcccaagccggagcgcaggagcgtgatcttggcttactgcaacctctgcctcatgggttcaagtaattctgcctcagcctcctgagtaactgggactacaggcatgcgccaccacgcttggctaatttccatgtttttagtagagacagggtttcaccatgtcggccaggctggtctcaaactcctgacctcaagtgatccacccgccttggcctcccaaagtgctgggattacagacgtgagccactgcactcaggcccccttgtgactttccttataacattttcttttctctagtttactgtattgtaagaatacagtgtataagatacaaaatatatactgaaaatatgtactgactatgttagcagtaagtaactactaatagcatactactggtcaacagcaggctattagttaagtttttagggagtcaaaagttatacacggatttttcaactgtgcagggcagggggtgttggtgcccctaacccctgagttgttcaaggatcaactgagtttgtcttctgtttgcactgcactgtcagacatttataacatccaacgatcagagacaatttgtccatcggcaaccctgacaggactaatgggaagagcgggtggggagggaagagttttgctttttgtgctctgctgcctttggcttctcctaccacctcttaacagcaggaacttgggataataaatacaagatcatgaggacctcaccccgcaaagcacaaatagggtgtgcgtagacaagaggtgagcatctctctgcagaattggaatctttttccactctgcttttattggctgctgagaaaaagtctctctacaaatgctttttcacactgtgtcacagctcccacctgcccttccagactgcaaagccaccttgccaggaaccacagacaaaggccactggtcaggtgacgctttttaattggctggtgtctttggagaatatcaagagtcacatgtgggccagagcagaaagcagaagcccagtgctcagggtgaggccttgggggaaacaacggtctgcgcgggagatcagcgatggctgaagaatccctgaggatggttgtatttaaatggcttcatcctgctaggacccctagagaaataggagaacggagttgttaataacacaccttctaggctgataaaataaattatggttcattcacacaagggaaaaagaagaggcagagttacatgacacagaatgttgttgagaaaagcatacggcagaacaacatataaggtgcgatactatttttgtaaaaatgtctttttgtgcttgcaaatgagtgaacacaaacttggaaaggccctcactgacagtggcacttcggggacatagctttaggcaccctcactttttaggattgttcctttttttattttttgagacggagtctctgtgtcgcccaggctggagtgcagtggcgtgatctcggctcactgcaacccctgcttcccgggttcaaaggatttttgtacctcagcctcccaagtagctgggattacaggcatgcaccaccacgcccgggtttaggttgaggtttagtttaggttttgccatgttggccaggctggtggaactcctggcctcaggtctcttgctgcccatgccagcactctgcatcctggccggagagccttgcctctcacatctaccggccatagagttaactggatctgagtcactgaaggagcaccttcccagaatgctgacagaggagctcagcctggagacacaacaaagcccttcaagaatggggtcctttggccgggaggtggaggttgcagtgagccgagatcatgctactacactccagcctgggcgacagagtgagactctgtctcaaaaaaaaaaaaaaaaagaaaaaagaaaaagaaatgggtcctttgggaaccactggagaagaggaaatcaatgctggccatgtgagaattcccaccctggcaatgtgctagaatgggctgggcaggtgagaagagcagaggtctcacacaagccctctagggagagagcaagtcctagaaggtgccagcatctggccaccagctccacctcccagcagccactcagagctggaactggttattatgagataacataatgaaccaggccagtggaggtgtcagatgaggtgaaaggatgctgggactgcttctaggggctagaactggctgtctgagaacaaggtgagggagaggtaaggcactgtttagactgacagggaacagagaacaaggtgagggagaggtaaggcactgcttagactgacagggaacagagaacaaggtaagggagaggtaaggcactgcttagactgacagggaacagagaacaaggtgagggagaggtaaggcactgcttagactgacagggaacagagaacaaggtgagggagaggtaaggcactgcttagactgacagggaacagagaacaaggtgagggagaggtaaggcactgcttagactgacagggaacagagaacaaggtgagggagagataaggcactgtgtagactgacagggaacaaggggggatgttctgattagaaacagattatcactcttcttccttcccaaacactgctccccgccaacctcatgcagaagggaagggatgcctgagcagtgaaatctgcagttttgaaactgactcttaaaagaacatgagttagaggctgaaagggaaataaaggacccaaaatgaaagagaaaggaaaagtagctggaagtgccatgagcccagacactcttgagtaccaagctgtcaggaactgctggcattttccgagtcccagtcctgtgccaggactttatatgaattacttctgcttcatcatgagctagaaggtattactttcaccatttctgtctttagaaaataggggtcaggcacaatggctcatgcctgtaatcccagcactttgggaggctgagacaagctgatcacttgagcctaggagtttgagaccagcctggctaatatggtgaaaccccatctctacaaaaaaatttaaaaattagttgcgtgtggcggtgcatgtctgtggtcccagctactagggaggctgaggcggaaggatcgtttgagctccagaggtcaagactgcaaggctacagtgggctatgatcatgctgctgcactccagtctgggcaagagagtaagaccgtgtctcaaagaaaaggaaacaaacaaacaaaaagctggaggagggctcagagctaagcagaactgactcttctaaggtcagcagcaaaacagagatctgcactcctatctgttttactttgaagctggttccttctgtgccacctgactgcctaagctgtgattctcactgacaggacagtaccctagaaagaccacagcagactccctggggacaggcgaggatgcacacagtttaaaaagcttatttggacactaaaaagcaaacaaactctattgttttccacagaaagtatagaaaataaagttcagccaaatcctcttggctcagacctggcactaacaccttcaggaggtgttagtgaaaaacaggtggaccagagtgataggcatcggctgcaggggaagtttcaggaaggaagaagcaagctctccccagaaaatctggctctgatctctgtcccacatcaccatgagaagtcaccagagccccaaccctctcctcacctgaagagccgcagacacatcttctcctggggaaattccttgggcccctccacactgtcgtcatggctctcggtctccaggtaaacatccagcagcacacacagccgctgcagctggttggtcaacagctggtggctgggccaagggccacacagctccttgtagcacacattgacttcgccctccatggcctgtgtgataggaaagccagcatctcagcactaccttcctgcatgtgggggaccacactggccaggcttccgtccctggatgggcccgagcgctgatgcctctgcaggggctgggccaggggctaggccatcagatcaagctagactggcttgtcctcaggccccctcatcaagacaatgaggtcttcctgattctgacccatagctttccctgcctcatatgcccacagccaggaaaacagaggtgtgcagggaagcagtctcaaaataagacctaagtcagaagatgttggttaaaaacgtgttccatggcatgtttgacttagtagcagcaatgctgattaacaactgcaatgctgattaacagctgcaatgctgattaacaactgcagtgatgtcattcctcatgtcattccagtgcttctataatgcttcagagcttattcacattttttataggagcccaagccaataacctttcaaggtaggtatttctccttactctctaagtggggaaacctgtggaccccaaggtaggcaagtaggtctgggctctttcctctagtacaccacacaagctccagcaaattctgcaaatcctggcacaaccttctgttttgggaattaaggcagtgcccaagtcctcagctgcagtgggttctgccacggccacctcccccgggagctctgcctgctcctcctgtcatccccagctgggtcttacccgaatgttgtcatcgttgctgttggttttctcccctttccagttcaaacagagctggaaaacaggtgggatggaggagtagccagggttcaacaccacagcggcctgcagtttggctgggaagagaggagagaggggaaatgcgcagttctaagactcagcttgccagccatggcagcctccccactgcacccctgaggctagctcagatgtctcctattaatctgaatgctgcagagtatattctggtaccaactgttccagaatgtcctaagtggaattgccagcttgcagaatgtgaggtcctataattggtctctccaaggactttgacatatttactgtgccacaaagctgcggactccccagagtctggtccaccttggctctctccatgagttctatttgctactttgatagaagtgtaattgtcatttctttatttgccagcaagctaaggttttctccatgtgaaagcttactaatttttcaacaatactgtgtatcaactatcacatcaaatatattttctctattttcttcatttgatttttacatactttgttacataaaattctgtatactagccaacatgtagagagtccttactgtatcccaggcactgtgctaaaccctctagacacattttatttcatcctaacaataattctatgagttaggtactattatcctcatcctcattttacacataaagaaacaggctctgacagaaacttccctaccatcaaatagttggaaggtagcagtgctgagtttaaccagaactggctgatatcaaagctgtgttcataatcattaaacaaaatatttgtgtttttgaacatactcatttattctctggtgaaagcctttgcctttttcaacaggaagacatttatcttctcaagtgggataggtatgccattcctttttagttatttttaggggggagactttcactctctgaccactagttattcaaataacagaggagaggagaggttaacacaattcttccctaacagtcagaacattaattaaaaagttgtggctggcgcggtggctcacgcctgtaatcccagcactttgggaggccgaggtgggcggatcacgagatcaggagatcgagaccatcctggctaacatggtgaaaccccgtctctactaaaaatacaaaaaattagctgggcgtggtggtgggcgactgtagtcccagctaccagctactcaggaggttgaggcaggagaatcgcttgaatccaggaggtggagcttgcagtgagcagagatcgtgccactgcactccagcctgggtgacagagcaagactccgtctcaaaaaaaaaaaaaaaaagttgctttacctccccctgtccccaaaaaagagtgttctggactgggcatggggggtcacgcctataatcccagcactttgggaggcagaagtgggtggatcacttgaggtcaggaccagcccagccaacatagtgaaatctcatctctagtaaaaatacaaaaattagccaggcctagtgggacatgcttgtaatcccagctgcttaggaggccaagacgggagggtcacttgaacctggtaaggtggaggttgcagtgagctgagatcatgccactgtactccagcctacgcaacaaagcaagactccgtctcaaaataaataaataaaaagtgctttctggccaggcgtcgtggctcacgcctgtaatcccagcacaatggcaggctgaggcagaaggatggtttgaagccagaagtttaagaccagcctggtcaacatagcaagtcctcatccctataaagaattaaataaataaaaaataaaaataaaataaaaagtattttctttctctgctgctgtattgcttctgtcctaataatcagcatacatttctggatttatctctgttcatcaattttttttttttttttgagacagagtctcgctcttgttaccaaggctagagtgcaatggcccaatctcagctcactgcaacctccgcctcccaagttcaagcgattctcctgcctcagcctcccaagtagctggaattacaggcatgcgccaccgcgcccagctaatttttgtatttttagtagagacgggttttcaccatcttggccaggctggtcttgaactcctgacctcgtgatccacccgcctccacctaaaagtgctgggattacaggcgtgagccaccacgcccaggctgttcaccaatttttaaattcacactacagaaagtttccaaatggatctgttgtagaatgactgaagaatttttttttttttttttttgagatggagtctcgcactgtcacccaggctggagtgcagtggcgccatctcagctcactgcaagctccgcctcccgggttcacgccattctcctgcctcaccctcccgagtagctgggactacaggcgcccgccaccaggcccggctaattttttgtatttttagtagagatggggtttcaccatgttagccaggatggtctccatctcctgacctcgtgatccgcccgcctcggcttcccaaagtgctgggattacacacctgagccaccgcacccggccatgactgaagaattatatttgcaattgttgcccacttattcgtctaaattttgcttttcaatttcacaatgcactcaaatgaaaaaatatatatatatatattttttgagacggagtcttgctctgtcacccaggctggagtgcagtggctcgatcttggctcactgcaagctcgaaccttccgggttcgagcaattctcctgcctcagactcccaagtagctgagattacaggtgcccaccaccaaccccggctaacttttatatttttagtagagacagggtttgctatgttggccaggctggtcttgaactcctgacctcaagtgatcctcccacctcagcctcccaaagtgctgggattacaggcatgggccaccatgcccagcccataaagtacttttaaattaaggtatatatattgttttttgttgttgttttttttgaaagagagtcttgctctgtcgcccaggctggagtgcagtggcatgatctcggctcattgtaacctccacctcctgggttcaagcgattctcctgcctcagcctcctgagtagctgggactacaggtgcatgccaccatgcccagccaatttttgtatttttagtagagacagggtttcactatgttggccaggctggtctcgaactcctgacctcaggtgatctgcccacctcagcctcccagaatgctgggattataggcatgagccactgcgcccggctgtatattgttttttaaaaacatgatgctattgtacacttagactatagtgcaaacataacttttatacgtactgggaaaccaaaaaatttgtgtcacctactttattgcaaagtttgctttattgtggtagtctgcaactgaacctgcaatatctctgaggtatgcctgtactttatgttgtttagggatgagataaaaggaagaccgggtgtggtggttcatgcctgcaatcccagcactttgggaggccgagttgggaggatcacttaaacctaggagttcgagactggcctgggcaacaaagcaagaccttatctctacaaaaaaaaaaaaaaaaaattagccaagcatggtggtgcacatttgtagccccagctactcaagaggctgaggtagggaaatgacttgagcccaggcagttgaggctgcagtgagccatgactgagccactgtactccagtctaggcaacagagcaagaccctgtctcaaaaaataagttaaattaaattttgaaaggggagaggccaggcatgatggctgatgcctacaatcccagcactttggaagaaaggccaggagtttgagaccaggcttggcaacatagtaagaacatgcctctacaaaaaaacaaaaacaaaaacaaaaaatcttagctgagcatggtagcatacctgtagtcgcagctactcagggagctaaggtggaagaaggattgcttgagtccaggagttcaagattgcagtgagctatgatcgtgccactgcactccagcctgggcgacaaagcaagaccttatctctactgaaaaaaaaaaaaaaaagggtgtagcggggaaaggatggaaagcaaatgcataaaatccaaatagtggtcacttattaggagaaagggaataaagtgggatagggaggcctcaactgtatctgaaatattcagtttcttcagaattttttttttaaaagacatgaagaatagaaagagaagaaagtggggtagtgaggacagaaactctgataccaaagagttcagcctttccttacagttctggaactgtcttagaactacagacaacttcctcagctcagcaccaagtcttgagggtgtcagatcccacgggcagtgccaggcttgctgcggcttgggtgggacaacagcacaacggcccaaacacaacatcccaggacttcagcagggagccctggcagagtcagatgccagaagaggtatgaagaatcagagctttcaatgcctctaaagtgagtgcagggactgcagaagagggagcgaggccctgtggccctgccctttacaacctgagggtgacacctcagccctgttatgaagagggagaaggaggagatgtccggtactagaaagcggtgaaggaaggagcaaagagctcaggctcagcgctcagactgggcttgcaactaagcctgaatttcctcccatgtaaaatagaaatgaaagcaccacccctaggactgcagtgagggttcagtgatacacagcgtgtgtgtgactgtgttgcagaatgagtccttgctgaacaggctctcacgatcattattatctgttaagtccttgcaggactccaggatcttctgctttgggcagccccggagagtgtttgattcttggcagcgccctttgtctagaacccctgtaatcagcagagcaattacctgtgcccctttcgatgagcgccatgtagtagagattggtgtccccagccagtcccgcatccacaatgtctttggtgaagtgcagctcctagaagaggtaccacagacaagaggtgaactgctggctcctctggttaaaccccctgctcttccagtgaggtggcaggagctgaaaggtgacatggtcctgcaatcctcaggacagtaagggtaacttgtcactccttcacctaccatgtaatcctcatgggcaactgtcacccatttcaccaggcgagagacaaccttggcagggaagaggtactggcaatcactggtaactggcacaatgccatgttctaaaagagaacaagacagatgacgtcacaggtagaaatcaggtgccacagatgggtaactagcatcctcctggggctctctgaagggctcagatggcccggccagctatcctggtatacctggtactcaggaagtacccaggtcaacacgtgccaggaatgcaagcatgtcaacctgaccttcacccagtgctatgtgcttgtggccagatccagtgccagcacttatggtgctttctctttaatgcaaatgatagcctgccaaagaaaaacccttacagtcagaactagggagggtgcccctgcagcagtgactgttaattagatcaaatagcatagaggcctgtgttttcatagctgaccttgatggaggaaacaactgaagtgttgtgtgtcagggagaagagccagataactgctccagggtaaattcctgctggcatttaaataagcaaatatgccaacacagtaagtactgtccagaatgacaagttccctaccttgggacaaaacaaactcagcagtgctgatggggagcacggcccgatggacaaacatcagtgctctggagagatcggcagccatgtggagtctaagaactggtggggagtggtctccagatgtgtcctggaaacccaatgcctttcctgacagagactcttttttattttttactttttattttgagatggagtctcgctttgttgcccaggctggaatacagtgatgcgatctcagctcactgcaacttccgcctctcaggttcaagcaattctcctgcttcagcctcctgagtagctgggaatacaagtgcacaccaccatgcccagctaatttttgtatttttagtagagacggagtttcaccatgttggcaggctggtcttgaactcctgacctcaagtgatctgtctgccttggcctcccaaagtgctgtgattacaggcaagagccactgcgcctgtcccagagactcttttaggtcagaaaaatcttgaccccatccccctgccacatggtaagcatttgacaaccacttactgagtgaataaactaaaagaagcccccaaatgccaccacctaagtcagtggctcatcattatcacttgggagcttagaagaaaacataggctcagcctcaccctggggaacacgaggtcagtaggccttggggaagggatatgcgagttgctccctggatagctatattcaaaaagctgactgtgagccacagagccaggggcaggggttcactgtgctcagttcttcccccagcactatgctcagtgcctggcatgaatcaggatctcactaaatatgtgtcgaatgcacatcaaaatctgcaatgcatgacctaggatgaactgccccgaccagtccacaaacttgtgccacccaatggctctgggcctcctctgtgaggcaggacagcactgatggctctaagggggagctcggtcctctgcctggacaggcctggagctctccccagtggctctgccaagatgcccactccgtaaagccaggaatccaggtcttgtatttgtcatcaggattcaagttttgagtgaaaggctaagttgttgttgtccgtgtgttgtctgagtgactcttaaaccactgccccatcatcagcttacctagggatgcaaactgtttgtggagggccaggcgggactgcaccctggtcttcagaagtttcatggtggtctccatgtggctggcgctcagcgagtggtcagcaatcactgtttgctgtgagtgacaatgagacacatacacgtgtgctcccccatcccttcctccgggcaccatctctctcctgggacctgcctgtctgcggcaccctggattatccatgccccaagatgggtaccctttagacatggcaaggtttatctgctatgacaggccagacgctgagtcctggcagaaacaacacaatatgctgcgttcttgagaagctgtgtccaactcctgaggaaaggcaggcttctgctaaggggccaggccccctggatttctgctcatgcctcatatttggtacttgcacacaagaacaagggcagcagagcctgcagacatgagtcccagagcaaggactcaagttgcctgggtctaaaaggctactaggctcagagaaaatgcaaaaggtacgtaaactcttgtaagtctaagacattttagtgtcctgagtggatagaagacaggtcacagccctgaggggacacattctgccagttcaaaactccaaaggccatgacaggcctttttttttttttttgagacggagttttgctcttgttgcccaggctggagtgcagtggcatgatctcagctcaccgcaacctctgcctccctggttcaagtgattctcctgcctcagcctcctgaatagctgggattataggaacgtgccaccacacccagctaattttttgtatttttagtagagatggggtttcatcatgttggccaggctggtctcaaactcctgacctcaggtgatccacctgcctcagcctcccaaagtacaaggattataggcatgagccaccgcacctggcctggcctttctagagtctatacaggaagagaagaggtaagctcctcagccaactagatgagatcagtgtacagacctggggctgctctttggggaagtggaggccacccagcttctgcacccacaaataggggtgacctagctcaagtacatagtcgctcaaagtcaggatgctgcagaaaagaagataaataaaattgtgctgtaagtcatttctgctgtggtcccaggatacagcctcctcccaccctcccatgccccacaaaccatccagtcctgcaggtttggccatgttcacagccaggctgctggcaaagcccttcaactttgtcagttccctactgtgaatttcatctctctcacattcactttcctctttttccttttcttcttgcagccttcaacttataagcaaatatcaaatacaaaggcagtgtactaatgtctttattggtctaccaatttagaaaatcttttaaaaattaatcctcggataattaaaatgtcaaacatttttattgtatcacgtattattatgcttccagagggttttttttgtttttctttttgtttttgttttgagacagggtctggctctgttgcccccaggctggagtacagcgacatgaccatggctcactgcagcctcaacctcctgggctcatgcaattctcccacctcaacctccccagtagctgggactacaaatgcccaccaccatgcctggctaatttttgtatttcttgtagagacagggttttgccatgttgcccaggctggtatcgaactcctgagctcaaggaatccacctgctttggccttccaaagtgctgggattacaggcgtgagccaccacacccagcatgtttccgagttttgatccttccaccctttttgtgatctccctttgccttgtaagcaagaaagaacaaacatttccttctaccctgtggtctttcctatcctctgggtcacctctggccctaacaggtctccagcatttagcttgagccaccagagaaactcagaagtagagagctcggagaggaggaaactgctgactcacccaactttatcaaactgatactgattggctggattcggagttttctttccatgatccccaggatacaagcaactcaggactgagtcaggagacagcaagtcactagaaaaggaaaaacagtaagcagtgagaatgcagccaacatctttcttcaacataggcttgggcatttggggatggtaatgccacgtctcactgatgaccaatgccaccatttattgaaggctttctgtgggccagaccgtttatatgcttgaggtcattgcatccttacaaccctatgagggaggattatcatttccattttatagaggaaaaactcaaggctttaaaagatatggcttattcaagatcacactgctagtaagtgctagaggtggctttatattgtctgatcaaacagactagtactcttaatcattaatttttaaaaaactcatcccttcaagatttatatggtgcctaaggccttacctcaggggagcaaagtcccatgacaccatcagtagaaataatttcaattttcataaaagcagaacagactcctttctgctacagagagaacaagtgtatagctttggtgctatgtctatctcactttgaccaaatcttatgctcatcacaggaaaaggccccctgtatgttcccagaaaaagatacaatcacatacactggagacccacagctacaagcggagagaaatagtgacgccactgccacccacctgggatggttcgggcacagtttgtcattaaatgtgacaagcaaaaaagagataatgtgggagggtaatgtagtaattttatcacaaaggatgacaaggcccattctttccctgaaccaaagggggttctccttcatctttccatggataacgtcaggagcaacttgggcagcacgtgccggtcctgcgttttggccccagcatgccttcaggaactccatgctaggacagtggaggcttccagctcttccctactgtgtctcactgagtatccctgttccccaaggtctttgcccccttcaccacctcaaatggagaactgactaccaaacaaataaaacatttcaggccaggcacagtggctcacgcctgtaatcccagcactttgagaggccgagacgggcggatcatgaggtcaggagatcgagaccatcctggctaacacggtgaaaccccgtctctgctaaaaatacaaaaaaaaaaaaaaaattagctgggcatggtggcgggcgcctatagtcccagctacttgggaggctgaggcaggagaatggtgtgaacccgggagacggagctggcaataagccaagattgcaccactgcactctagcctgggtgacagagcgagactctgtctcaaaaaaataaataaaataaaataaaataaaataaaataaaacttttcagtcttttagcaagtgtttagggactattactaatagattgattcaatctattagtaaataaataaaacagaactaaaactgcccacgatgaaggttattaattgacaaaacctgatgaaggaatcaccttcttggcaaaatttatatctgcaacatatggctaagacaactgaacttggtaaaaatgatgaacataaaaggaaaggctatttatagtcataaaaatataacaccaaaacaaaaaaacttctcaaccagtcaaatctttgttataaaattttgataaaaagtaagggattaaaaaaaccttagtggccgggcgtggtggctcacgcctgtaatcccagcactttgggaggccgaggcgggcagatcatgaggtcaagagatcgagaccatcctggccgaaatggtgaaaccccgtctctactgaaaatacaaaaattagcccagcatggtggcacgcgcctgtagtcccagctacttgggaggctgaggcaggagaactgcatgaacccaggaggcggaggttgcagtgagctgagatcgtaccactgcactccagcctgggcgacagagcgagactctgtctcaagaaaaaaagaaaacaaaaaaccaaaccattaactcttaagactggcctggccaacatggcaaaaccccatctccactaaaaatacaaaaatcagccaggcgtggtggcgcatgcctgtaatcccagctactcgagaggctgaggcaggagaatcacttgaaccagggaggtggaggttgcagtgagtcaagatctcaccactgcactccggcctgggcgacacacagagactccttctcaaaataaataaataaataaataaataataaaataaaaacattaactctgtcagggaggatttttaaaaattctctaatgaattaatggatctaggcaacagttgtcaagacagtaacatcacaaaaataaagagagcctgtgcctcttgatggaagtattcaacaacagccatgatacagtcctgccctctacccaccccaccaccacaaaaaaatttcgaaaacctaatctgatcaagtctctaagccaactccctgttcacaagaacacacaggtagaaagacgaacacgtttaacgataccacagggacgcagtcctcaaaatccagactaggtagaacctacagagcaaacgacccattttctccaacaaatacaaagacggtggaaagcccaagacaatgaatcttaggagaaaacaaaagagatggcaggaccctctgataagatacttgaaagaagctttgctcattggcaatgtatgggccttatagtgatccagactcaaaacacaaaactattaaaaaaaattgtttgtctgaaaactccctcccccaaaaaatatatgaaaaaaatcagggaaattagaatgatagtatgagattcaagaattagtgtgagaatataccctttatgttttaatagataaatcaataaaactgtatgccaggttgctgtcttcatgtggccaaaggcagcctgtatttgagcaaaggcttctgggctgggagcccagagtctcgggctttaggtccagtgctgcgataattggttgtatgctccctggacctcagtttctctatttgtaaaaggaggatgagctagacaacacctgaaggcctaaaagacctaatcccagtttcacagtggcatctccttttatgtctcctccctgtttgggggtcagggcccacctggctatgacagcagtggtatacaggtcttgctgacttcgaatcataattctccactctctacctgtgaccttgaggctaccccttaactgtccagagcctcagttaactcacctcatagagctattgtgaaagttacaagagtcaatgattataaatcagctgtcctttaccaagtgcttcctctatgctaagcacttgacctgactcttcacaagcaccctgggaggggatattacaattaacaaccacacagcgaggaaacagattctgaggccaggtatacagcttagtgaagagctggagttgagcatgcaataaagccaggctgcagccctgttattagcatgtagggcacctgagaaatgaacaagcagaatgttcatgatgagctctaccacgatctgggggccctggaactcctcaatgaactgagagccctggacagtgtaactgggtgctcagaagcaagccctgggctccctctgctggggtcagatgggaacaggggcaatttcatccagagcacccctgggggtgtccaacaacactctcaggcacagcagccaaagctgctatggcctgaaggggatgtggactctaagggcagtctaaaacccaagagacaccagcatcatggagaactggcaggggtggaaagagccctgctctaccaggcaccagagctgtacctccctaagcctcagtggtctttctgcagctgacagtgggactaggtcagggcagtgctcttgtgaatggaagctatttcaccctcagccccgcatgacccttcttcccgcccatgtttgcagaagaagaatgccatgattgggccaggtatggtgactcatgcctggaattccagcactgtgagaggcagagacgggaggagtgcttgaggccaggagttcaagaccaccctgggcaacacagcaagaccccgtttctataaaataaaaatagaaagtcagccaggcatggtggcatgcacctgtagtcctagttactcaggaggctgaggtaggaggatcactacagcccagaagtttgaggccacagtgagctatgattatgccatggtcctccagtctgggcaacatagtgagactgtgtatcaacaaaaatagaaattaaaaaaagaacactgtagtcagggccttcctggggatgcgatgatggctgtcattactgtgcctctgctcactcttctcaaaactttcacagggacccaccacagtcctcccaccacccagataaggacatgggcttgggctgagctggggagcaaaaatcccagcaccttgggatagaaagagaaaagggaaagagtggcctgaatttggcaacctaataatgtctgccaaatctcattttatattcacacactttccactggtagcaaaaagctggtgctctgccccacctactcaatttgcaaatatgctgttgtcacttttatcatctgctgtgtagtaagaggacttcacaaattaaagtcagagagtgctttctaaataccagcgatgtgccaggacttctggtccatctggatacaagacaagtcaacacagccgtagccctctccagagccagagggaggaaccgagagcagccccacaatgaggctctcatcacctccccatcccgcacgtcattgcccagagcgcctgctcaataccctgcactgatgggggtgatcagctccatggcagttgtcactttggcttttactgtcatgatgttgaggttcatgaggtagtagaaagtcaggtgaagcacactgtcatctggaggggaggaagatgagagaatttatgagtcaaaacactcagagcagagtgaacagagtcatagggggtagtaaggtgggggggtcaagtgttgaaaaactaactactaggtattatgcccactacctaggtgacgggatcattcataccccaaacctcaggaccacgcaaaatagtgtaacaaatcggcacatgtatccccagaatcgaaaataaaagttgaaattataacaaaaaaagaaaaacagaattatagaaaaattcagagacttttacaatcatttactataaaaacaaaatcggccaggcgcggtggctcacacctgtaatcccagcactctgggaggccaaggtgggcagatcatgaagtcaggagatcgagaccatcctggctaacacagtgaaaccccgtctctactaaaaatacaaaaaatcagtcgggcgtggtggcgggcacctgtagtcccagctacttgggaggctgaggcaggagaatggtgtgaacccaggaggtggagcttgcagtgagcagagatcacgccactgcactccagcctgggcaacagagcgagactctgtctcaagaaaaaaaaaaatcacaacagtaatataatgaacaaaaagaagcaaggagagcatctacaaattctttgctacgcttcccaccaagaggtagggcttaatttctctgcccttgagagtgggctggacttagtgactctgcttctaacaaatacaagatggaaagggaaccaagcgatcaaggtcaatatcagcagaaataatacagtggcatcaggtactcctgatatgacatgatagcgacgacctcatctatgctattctctcccccaaatccataatctcagtctaatcaaggtcatgaaacacaaggaaagactgagacactcactgcctagagcagactaaggagcatggcaactaaatgcactttgagaccctggcttggatcttgggacagaaaaaggacattaattaaaaaaggaagaaactaaaaaaattctgtcattttgttaacagtattgggccaatgaaattaagagtggtgtggatcgctgttaatcataccatctttaattaagatgtaactttagggaagctgaatgaagagtatataggaactcatgttattttggcaagtcttctatgagcctaaaattatctcaaagccagccatggtggtgcacgcttccagtcctagctacttaggaggctgaggcaggaggatcgtttgagcccaggggttcaagaccagcctgggcaacatgacaaaaccccatctctacaaaaaatacaaaaattaactggcatgatggcacatgcctgtagcccccgctacttgggaggctgatgtgggaagatcgattgagcccaggaggttgaagttgcagtgagccgtgatcatgccactgtactccagcctggatgacgagagtgagaccctatctctaaaaacaaacaaacaaacaaacaaccagcaaaaagaaaaccagtgcgtagagcctatttccatttgtgtaaaaaataaagtgggaagcagataaatatacatttgtataaaagcttccaggtgcaaagaatctttctaaaaaatacataagaagtctgtaataatggttgcccttggaggtgagacctaggactggtatataggaacctgtggtgagagggaaacttaaattttactgttagctcttctactgctagaacattttattatatggtactttttcatacaaaccaacttcaaaacatatactctgcagaatacaaagttctacttacatttattaaacatgttggtcttactaaaaacctgtatacttttgcaacttgttctagatatttgacttgctagattcagaaagaggtatagttttctcaagcttctgccttatgtgactggagttttgttgctatgttgttacggttatgatttaacaaaaagaaacaaagtccatgcaaaacaataaggaaaaacaaagcaatatgaaatgggaatcctttgttgggcaaatgggtgtttggctcccggaccctctgcacctgcagctgggtgaactcttaggtgctacagatcccttaaacaaggtgagtgcaaccagacctttgcacttcaggtcgagcatgacagacagtgggtgcctcttcagcatctccttgcgtttgtcgtccaactgaacccccagtgtgggtctccggcgcttctggacaaaggaaagtgccaagctgatgagcatcagtcatagcaatctccccttccctctcccaaccagccaggcctcagccctactgcctggcacctgctgcttcagctagctgggttgtcagactcccctcccagcagcaccttctttcacacctcttctgcttctagggaggacggcacctgcgaacaagcatgccccagtgcatgcagctgcttgatgcccccacaagaggaaatggttctcaccgtagtctgctcctcctcggcatctgagtcactctcgtcatctgcagccacagagagaaggcagctagaggtgagggggctccaaatgctccctaaagcactccaacccacatggcataaaggggccctgactctgtcttttgtaaataagtttctctgtaataaataataaattaacttgctgcttcttattcagtatacaaaacatggtgatgaaaaaagaaaaaagaagaatgacgtataactcatttttttcaaagggctttttgatgtcatttagatggaacacaagcccctccttgtgatggtggtggtggctgtggtaataatagtaacacaaataataataatagtagtagaagcatgcataacttgagggggtactatgtgctgagaattatgctaaaggctgtatgtgcattaccttatttaatccacataacaatcctacatgaggtgttactatctgttttcacaaaggaataaactgaggctctgaaatattaaataccttcctcggggtcagtcagctagtgagtggcagggctgaaatccacgggccgcaccttgtgactccgggaagtgagctctctttcctgtctactccagggtgctaagacattcaagtcaagcttcctgctacacagaactagtccagctagttctccaaagaccaggactgcccttggatggtgacctggtgtccctgggggacgaatcccaaccaccacattaccttgggagtcctctggaggtttgaacagagccttggcttcatccacactgccttcgattgccacagataacgtcttatctggggggcaagaagaagtctgttaggaaagctgctgaggaaagctgctaagcagtgtgagtaggccagctctggggctgcatttctcccacctctgcccagctccttgctgactaagggtggaagggcaaaagtccttgctccagatgaagggaaacaaggtgggacacttaagcttttttttccgtcatttactgagaacagagaacttaagtacaaattcctaaaccagcatcacctgaaactagcagtgaatgcctctcttttttggtgcacaccaaagcacagaaattcaaactgagggcctaaagccacatggaactcctctgccagttgtcttagaggttctcacccagaaatccacacctgtccacatcccagaaacaatgactctcacctaagtgcttattctctattctacactataccaagcacatggctgccattgtctcacttaactgggaggcagtaggacagtgaataggaacttggatcttgcagtccagttccagacctgagtccctgcctaaccaattctcaaacacatgacctggaaagttatgtcactgtctgagcctcagtttctgtatctatgaaaaggggacttgaaaaatagtagctgccgggtgcagtggctcacacctgtaatctcagcactttgggaggccgaggcaggtggatcacctgaggtcaggagttcagagaccagcctggccaacatggcaaaatcccgtctgtactaaaaatacaaaaattagctgtgtgtggtggcatgtgcctgtaaccccatctacttgggaggctgagacaggagaattgcttgaatccaggaggtggaggttactgtgaaccaagatcatgctactgcactgcagcctgggcaacagagtgagactctgtctcaaaaaaaaaagaaaaaagaaaaacagtagctgccccattagtggtggggactgaatgagctgatgcttgtaattttaattataaaattattaaaaattaatttttaggctgggtgtggtggctcatgtctggttgggaggccaaggtgagtggatcacctgagatcaggagttcgagaccagcctggccaacatggtgaaactctgtctctactaaatatataaaaattagccaggcacggtggtgggtgcctgtaatcccagctacttgggaggctgaggcagggagaattgcttgaacctgggaagcagaggttgcagtgagccaagatcatgccactgcactccagcctgggcaacagagccagactccatctcaaaaaaaaaaattttttttaatactcacaacaaccctacaggagtaatacattatagccatttatagatgagaaacttaaggctcagagaagctagacatcacagctataaggctgataaaccaggattcaagaccaggtctgttcaacttaagcttggcctctccagcacatgagctaacagcctgttgcatacaccaggtatgacacctcattgagtgatgtcttgagaccccctctgagggtctagcgttgtgaggtcagacaggccaccaccgtccaactccattcttaagggtacatatggtcccaagagcctgaaacggtttgcctagccacactaaggagggatggcaaacttcccccaagtggctgaccactgccttatctatggcaaccctatgtgaatcaccacccttcaccccaagcaactagttgctcccatcaagcactggcaaacaacagactatttttttcagccatttaatattagcattctacaagaacatcagaatggaacaggccgattttaaacataaaagaaaagaaaattactcaccctgtctagggggctgggaggatttcatatgagctgatgatggaaacaggagggagaacaaaggggaggggaggaccagaaggacgaggaagacacaagaagagacagtaatgtgttggtgcccaaggtgggaggagaagcaagcactggtgcggtgtatgtctgtctgatgaggtggggtggggtgggggagaaaatgtaggtgctgggtgaaagctgcattagggcaaaaggcagagtctccaaaattttctcaaaaccctagcagagtcacaggctgccctcaagcttaatgaggacatatcatctaacctggaaattcacaacaaagacatgcagcctgattcaaggcatggtgaaagcctgggagagctggctgagacctgtattcaccaggcacccccaccctgaagcagagcaagaggcactgatctaactgccaagcgtgccttgatggggtgagcacctgggagcccagacaggctgcctgggttctgcacccaagagctgtccagccaggctcacgaatgactcaaagccacccattgtgaaatacccatcaggttaatccagccttaggccagctggtcagagcagccatgctgggcaatgcagagggaagaaagcttctgtcacctgagggcttcgggcaggactgagaaatttcctgagcaggtactgcttccaactgattcactcggccacagctgctgctcccatagccccttgtcctcacccaggccccatactcaccacaggcctgcccatacgcagtggcctgaacaaagaggacatagaggggaggcggcaggtgtctggctgtctcatactgcttgtgagcctggtcgaatggcataaacaggtactcctgcaccggaagggaagcctgcacacaagagacagatttttgttcttccttttttagccagtccacacaggaaaaagtggctacttagtgaccgtaaatcattatttataaaagtgatacatgataaactaatagaactaataggtggataaaagctcaacgtaaacaaaattatatttctttatactagcaacaaacagtaaggaaataaaattgttttattttacctactgtcagggcaccctggctcatgcccatagtcccagcactttgggaggctgaggcaggaggatcacttgaggccaggagttcaagagcagcctgggtaacttagcgagatgccatttccacaaaaaataaaaatcaatttaaaaaaagaaattataaaaagatgccatttcaataccatcaataaaacatcaaataagaataaacaggccgggcatagtggctcacgcctgtaatctcagcactttgggaggctgaggcagatggatcacctgaggtcgggagatcaagaccagcctgacggacacagagaaccccgtctctactaaaaaaaatacaaaattagctgggcgtggtggcatatgcctgtaatcccagctactcgggaggctgaggcaggagcatcacttgaatccaggaagtggaggttgcggtgagccgagatcatgccattgcactccagcctgggcaacaagagcaaaactctgtctcaaaaaacaaacaaaaaataataaacaagcaggctgggtgcagtggctcatgcctgtaatcccagcactttgggaggccgaggcaggtggatcacctgaggtcaggagtttgagaccagcctggccaacatggtgaaacccaatctctgctataaatacaaaaattggccaagtgtgggggcacgcacctgtaatcccagctactccagaggctgaggcagaagaattacttgaacctgggagacggaggttgcagtgagccaagattgtaccactgcactccagcctgggcaagagagcaagaccctgcctcaaaataaaacaaaataaaataaacaaatgaaaggcatataagcctctacacaaaaacctgagaaatgaaaagtctaaaataagtggatacatgtgaatgtcaatggcctggaagactcaaatattgtccaggtaacaatttattctaaagtggtctgcagattcaatgcaatccctgtcaaaatcccagcaggtgaaaacagacaacctgattctgaaacttgtatgtaaatgcaaagggccaagaataaccaagacaatcctgaagaaataggttggaactgtgcatcgagacttctgataaagccacagtaaataagacagtgtgatactgtgcaaggatggacacagagattatacacatatccacatgtacaaagacatttgatttgtaacaaaagtggcactacagagcagtggaaagagaatgtcttcaataaatggtcagctaaatacctatgtggaaagaaaaaatgaatctttacccttaactaacaaaatcacttccaggatgacaacagatttaaatagaaagatttcttaaacaagacacaaaaaaagtactaaccataaaggaaaagaataattagtaaaattaggaacatgcactcattaaaagataccattagcaaagtgaaaaggcaggaggttacagaatggggaagacctgggaaaaaactcatctccaggcaacccaacagaaaacaggcaaaagacttgcctagacccatcacaagaggttatccaaaaggcaaaatgtgctgtgttcaacatcactagtcctcagggaaataaaaattaaaactataatgagataccctccagagtagccaaaattaaggagactgacagtataaagtgttgacaaggatgtaaaacaattagaacttgcatatggtgctggtgggaatttctgtaaatcggtacaaccagtttagaaaactgtttcagtgtctacaaaagctaaatatatgtataacatactgtatgacctagaatttcattcctgggtatatattcaacagacagatgtacacatgtatgccaaaacacatgtataagaatgctcatagcagcattattgaaatggccctaaaccggaaacaaccaattactaaacatcaatgaaaacaaactcttgtactcacaatagcacagatgaatcttagaaacatactgctgaacaaaagaagccagacataggagtatatactatgattctctttgtatagagttcaaaaataggcaaaactaacctatgatgttaagatgtcaagattatggttactggggtgtgagggaagatagggactgcgagggggaataaaggagcttccaggaaattgttaatgttctttctctgggattttgggtgctggttatacagatgtgtttgcttagtgaatattcattgagccatacacttgcgagttacatgcttttctgtataaaaaactctgttttaaagtaatatatggtacactgtttttaaaagttgtattcaagaccttaggcaatgaattcaggttttgtttcagagattttatttgtgtgcttttcttctgtttttttttttcttttttttcttgactcgggaaagactgaactagatcgccttgagtttcaagtttgcagattctgcacagtgcatgaggaccaattgtacaatatataaagtaaaataaaaagcattttaggctgggtgtggtggctcacgcctgtaatcccagcactttgggaggccgaggcgggcagatcacaaggtcaggagatcgagaccatcctggctaacatggtgaaaccccgtctctactaaaaatacaaaacaaaaaattagctgggcatggtggcaggcgcttgtagttctagctactcaggaggctgaggcaggagaatggcgtgaacccaggaggcagagcttgcagtgagccaagattgcgccactgcactccagcctgggtgatagagcgagactctgtctcaaaaaaaaaaaaaaaaaaaagcattttaggccgggtgtgggggctcatgcctataatcccagtactttgccgaggcaggcagatcacctgaggttaggagttcaagactagcctggccaacatgatgaaaccccatctctactaaaaatacaaaaattagccaggtgtggtggtgggtgcctgtaaacccagctactcaggaggcagagcaggagaatcacttgaacctgggaggcagaggttgcagtgagccgagatggcgccactccactccagcctgtgcgacagagcaactctgtctccaaaaaaaaaaaaaaaaaaagcattttaaagtcatggggggcggtggcaaaggtgggtaaggaaaaggaaaaaaaaaaaaagtggtattcaagtttgtaaaacaaaagctcccagttcccagtcctcaaagtagctgctaatggtctgctatgaatatagacttttccaagcatataccgcatatacccaactcctacttgtatatatccctacagatactttgtaaaccaaggtatagaaatgagtccatactatatgttctacaacttgcatttcttatttaatatgacagatcttctttcatatttcagttattctgtcagtggttcaaatatcagtggtttgattccatactttcatcacagctctaaggctgtaccatacaagaatttatttaacctgtaccctatttaaggacatttagaaaatttccaggtaacaagagaaaatttaaccatgcagaggctttggttaagtacaaccaaaacttttaatttctgctctatcacccaggctggagcgatcctcctgcctcagccttccaagtagctgggacgacaggcacaggccaccatgcccagttaatttttttttgtagaggcggggtctcccgatattgcccaggctggtctcaaactcctgggctcaagtgatcctcccccctcagccacccgaagtgctaggattacaggcatgaggcaccacaagcagtcaacaactctccttctacgcttacagttgaagaaaggaaatatagatcttgccaaatcctaagaagaaaagcaaatttatctctaggatccttttacaaagttctttcatattagccatcttgcttcataaaattataaggatttagaccaaatctggcttcgcaaagcaaataaaaagtggatcacctatacagaaagacattatgttttacaggcgaagtgttgactcttcctcatgagtaaagtttttttcagagtgagaagatctgctgagcagtctgaccctgaagcatggtcgggggatcaaacagacatccacaggaagcaagtttagatgcctggagattgtgaggccggtgggggccatgcagggggtaaactaaatttacacagtctgagaaagtacgttacccagagaaggcctctggatgaaaacacccaggtcaatgtgtgtatatattcctgaggccagcacttcttcctcccagacacaagcttatcacaccaactgggtagggatgcagacaaggccatccttatactatactctaatttagggtaatagacctggcaaagcccaaagggtgacatgacttctggcagcgcctggtcagtggtgaaggcaaagcaaaaggccagagggccccacctgcatgatgctgttgaggcggggctggaggctgctcaggtactccttcttcacctcaatctccttgagaatcttctccttgttagataggcactctcggtacttctctgccagcctgttgggggaggaaagagcattgtcacctgatatcccccagtgatacctcaacatgcctgttcactgtcagactccacctaatagtagcagccatgattaactgccaatgtttatccagcactcaatgtgtgccaggtactttggtgagctctttaaaagcataattacatttaatacttataaagaccctggaagacagggactttgcttatccccaaaggaggaaaccaaggctcaggcaagtagataacttgcccaagggcatccagctaagaacaaacactgcgctaggctttggatccatgtctcttgctctccagaggctctgtctgctctgtaaccactagggaatacacatgccatcttctgctccatttcttgcttgagaggtaagacctaaaactttcacaaacatggacttagcagctatataacccaaaagaggcccatggactggcctggttagcacagggtgggaacagattctggaccagtgccacaagaatgcagcactgatggctgagtcagtgcccagcacaatcagtggactggacagcggagtgacaggtcagccccatctgctaagacactgacacaaatttcctaagaaccagactcggccgggaatggtggctcatgcctgtaattccagcactttgggaggcccaggcaggcggatcacctgaggtcaagagttcgagaccagcctggccaacatggtgaaacccgtctctactaaaatacaaaaattagctgggcacagtgacatgcgcctgtaatcccagctactcaggaggctgagacaggagaatcgcttaaactggggaggcggaggtgaaacccccaactctattaaaaatacaaaaattggccgggcacagtggctcacgcctgtaatcccaacactttgggaagccgaggcaggtgaatcacgaggtcaagaggtagagaccatcctggccaacatggtgaaaccccgcttctactaaaaatacaaaaattagctgggcgtggtggcacacgccttgtagtcccagcttctcaggaggctgaggcaggagaattggttgaaccagggaggtggaggttgcagcaagccgagatcacaccattgcattccagcctgggcgacaagagtgaaactctgtgtcaaaaaaataaataaataaatagataaataaataaataaacctctttattcatatagaaaagtttatacctaaagtgtgacttgaagcattatttatttatttattttttgagacggagtctcattctgtcgcccaggctagagtgcagtggcgcaatctcggctcactgcaacctctgcctcccggcttcacgccattctcctgcctcagcctcctgagtagctgggactacaggcacccgccaccatgcccggctaattttttatatttttagtagagacggggtttcaccatgttagccaggatggtctcgatctcctgaccttgtgatccgcctgccttggcctcccaaagtgctgggattacagacgtgagccacctcgcctggctgaagcattatttatgacagcaaaaaatggaaacaacctaaaatccaacaggggaataattttgtgcatttttctatacaccagaatatacactagaatgttgcacaacctcctgaaatagtgtttacaaagctttctgccataggcatacacttacagataaggggaaaggcaaatacaaaattagatttatggtacaaaagataaggtcttcggcattaaaatttcaaggagagaccaggcatggtaactcacacctgtaatcccagcactttgggaggccaaggtgggaggatcacttgaagccaggaattcaagaccagcctgggtaacagagtgagaaccctgctctacaaaaataaaaatattagccaggcatggtggcaggcacccatagtcctggctacttgggaggctgaggcagaaggatcgcttgagcccaggaggtcaaggctgaagtgagtcgtgatagtgccacagcactccatcctgagcaatagagtgaaacgccatctctttggaaaaaaaaaaaaaaaaaaaaaaaaaagggccaggcacagtggctcacgtctgtaatcccagcactttgggaagccaaggcaggcagatcacttgaggtcaggagtttgagatcagcctagccaacatggtgaaaccccatctctacaaaaaatacaaataatagatgggcgtggtggtgcacacctaccacccagctactcgggaggctgaggactgagaatcacttgaacctgggaggcagaggttgcagtgaactgagatcacaccaccgcactccagcctgggagacagagtgagactccatctcaaaaaaaaaaaaaaaaaaaaaacccttaagcaattataaccccaaccccatccatgatgaggttggtgaagtttaaactatccagtgtgatttaatcataaaatgggatttggtcttagaaactattctgagagttgcacagtgttttgctgccttatcctgggtcatgacaaagcactgacactttgtggttaaaaggtcaggaaggaggaaatgctaccttttccgctgctccagctcccagtccagacgtgccagtgtttgctggtgagggtctcccatggtgacttcggccttgctgatatctggtggagcctccttataaaactcctctaaactgaccagatcaatttcttcatgctttgacctacagacaaaaacatgacatcaagctgctgttctcaggaaactaaactgtagtttaagcaggcccaaagttatccccaacatatgcctgcttagtcctggtctacaggatcctggaatccagtcttctccacaaatgctcattagcagatatttcagtgtgaagaaaggtagttggtgacatgccataggatccttatccatgctgtccaacctttttacccatgaattaaagactcggaagggattcttatcaaatttacaaatgtctccaagctgagcaggagaactactagctaaaaagtcaagtaaaaacactacagcctgggcctaggctgtagggttgaaagcaagacataatttaacaggaataaatacaagggtctgcacttaagttcaagacattagccgcgtaagaacagaatgaggaagatccagcatgggagaactggatggaaaaagatctagaggcttaaaccgttgcatgcatagtgatttatatgtataaaagaaaagaaattctgccaggcgcggtggctcacccctgtaatcccagcaccttgggaggccaaggcaggtggattacctgaggtcaggagttcgagaccagcctgatcaacaaggtgaaaccccgtctctactaaaaattagctgggcgtggtgacgcatgcctgtaatcccagctacttaggaggctgaggcaggagaatcgctcgaacccaggaggcagaggttgcggtgagccaggattgcgccattgcactccagcctgggagacagagcgagactccatctcaaaaaaatccaaccctctttgctgtattaacatagttgactgctcaggttatggtcagatgacagtaatgataacggcagctatcatatattaataagcacccactatatgtcatcctcacctcatttaagcctcacaacaactctaagaggtggggagttttaatctccattttttgactgagatggaggcttctatcagtaagcagcttgcccaaggtccacagctagggagtggccaagctgggatttgaacccaggctgtgtaacttcaaggcctatgctccttccatgtggccgtctgcctcccaacaggcgcaagttccactgtattctgggtttgtcagtttccatttgggtgatgattacagaccagtgcatcacattattttgtttttgatacctttttaatttggaaatagtttaagactccaagaagtttcaaaaataatacttagaatgtatttcctccatgtacccttcacccaatgatactatcttatctaaccacattatacattgtcaaaaccaggaactgacactggtacaatattattaactcaagtacagacctgatgcagatttcacctctattcatatttaactattgttatgtgacgattttgtggaacagataaagatgcctctcaaaaatcagcatcagggctgggcacagtggctcatgcctgtaattctagcactttgggaggtcgaaatgggtgcatcatctgaagtcaggagtttgagaccagcctggccaacatggtgaaaccctgtctttactaaaaatacgaaaattagctgggtgtggtggctcatgcatgcaatcgcttgaacccaggaggcagaggttgcaatgagccaagatcacgccaccacactccagcctgggcaacagagcgagactttatctttaaaaaaaaaagaaaagaaaagaaaagaaaaaaatcagcatcaggccaggcttggtggcttacacctttaatcttacccttttgggaggccaaggcaggtggatcatttgcaaccaggagtttgagactagcccagcatggcaaaaccctatcactactaaaaatacaaaaaattagccaggcatggtggtgcatgccaatagtcccagctactcaggaggctgaaatgggaggatcatctgagccaagtcaagtcaaggctgcagtgagccaggattgtgccaccacaccagcctgggtgacaggagtgagaccctgtctcaaaaaaaaaaaaaaaaaaagacaaaaaacaaaacaatcaatcagtatcatgattattaaaaatattccggacccaccgggtgtggtggctcacgcctgtaatcccagcactttgggaggctgaggcaggcggatcataagatcaggagatcgagaccatcctggctaacacggtgaaaccctgtctctactaaaaacacgaaatattagccgggcgtggtggcaagcgcctgtagtcccagctactcgggaggctgaggcaggagaatggcgtgaacccgggaggcggagcttgcagtgagccgagatcacgccactgcactccagcctgggcgacagagcaagactccatctccaaaaaaaaaaaaaaaaaaaaaaaaaaaaaaaaatatatatatatatatatatatatatatatcctggacccaatgtctaatagggcccctgcatatgtcaagtttgttacagataaaagctgctttcagtttgcataaacaggtctgatcaagtgagaacacttccccttctcttcccgtttactccttcctccttctcatctctcagcttggttttgaggaaggacactgacaaactgtagtttcttcacctgaaggcagctaagcagcaagaaattcaggttccaaagaataaaatccatttgcagaaatgaactgctgggactacagaaaggaaaactgggccaaaaggttaaaagaatgtgactggaagtgagttgctcccatacaacatgcccagaaatcaaactggtaatgtaaagacccctgatagggagagagacctgctttttaccaagtgcagagctcaaaactcaaaaaggtcagagagacttctgaggttctttatgcagcctgaaatcacggcttgcaattctcccacattcacccttgcaatttgcccttctcccagatcctacagttttctaagctcatcagatttctttttaaagagagacttaggctgggagcggtggctcacgcctgtaatcccagcactttgggaggccgaggcgggaggaccacctgaggtcaggagttcgagaacagcctggccaacatggcaaaaccccgtctctactaaaaatacaaaaattagctggatgtggaggtgggcgcctgcaatcccagctactcagaaggctgaggcaggagaattgcttgaacccgggaggtggaggttgcagtgagctgagattgcgccactgcactccagcctgggtgacagggcaagactccgtctcaaaaaaaaaaaagaaacagacttacagtgagctacatgggaaaaagcagttaccgaaagaccacatgtgccaaagccctgtcctcccaaactcacttaaactccaaacatttggtgatctccttctgtaggtgcatcacctcatacaacaggttctggagctgcagatgataggcatctactttctgcttagcctgaaaggaaaatacgatcagaagtgagcagggcaagtcaggatggagcagaggagagggtcagcaaactaagagaaggtgtaaagggaataaagaaggggatggggctgggtgcagtggctcacgcctgtaatcccagcactttgggaggccgaggcgagtggatcacctgagctcaggagttcaagacaagcctggccaacaaggtgaaaccccatctctactaaaaaatacaaaaattagccaggcatggtggtgggaggtgcctgtaatcccagctacttaggaggctgaggcaggagaatcgcttgaagctgggaggcagaggatgtggtgagctgagatcgtgccactgcactctagcctgggggacagaacgagactctgtctcaaaaaaaaaaaaaaaaaaaaaaaaagaaggggatggggaggaggaaggaggaaggttaaaattaaaccttttaactactacctcgtgggtctgatctcttcctttcttcaacctgatgtgggctaatcggttaagcttctttagagtcatgaaatgcacacagctctggatcctccgttcttctatttctattgcctgtgggcaaagaaaacagtaaagcccactgacgacagggctagctcagcttccttcagtccttcaccactgacccatcctcatctggggccaaaaacggcaccggagggagctcagaaccatgagaagggtcatgaagaaaataagaggatgattgtataaggaaaatgattaagaatctcgggcaaaaaaaagtaatttctgcttggactagagtaacaggaattgaagatggaataagggcagcaaaggcacaatctatctctacagatcctacacagagatcccagcaatagtaacatcttgtcataaaatttgacctctataaataacattacaggataacttaaatggaaaataacagaattatagccataaagcttggctagaatagattgaatgcaataattctaacaaaacttgtcagcataagcacaaatacgtgagattcctgggggaaaaaatggattttaaaaaacttatctatcgagtttttagtcacattgtttaatttctctgcccctaaaacctcatttattcatttactattaatgataatttcatttttggtatctacaatttacttgtacacatccatctttgtatcaagcaaatgtataagtaccatcatttctcaacacctagcaaaatgcctggcacttaataaatattaattggatgaatgatcaaattagtagggaaaaaattaattatcctgtactttcattcctgtaattggtgactgaatggtgataagaagttccaataaattcacaggttttgggagccctcaggctccaatcacctgatcatggctaggacagaagatcaagatcaggaagggccctggtaggtgcaaaaacagcctcatctatgtaaacccaccaggttcacggccacctggtcccactccttaccacatccttgccacccctgctcttcaggtcttggatctcagccatcagcctctgtagctcctggcaggtgtacttgtataactcatagtctctgccagggtcccgcagatccacctcggcctcctcactgtagtatttaccttcctgtagaggtaaggataaaggctctgtgtgcatggggtaaaagtctccctgctgggatcagggacacttggctgacatctccttttagataaaaacagtaacaatgaagcctcagtcaggtctctaaaagatctggtccttaaattaaatgcttttcttctcttcaaaatagaaacctcttttgctttctgattgcagagtaatgcatgcctggtatcaaagattcagaatatacagaggagtatcaaaaagaaaatggaaaaattgcctataatttcgcctctcagtccgaaactgagtgaagattgtggataaataaacattttatttgtaaacaaaacgggatcatactgtccgtgctgttaagtgcaacttcccatctgcattagtccattttcacgctgccaataaagacacacctgaaactgggaacaaaaagaggtttaattggacttacagtcccacatagctggggaggcctcagaatcatggcgagaggtgaaaggcacttcttatgtggcggcggcaagagaaaaatgaggaggaagcaaaagcagaaaccccttataaacccatcagatgtcgtgagacttattcactatcatgagaatagcacgggaaagactggcccccatgatgcaattacctccctctgggtccctcccacaacatgtggcaattctgggaaatacaattcaagttgagatttaaatcccaaaccatatcattccgcccctggcccctccgaatctcatgtcctcacatttcaaaaccaatcatgccttcccaacagtcgcccaaagtcttaactcatttcagcattaacccaaaagtccatagtccaaaatctcatctgagacaaggcaagccccttccgcctatgagcctgtaaaatcaaaagcaagctagttacttcgtagatacagtgggggtaaatatagccattccaaatgggagaaattggccaaaacaaaggcgttacagggcccatgcaagaccaaaatccagtagggcagtgaaattttaaagctccaaaattatctcctttgactccaggtctcacatccaggtcaagctgatgcaaaaggtggcttcccatggtcttgggcagctccacccctgtggctttgcagggtacagtctccctccctcctggctgctttcatgggctggcattgagtgtctgcagctttttcaggtgcatggtgcaagccgttcgtggatctaccattctagggtctgaagggacggtggccctcttctcacagctctactaggcagtgcctcagtagggactgtgtgggggctctgaccccacatttcccttccacactgccctagcaggggttctccatgagcgcgccagcagcaaacttttgcctgggcatccaggtgtttccgtacatcttctgaaatccaggcggaggttcccaaacctcaattcttgacttctgtgcacccacaggcttaacaccacttggaagctgccaaagcttggggcttccaccctctgagccacaggccaagctctagattggcccctttcagccatgcctggactggctgggacacagggcaccaagtccctaggctgcatatagcacagggaccctgggcctggcccagaaaaccactttttcctcctgggcctctgggcctgtgagggaaggggctgccgtgaggtctctgacatggcctggagacgctttccccatggtgttaatcccccacggggattaacattaggctccttgctacttatgcaaatttctgcaaccaacttgaatttctccgcaaaaaatgggtttttctttcctttttttattttttatttttattttttgagacagagtctcggtcttgtcgcccaggctggagtgcagtggcatgatctcagttcactgcaacctctgcctcccaggttcaggcaattctcctgcctcaggcttggagattacagtgggtagctgggattacaggcacctgccaccaggcccggctaatttctgtatttttagtagagatggggtttcaccatgttgcccaggctggtctcgaacttctgacctcaagtgatccacccagctcggcctcccaaagtgctgggattacaagcgtgagccaccgtgcccagccgggtttttcttttctactgtgtcatcaggctacaaattttccaaacttttatgctctgttttccttttaaaatggaatgcttttaacagtacccaagtcacttcttttttttttttttgagacaaggtcttgctcttgttgctcaggctggagtgcaatggcgcaatctcagctcactgcaacttctgcctcccgggttcaagcgattctcctgcctcagcctcccaagtagctgggattacaggggcccaccaccatgtctggctaatttttattgtatttttagtagagatagggttttgccatgttggccaggctggtctcaaactcctgacctcaagtggttcacctgcctcggcctcccaaagtgctaggattataggcgtgagccactgcacatggccctgtcaccttttgaatggtttgctacttagaaatttcctccaccagataccctaaatcctctctctcaagttcaaagttccacaaatctctaaggcaggggcaaatgttttcagtctctttgctaaaacacaagagtcacctttgctgcagtttccaataagttcctcatctccatctgagaccacctcaggctggaccttattgttcatatcattatcaacttttttttttttctttgagatggagtctcactctgtcacccaggctggagtgcagtggcatgatcttggctcactgcaacctctgcctcctgggttcaagcaattctctgcctcagcctcccgagtagctgggattacaggctaccgccaccacgcctggctaatttgttcgtatgtttagtagagacagggtttcaccatcttagccaggctggtctttaactcctgacctcgtgatccacctgcctcagactcccaaagtgctgggattacaggcgtgagccaccatgtccggcccattatcagcatttttgtcaaagccattcaacaagtctctaggaggttccaaactttcccacattttcctgtcttcttccaagccctccaaactgttccaacctctgcctgttacccagtgccaaagtcgcttccacattttcaggtatcttttcagcaaacccccactctactggtatgaatttactggattagtttattttcacgctgctgataaagacatacctgaaattgggaacaaaaagaggtttaattggacttaacagttccacatggctggtgaggcctcaggaacatggcaggaggtgaaaggcactttttacatggcggcagcaaaagaaaaatgaggaggaagcaaaagcagaaacccctgatgagcgcatcagatctcatgaggcttattcactataataagaacagcatgggaaagaccggcccccatgattcaattacctcctcgtaggtccctcccacaacacatggcaattctgggagatacaattcaagttgagatttgggtggggacacggccaaaccatatgaccatcccagtaaatacagatctcaatcaaaatggctgcatgacagtctcctatagagaggaattccagctgggtgcggggtggctcacacctataatcccaataccttgggaggccaaggcaggtagatcacttaagctcaggagtttgagaccaacctgggtaacgtggcaaaacctcatatctacaaaaaatacaaaattagctgggcatggtggcgtgcagctgtggtcccagctacttgggagactgaggtgggaggatcgcttgagcccaggaaatgcagtctgcagtgagcagaaatcgtgccactgtactccgacgtgagcgacacagtgagaccctgtctcaaaaaaaattttttttaaatagctaagtcacaaatgaagttgacagattcaaggacagagaaacagacaaaaagaagaaaagaacctgacgaccacatgagctctcaggccacaaaagaggttctgtgggcacatggttctggtattgtctcagcagcacaccgagggattcctgaagctccagtgccatgctgcagatggactaccttcttctgaccatcaggaaaactggagacacatatcatactggaatacattctctgggtaggtataatcatgtctaatacaggcttgttggttttggagatgctgcagctaaaccagatgtggacactcagctttagtgaagaaacaggaatcccagtcacctggtcaagtggaagccaccaaaaagttgtacctggtagatgcgaccccgagctgctgcaaacacacagccaggtgcttggccatgagatgtaatttctcagcagcatggcaaccctgactgatctcacctgctcggtgtcagatcgattccgctttccttcagctggggctccatcgcttcggatcactttgggcttccgttttttgctcgattctgatgacatggttgttcctcctgttaagaggagaaagtttttgagattcttctggagtcataacactgaagtcaaactagcagttctggccacttacagacttggtaactcaaggaaagtcatttaacccctcaaagcctcaatttaaccctctgtaatacaacagggaagcatctctcagcctgtccaaaacaaactccaccttctcttttaaaaaggcatcaccacccactcccactgacctcggaatcatctacttcaacctctccctgccctgcctccacccacatcctgctccacactctccatagaggagacctgcattcaagtgttcacccagctatccaggcaccatgtgtgtctccatctcaacaccctaggccaggccctccacattcctctccaggactactctaacagtcttgcccaacaatactgtctaaattctctttcttaaaaaagaccgacctaattaatgcctctcctgtttcaaaacctttgctggctcttcataatgcactgaatatccatattccctgacttgtcataaagacccttgatggtttgtccccaacctaccttcccaacttcatttcttgcattcctattcctaccgaccttcccactgtccccaacctctgctcctagctgcaactgcaccctgcaatcccagttccccaaacactccatgtcttttcccctgcttgcaaagatcttccttttcctccctatatccttcaagactaagcaatgctcatctgctctaggaagcctgtcaggtctccccaaagccctcttttggctactttgggtacactattagggaatttatctctatgaatcatttacctgtcttcccacctagattgtgagctctaccctcttccccctgagcctggcagagtgctccataaattagtatccaaactcctcggtctggcatttaaagacactcccaatactactgtgatcactgtgtgctgggccttgatctaactactttatgggtatgttctcatttgctccttataacaaacttttcagctaagaactaccaccatttcacagatgacaaaactgaggctcgcaaggggaattacttgcaagtaattgcgagtcacatgactagtaggccaaaatccggatctatccaatcaatgccatactggtgctcttaactacacttttatgcctcctagtcctgccagcctctcatctagtgatgccattgactcccaggttgatcctagaatttaaagtatagaacctacatttcatggggctctacagtcacaaagcatcctcccttgttgcctcaccacagcctcctgaggtgggcagcactgtcccctttaccctaatccctcttgctctgtcacccaagctggagtgcagtggcacaatcatcactcactgaagcttccacatccccgacttgagggagccaatagtttgtcacggtaaaagtcagagagccctgaactggaatctccattctactctttcatggctatgagtccccggacgagtcacttcacttttctctgggtctgattcctcacaaatcaaatgagaataacagtccctaccacaggggttgttgtgggctttaacacaggaggcattccactggggaaggtgatgaagatgacctgggactgtggcttcagatgatgcataggtgatcttaaataatgctgaacacctaaggagaaagttaatcccttttcaattcttattttgaaacttctgattgcttcaaggagaacatctcagttccctagtttgtctttaacatctatgaatgccaatgttcctttgtaacaaaagaactctatcccacagccttaaacaacaaaatctagccagagtttgttaacaatgatctagttgcattatattaactatattaatttttaccttctacataaaacaagtgaaagcagctttccatttctggtggagagatttcaagttttctctcaaagtaaatttgagtttaaaaagtgacttggctgggcgcagtggctcaggcctgtaatcccagcactttgggaggctgaggcgggtggatcacctgaggtcaggagtttgagaccagcctggccaacatggtgaaaccccgtcagtaccacaaatacaaaaattagccgggagtggaggcgggcgcctgtaatctcagctactcaggaggctgaggtaggagaatcacttgaacccagggagcagaggttgcaatgagccgagatcgcagccacttcactccagcctgggcaacagagcgagattcagtctcaacaacaacaaaaaaagtgactgggcccaacaccatggctcacacctgtaatcccaacactttgggaaaccaaggcaagcagaggtgagagaatcgcttgagcccaggcgttcaagaccagagtgggcaacagagcgagaccccatctttagaaaacattttaaaattagcctagtatggcggtgcacacctgtggtcccaagctactctggaggctagggtgggaggatggcttgagcccagaagttccaggctgcagtgagctatgatcgcgccactgcactcagtcttgacaacagagatcccgttgcaaaaaaaaaatttggactggattaaaaatttttagtaaacccctccccctcccccctccccctctctccacggtctccctctgatgccgagccgaagctggactgtactgcggccatctcggctcactggaacctctctgcctgattctcctgcctcagcctgccgagtgcctgcaattgcaggcgcgcgccgccacgcctgactggttttcgtattttttggtggagacggggtttcgctgtgttggccaggctggtctccagctcctgaccgcgagtgatcggccagcctcggcctcccgaggtgccaggattgcagacggagtctcgttcactcagtgctcaatggtgcccaggctggagtgcagtggcgtgatctcggctcgctacaacctccacctcccagccgcctgccttggcctcccaaagtgccaagattgcagcctctgcccggccgccaccccgtctgggaagtgaggagcgtctctgcccggctgcccatcatctgggatgtgaggagcccctctgcccggctgcccagtctgggaagtgaggagcacctcttcccggaccccatcccgtctaggaagtgaggagtgtctctgcccggccgcccatcatctcagatgtggggagcacctctgccccgccgccccgtctgggatgtgaggagcacctctgcccggctgcgaccccgtctgggaggtgaggagcgtctctgcccggctgccccgtctgagaggtgaggagcccctccacccagcagccgccccgtccgggaggtggggggcagcccccgcccggccagccgccccgtccgggggggaggtgggggccagccccagcccggccagccgccccgtcgggtcgggggtaggggggcgcctccgcctggccgccaccccgtccgggaggtggggggcgcctctgcccggccgccccttctgggaggtgaggagcccctctgcctggccgccaccccgtctgggaggtgtacccaacagctcattgagaacgggccatgatgacgatggcggttttgtctagtagagaggggggaaatgtggggaaaagatagagaaatcggattgttgctgtgtctgtgtggagagaggtggacaagggagactccattttgttctgtactgagagaaattcttctgccttgggatgctgttggtctatagccttacccccaaccccgtgctctctgaaacatgtgctgtgtccactcagggttaaatggattaagggcggggcaagatgtgctttgttaaacagaagcttgaaggcagcatgctccttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatcccctctgcgagaaacacccaagaattatcaataaatactaaaacaaacaaacaaacaaatttttaataaacggtagtagaggtggtaagttgatctggcaaagcctacaaagaccggacctgaaaggcttaagtgtgggaaatcctgactttggcaacacagtagagtgcctggcacaccgaagagcacgatatatgtgagctgttaccatcaccaccacccccacccccatcaggctacattaccacaatcaagaggctccaacgtgaagcctgaggatgctgcagcgaacacttttcggatgaggtaacagcgcagcgccgagaggccggggaccgcgggtagtgagggaggagaagccgggtcagaccccagcccaggggcgccctttgggcgatcagcacctcagtcccggagcgcccagccccgccccatctcccagccccactgcccttgtcccctcctcacctcacagctccaagaacctggcaccgggagtaagccactgccggaggcggagcaaagcttgcccgcgcaccatagagaaccggaagtaaggaaggggcggccgaccggaagcgaggcgtagaggccggaagctcagcgcggaggcccccgagggaggtggtggcgtggtgagactgtaaaaacaaagacacatgcttctcgttcactgtgcccagggcctaagagagtgtccagcagctagtgggcgctccaccgagtagttgaattaatgttgtgttatgtccaagataacacgaaagaacctggtagcgcggcggggaagatttcggcgctagaggatttgcctgcataaccttacttcttaattattatttttaccataatatgccacgccagtgaaggcaacaagtcagggagggcattaacctcattttacacttggctttttgaggagtgcatcaccagtttctccattttaggcctgacttgcccaggacagagtcacaactctaacgcagtatttgaaagcttcaggtatttcctacccctggcatgaactgtacaaacaaggcccaggattttttcgtgtaaatcctcatctggagctagtaacacgtgtcctgaatccctggttgtacggggccagttccttctccttcccaggagcaaggaggaaaatactggctcttttttatttttatttttatttgagacagagttttgctctctcacccaggctgaagtgcagtggcgcaatccccgctcactgcaaactccgactccagggtttaaaggattctcctgcctcagcctcctaagtagctgggattacaggcatgcaccaccatgcccagctaatttttgtatttttagtagagacagggtttcaccatgttgcccaggctggtcttgaactcctgacctcactcaagtgatctgcccacctcggacttccaaaatgctgggattacaggcgtgagccactgcacccaaccagtactgactgttgagaatagctcaagaacacagtaccctccaggagggtagatctgccatgtgggactaagcccaccagctctactgtgccctgcctcaggcacctgctaaagttccttgcagatgaagaaaagacactgatttatagtaaatatttaattgtttccatcagcaattccagcacaagttttcctggatggtaggcagaatcaagctacccaagggttcatgatgaggtatgggggtcactgaggagacccccagagtcactgacccctcccgccacctccacacaccaggtggccctgcagaatgagggttgggctgatagaatgtcaattaggggagacaggatacagggtgagggaacagggtctagcttgtatatttgcctgcaggaaggagggagggcaggagagactctgcatagaaggactggaactacacatttaagttttcaaccccaatatgcagggggaaacagccaagccactctccatctgtctagtattaggaacctctcttcaagtggtcttttgtcatctctgttcttcttcccaattctgtattccagattccaaattctacaattgaaacccaagttctgaattctaagttctaccttccgagttcctgttacgtgtctgtctcctgcccctaaatctttcctggctcccatccctttccccagcccctctgggcagaatgtctgaacctcctcctgaccgtggtgacgaggtttgtttgtatttgtttttttgttttggcagttccaggcttttctccagcaggagggacttggctcagactgtccagcaagtgggtggcccagtggaaaccagggaattcctgagggcctggcctggcctcctctcttcccaccccacctctagccactggacatactaccttttgtgcaactaagctaaacagaggatttccaagggtgataactggggactggtggccttgagatgaggaattttagaagataaatgaaggcctaaaagatcactatctttcattcagggaaatcagaaactacttctagcagggggagggaggcaggcagggaaagtagaaagggcctgggcagagctgtaatcctcagaacttgtcagccttcagttcccccttgtctgaactgagcactgcccctcagagtcctcccagagccaagacaaaaccaagacagcaggaccaggagtgccactgtctgtcggggttgcctgagggagaaggggaaggaggtggaggtgtaggcagcatcactgcagaggcgagatcttcaaggggatcatgatcctagactccatgtgtcgcaccagggggactgcggagagagaaggcagaggtcacacagggggctcaagcaagccaacaacctcccctggccccacccacacatgctggcctttgagtgggcaggaggaggccccagatgctgcgacaggaatgtcccattgccctcgtggaagggcccatgaagagcaccagatccctcaaattatgggataagacaggactttggtggtgatgagaataacattttcttaaattttaatagttatctgttggccaggcatggtggcttgtgcctataatcccagcacttagagaggccaagacaggcggatcacctgaggtcaggagttcgagactagcctgaccaacatggagaaaccctctctctactaaaaatacaaaattagccgggcgtagtggcacatgcttgtaatcctagctactcgggaggctgaggcaggagaatcgcttgaacccgggagtcagaggttgctgtgagccgagatcaggccattgcactccagcctgggcaacaagagcaaaactccgtctcaaaaaaaaagaaaagaaaaacactgatttagaccaactgcctcgttttacagatagagagggtgcagcctagagaaggtcagctccaggtcatccaggaggttagactctttcctccagctcagagcttttcaaactttaatgtgcatacaaatcacttggcagttcttgttaatgtgcagattctgatttggtaggttgcaggaagcctgcgatttgttattcttgtttgtttctttgtttgagatggaatttcactcttgttgcccaggctggagtgcaatggcactatctcggctcactgcaacctctgccttccggtttcaagcgattctcctgcctcagcctcccgagtagctgggattacaggcatgtgccactatgcctggctaattttgtatttttagtagagacagggtttctccatgttggtcaggctggtcttgaactcctgacctcaggtgatctgcccacctcagcctcccaaagtgctgggatgacaggcgtgagccactgcgcccagccgagatttgtcattcttaacaagctcccaggggatgccaatactgtcagttgggaccacacttgattttttttgttttttgttttttttgagacagggtctcactctgtcttccaggctggagtgcagtggcaggttctcggctcaatgcaacctccgcctcctgggttcaagtgattcttgtgcctcagcctcccgagtagctgggattacaggcttgagttaccatgcctggctaattttttttatttttagtagagacgaggtttcaccatgttgccgagactggtctccaactcctggcctcaattgatccacatacctcaacttcatagtgctgggattacaggtgtaagccactgtgcttgtcttgttttttattatttttattttttatttttgagatagggtctcactgttgcccaggctggagtgcaatggcacaatcatggctccctgcagcctcaaactcctgggatcaagtgatcctcccacctcagccttccaagtagctgggactacagatgggaaacaccacgtcctgctaatttttaaaaaatgttttgtagagatggggtctccctatgttgcccaggctggtcttaaactactgacctcaagtgatcctcttgccttggcctcccaaagtactaggatttcagttgtgagccaccatacccagctgggaccacactgaatagcaaggctcctgctaactccttcagcagacacattctccctcataccacctggtaagtgatcactgtaaacttctcaatggcaaggacaggctcttgttcatttatgtgcccctcaaccacctacctaccacagttcccggcacacagtgagggcttaattaacacccactgactctaggtggtttcaggttcctagcaaagtggcaaacaccttgagcaaaaaacttgttcaaggctgggcacagtagctcatgcctatgatcccagcactttggaaggctgaggtgggaggactgcttgagcccaggagtttgagacctgcctgggtgacatagtaagactgcatctctacaaaaacaaaaaccttattcaaaaacatttcctgcatgcttcctttgtgacagacactggagaaagcacttttcataaatgagtttgtgggccagatgtggtggctcatgcctgtaatcacagcactttgggaggccgaggcaggcggatcacctgaggtcaggagttcgagaccagcttggccaacatgataaaaccccgtctctactaaaaatacaaaattagctggacatggtgacacacgcctgtaatcccagctactcgggaggctgaggcaggagaatggcttgaacctgggaggcggaggctacagtgagccaagatcatgccactgcactccaccctgggtgacagagtgagactgtgtctcaaaaataaataaaataaaataaaatataaaataataaaatagtttgtagaatcttccgttatagccctctgacagaagcactatcaccatcactatcttacagacgagggaacagcctcagcgaggtaaagaaccgtgcccaaggtcacaatgggcgtttgctaatccacatctcctaggcagaggcgtggccctggctatgttatcatcccctagagtactcacctaggcctgctggtatcctatggagtgtgccacttggatagaaacccattaactcattgtcttaaaagtgagttccccatcactggaggtaatcaagaaagactagatctccttgcagagaggattccatcctcagacagggttctcagcagaagacctccaaaggcttcactcacctgtatagtagacattttcatcccagcctctcttcctccaggcagcgtttcgagtctcctcccgagactgcaggtctttataggctgtgagaaaggcacaggctcattcctcaggcacagaggactggatcccttacccagcacagggccctcttcccactgtcccctaaaccctgcactgctgtctcctcctccctagatgcctccctcagactattagcaaacactgtctgctttaatcatccatccaatcagtacatatgttaatattgcctacatttatatttctagtcgcaaacactcccaagggctccagactcctatatccatctactgcctacttgacatctctactttggtgtgtcagcatttttagtgttaacacttccggctaggtgcggtggctcatgcctataatcccagcactttgggaggccgaggctggtggactgcttgaggccaggagttcgaggccagtctggccaacatagcgaaactctgtactaaaaatagaaaaattagttgggcatggtactgcatgcctgtaatcccagctactcaggagcgtgaggcacgagaatcacttgaacttgggaagcggaggttgcagtgagctgagatcacactactgcactccagcctaggtgacagagcaagactgtgtctcaaagaaaaaaaaaaaaagtaacaattccaagggccaaaattacgctcctgaccccactgacttgctccttccctagacctcccagactcaggagatgacacacagcagctcaagcacgagcctgggagctcttctggaatgcccttctccttctcttgccccacacagacaattcatccacaagtcctgttggttccacctctagactaacaaatcttctgtggacttctcagcatcccactgccccatcccctcctgcctgaactagagtaatggcttcctgaagccctgctttctctcttgctcgcctaccaagcactcttaacaaagcagacagcagccagagaaatcatactagaacaaaaatcaggtcgtgtcactgctatttgaaacaaatagtctctcattgcatttacaataaatcccaactcattccccctctcctgttccatctccccacattcttccctactcactccacactggcctccttgccacacctcaaaaccccgaaggcctttccccaccacagggcctttgcatgtgctgctctgtctacttggaatgcttttgcctagcaattcacagctggctccttctcatcctttagctctcagcttacattttacttcctcagagaggcattatttgtctacctagaccaatgtagatcccctatgtttttcaccatcatctctccctgccttttttttttttcttctttttttttgagacggagtctcgctctgttgccaggctggagtgcaatggcgtgatctcagctcactgcaacctccacctcccgggttcaactgattctcctgcctcatcctcccgagtatctgggactacaggcatgcgccaccacgcccagctaatttttgtatttttagtagagatggggtttcaccatattggccaggatggtctcgatctcttgaccttgtgatttgcccacctcggcctcccaaagtgtcgtgattatacacttgagccaccgctcccagactccttgcctattttctataaatattatttgtaatctgaaattgatctttttgtgactttacatctaagatagtgtctcctgctagaacattaagttctatgaggacactaatacaaccccattggctacagagagtgatgacagagaaagagaactaacaaaaggctcctggaaggtcctcaacctaccccagagatggtgcaccacgtagagctctcctatctgtgagaagaagccgcccactgcctcctggttctcctgccggtacttgatggcccgagccctggagaaggcacaataatatggggcagaagccagggctggtgcagagggtactgaggctgattccttggccacacttcacaggaggggcctaggtggaacccacggtcctccgggatgctgagagaaaggactgatggcggggtgttctaccaacggaggggtcacaaccttctaggagatcctcacctcctggctggatccttctcccagatccatgaggggcagaaggtaaagagttccctgtgatatggccctggaaaaggtggcccaccaggggccttggtggggcaggtgagcagggtacgcctcccccaaccccagtcttggtgctgccacttaccagttgttcccccactcgatcatggttcctggctgaaagagaaccaaagggatgatgggaatgagcccccacctcagattcatagcatcacagcttggcaaggaagggaaactgccctgtctccccacctcccaagctgcagcggccatttggcctcattcgcaggccctgacacacacctggtgtgcatgtttgcacacatgtgtatacaactctgctctgagcccatagggagggagaagccagaagccccagtctaggtgttggggcagctgcaaagcagcattgcagcagggaaattggggggcaggagggggtctgtcggagggaggcaccttgagcttgtatgtcctcagctcatagatgttgggacccattctgggctgtggctcattccagaagctgaactcgaggagcagctggtttctcctggacagcagcatctggctccgctcccttcggaactccaggtactcctgtgggcatggtggtaaaggcatggctaccaggaagtgcgctccatcctgacagtgtgcctcatggggtagcagagtagtccccagaacagggctgggctgcatcccacatccagagaggtgtgctgagtggacactaacataccttattgtttttgagcttgttcatgcagtccatgagggctgggtagccacctgagaatcgccacaggtgcactgttgggggtgagaggtataggtcagtgagctgctgggacccccagcagatgacctcctcaaggttggctaagtggtggggacgggggaggcggggtggcctggttccctgtagcagcaagactccctgagttccctctgccttggtggaagaccatgctggggaggggatgaccctagacacaagtctaggagacctggatttgagctccagctctgcccagcagccttggactgctctaggcctcaatgttctcatcttgaaaatgggaataatgttcccaccccaccttccttaaatagcaacaagaagatcagatgtgtcctgtaccctggaagcagtggcatgcataaggaagaccaccaggccttagaggggcagctgaacaaaagaacaggggagaactgatgggctgatatggaacattccaagacagtgaattgaaaaaaggaaccaaggaacagaagaggatgtgtggtatgctacctcatgtgttgaggtggcaaggacatccagagatgctaatttatgcatcacctcttaatggcgacttaagagattgacagtagaccaggcgcagtggctcacacctgtaatcccagcattttgcggggctgaggtgggtggagaccagcctgaccaacatggaaaaaccccatctctactaaaaatacaaaattagccaggtgtggtggcgcatgcctgtaatcccagctacttgggaggctgaggcaggagaatcacttgaacctgggaggcagaggtggcggtgagccaagattgtgccatcgcactccaacctgggcaacaagagcgaaactccgtctcaaaaaaaaagagattgacagtagatgcccctgggacacagaatggaggcctgtggggcctcgggcaggagggaagcttactttgcatggaaaactctttgtactgttagaatttataaaaatcctgggccgggcacggtggctcacgcctgtaatcccagcactttgggaggctgaggaaggtggatcacgaggtcaggagatcgagaccatcctggctaacacagtgaaaccccgtctctactaaaaatacaaaaaattagccaggcgtggtggcgggcacctatagtcccagctactcgggaggctgaagcaggagaatggcatgaacccaggaggcagagcttgcagtgagccgagatcatgccactgcactccagcctggacaacagagcgagactccatcttaaaaaaaaaaaaaaaaaattagttgggtgtggtggcacatgcctataatcccagttactcgggaggctgaggcaggagaatcgcttgaacccaggaggtagaggttgcagtgagtcaagattgtgccagtgtactccagcctgggtggcagggtgagactccgtctcaagtaaataaataatcaactttgggaggctgaggcaggtggatcatctgaagtcggaaatttgagaccagcctcaccaacttggcgaaaccccatctctactaaaacaaaaattagctgggcgtggtgatgcacatctgtaatcctagctactcaggaggctgaggcaagagaatcgcttcaacctgggatgcaaaggttgtggtgagctgagatcgcaccactgcactccagcctgggcaaaagagcaagactccgtctcaaaaaataaataaataaaaataaaaataaataaaaatcatattatctgcactgagttgaacaatgtcccctcaaaatttatgcccacccagaacctcagaatgtgaccttatttggaaataggtctctgtgggtataatcgacctaagatgagattatactaggtgagccctgagtccagtgactagtgtccttatcagaagtgggagatctggacacaggagaacactatgtgaagacagagacacacagagagaacagcatgtgacgagggaggcagagattagaatgacaagtctacaagccaaggaacactaagagtttccagcaatccccagaaactggaagaggcaaggaagggttctcccctaaggccttaggaggaaggacagccctgtcaacaccttgatttgtgacttccagcctccagaactgtgacaggataaacctctgttattttaagccacccagtttgcggtatgctggccaccccaggaaactaatctaattcctagtaacaaagaaacctaattaattgtggaggagaagaaaggaacagttttgccatcctgggagcatggctgggcccatcagcggaggaaggtccccaggggatcacacaggcaagctagagctaagggcagctggctgccagcagtctagaaactcagactctgtaacttcccatccccatccccagcctgaccttcacctgttttttgactccatctgtgccttgattttcccatctgcaaaatggcctgaccctatggtttaaaggtctttttcccaaaggaaatggcaaaagtactgtatggatagaaatctaccaaaaccaggaatgacctgtggaaaacggattaacggagaaaagttacaaggacagcatcattggcaagaggaaggaattttctttatttttctgtcacccaggctggagtgcggtggcgtgatctcagctcactgcaacatccacctcctggatttaagagactgtcctgcctatgcctcccaagtagctgggattacaggcgcatgccaccacgcccagctaatttttgtatttttagtagagacagggtttcaccttgttagccaggctggtcttgaactcctgacctcaggtgatgcacctgcctcagcctcccaaagtgctgggatacaggcatgagccaccgcgcccagccaagaagaaggaattgtctaacaactgtggtgctctccataggagatggatcaatggttcttacaagtttattaaaatgtagattcttgaaccctactcccagcgtacagctcaacatgattcagctgactatgtgagggactgaacttcaaggtacaaaaaatgtagggtatgctttaaaaagtcaggatcagccaggcgcagtggctcaggcctgtaatcccaacactctgggaggctgaggcaggagaggagcacttgagctcaggagtctgagatcagcctgggcaacatagcaagacctcatctctacaaaacaaacaaacaaacaaaacaaaacaactagcccaggcatggtggtgcatgtctgtggtcccagctactcgagaagttgaggtgagaggatcgcctgagcctaggagttcaaggttacagtgaactatgatcatgccactgcactccaaactgggtgacagagcgagaccctgtcccaaacagaaaaataaaaagaagaaaaaggccaggggcagtggctcacgcctttaatcccagcactttgggaggccgaggcaggtggatcaactgtggtcaggagttcgagaccagcctggccaagatggtgaaactccatctctactaaaaatacaaaaattagccaggcatggtggttcatacttgtagtcccagctactcgggagcctgaggcaagagaacttgcttgaatccgggaggcagaggttgcagtgagctgagatcacgccactgcactccagcctgggcaacagagtgagactcggtctcgaaaaagaaaaaaaagaaaaagtcaggatcccatccctcagagttcatttcacaactagcaaatgcttaagagaattcaaggaatactgctggagctgatcaagtcaagcttaaaatgggaaagctgtagtggctgaaactgaaggcaatttgcttttctcttattcccttagccacatatcagtgtctagccaggtatgatggcacacgcctgtagtcccagctactcaggaggattgcccgagcccagaaattcaactccagcctgggcaatatagtgagaccctgtttctaaatggaaataataaaaataaaacataaataatatgttaatgtctgttacggaaaccaaataattgattaaggagatacacctatctatctgcaggtcacagattattttcaaagacacgattatcagggctgtcaaaggatgaaatagattggcttacaagtgaactcttcatggctaggagtgttcaagggaagtttagaggaccatctgttatggctgtgctatgcagacactctaaaccagtactgtccaaaagtactttctgcatgagcctgtgtgtatatgagtgagcatttgaaatgtagctagtatgactaagaaactgaattttttctttttaaaatcttttcttcttttttttttaatatgtattttctttatagaagcaaagtctcactatgttgcccaggctggtttcaaactcctggcctcaagtgttcctcccacctcagcctcctaatctgctgggattataagcataagccaccatattcagtcctgaattttttcttttttagagacagggtcctcactgtgttgcccaggctggagtgcagtggctattcataggtgtgatggtattcaatcacggcctcgaactcctgggctcaagcagtcctcccaactcagcctcccaagtagctaggactacaggtgagcaccttggcacacagcttgaactttaaattttatgtaattttaactaatataaatttcaatagctacatgtgaggccagggcgcagtggctcacacctgtaatctcagtagtccaggaggccaaggctgacggattgcttgagtccaggagttcaagaccagcctgggcaacatagcgaaaccctgtctctactaaaaatataaaaaattagctggctgtggtggtgcacacctgtagttccagctacttgggaggctgaggtgagagaatcatctgagcccgggaggtcaagggtgcagtgagctgtgattgcaccactgcagtccagcctgggaaaccagagtgagacgctgtctcaaaaaaataaataaataggccaggcgcagtggctgatgcctgtaatcccaacactttgggaggctcaggcgggaggatcatgaggtcaggagttcaagaccagcctgaccaacatggtgaaaccctgtttctactaaaaatacaaaaattagccaagtgtggtggcacacgcctgtaacctcagctactcaggaggctgaggcaggagaatcacttgaacccaggaggcagaggttgcagtgagccaagattgcaccactgtaccccagcctgggtgacagtacagagcgaggctccatctcaaaaaaataaataaataaataactacatgtggttagtggctatcattttggacagtgtgggtctgaatttgaggtccctttgagtggctgagatgctgtgagtcagccaaattcatgtgtgggttcttatagctggtgccaactttgatgtgtctattaggctgggatggggcatgctaggggtgcccctgggactgtaagacaccagctcagacaagaagaactcctatttattccacaaatatgtgctgcatattggggattcacccatatatggagacagacaactaaacaggcagctataggggtacatgatcagggcgtgaggaggtaattactgaggcctggagagctaaggaaggtgcctgacccagcccgcgtggaggaaatctcggcagccttccaggaggaggtgacatctatgccaaaatagaaaagtgaatagtccaggcactgtggctcatgcctgtactcccagcactttgggaggccaaagtggaaggatcgcttgagcccgggagtttgagaccaccctgggtaacatagggagatcccgtctctacaaaaaatttaaaataaattagttgggcattgtggcatgcacctgtggtcccagctactcaggaggctgaggtaggaggattgcttaagctcaggaggttaaggctgtgtgagctgtgatcacaccactgcactccccactgggtaacaagacctggtttcaaaaataaataaataaatgaaaatttaaaaatgaataaaactgaaaggccaggcacggtggctcatgtctacaatcctagcactttgggaggccgaggaggtaggatcatttgagttcaggaattcaagaccagcctgggcaacatggagaaaccccgtctctaccaaaaaacacaaaaattagccgagcatggtggagcgcacctatagtcccagctactcaggaagctgaggtgggagtactgcttgagcctgggaaattgaggctcgagtgagccaagattatgccactgcactccagcctgtgtgacagagcaagaccctgtctcaaaaaaaaaaaaaaaaaaaaaaaaggccgggagtggtggctcactcctgtaatcccagcactttgggaggccgaggcaggtggatcacctgaggtcagaagttcgagaccagcctgaccaacatgtgaaaccccatctctactaaagatacaaaattagccaggcctggtggcacaggccagtaatcccagctactcgggaagctgaggcaggagaatatcttcaactcaggaggtggaggttgcagtcagccaagactgtgccactatctgccagcctgggtgacagagcgagaccctgtctcaaaaaagaaaaaagaaaaaaaaaaaaaaggccgggtgcggtggctcacacctgtaatcccagcactttgggaggctgaggcaggtggatcacctgagatcaggagttcaagaccagcctgaccaacatggtgaaatcccgtctctactaaaaatacaaaattagctgggcgtggtggcacatgcctgtaatcccagctactcaggaggctgagacaagagaattgcttaaactggggaggcggaggttgcagtgagccgagattgcactactgcactccagcctggggcaacaagagtgaaactcagtctcggaaaaaaaaagaataaaagacagtgatccaggtaaagcaggcaaacaagaaataatgcttaaggcagaagaaagagaatgagcagtagtctggaactaaagagtgaaactgtcaatctgaggaactgagtcctgggtgggacagcacagcgaggcatggaggatttggtgccatgaggctgggggcagggccgggaaggagtcacaggcttcacgggtcaccttgagggcacaggggagccaggacaggtatttgagcaggggagtgaggtgatgaggttttagtaagagccccaccaggtgctgttgtggagagggagtggagaacagccaggtgtgaaaggtgctggaggccagggctgggcagtggcaatggcactagggaggtgagcgccttacctgcctggtcctgctccccataccacgtgttccagttgcccacgagtgagcatgggtagtcctcatccaggtgaagcttgggcagcacagcctccctgtgggggaggtgcagagaggggcagggttcacatagccaccagggcctctgagataagggttcaaactcagttcaaacagaccctggggctgggcctcagactctccatctctaaaatgcagaagctaggcaagaggccctcaggacttccgacactgaaatttacatcctggctgggcacagtggctcacacctgtaatcccaacactgggaggctgaggcaggaggattgcttgagcccagtagtttgagaccagcctgggaagcaaagtgagatcccatctctcttttttgtgtgtgagacagagttttgctcttgttgcccaggctggagtgcaatggcgcaatctcggctcactggaacctccgcctcctggagaccatctcttaaaaaaaaaaaaaagaaagaaagaaaatggggccaaacgcagtggcacatgcctgtaatcccagcactcggaggccgaggcaggtggatcacctgaggtcaggagtttgcgaccagccggactaacatggtgaaaccctgtctctactaaatacaaaaaaattagccatgcttagcggcgcatgcctgtaatccgagctacttgggaggctggaacaggagaatcgcttgtacctgggaggcagaggttgcagtgagccgagatcgcgccattgcactccagcctgggcaacgagagcaaaactccatctcaaaaaaaaagaaagagagaaagaaagaaagaaagaaaaaggcagaaataaaagaaatctacatctcctggatttctacagaaaagaacagggtggaggatgttccgcaaatttgctgaaagtgtgttccccacccaagcaggggatgggatgtatggatgcagggtgctcacgtgaggctgttgtaggcatccaggtattcaggctttacattgtgaactgcaacagaggacagagaacaagaagtgaggtagggtgtgtacacagggaagaacttggggtgaggggagcccatcaaggccaggggtcccaggacagctgaggacattccagaccctcccatctccttcctggagcctcacaggcccccagagcccctgaaagggcagaaattggtcagctcagcagccactcacactggatcttatagaggttgctggtttccttcttggacagcagggtggagtgggcatccttccggggatccactttgtgaacaaagagggagcggaaccagctgccttcattgtccttggaatagaaactgcaggacagaggagttgagggggacgcgcggaggttgggggagccccagcaattccatccacttggatgtcctgctcccctagaccagtgacccacatttctgggaacagggccacggagtcctgtggcagctccagactgtgaaatgctattggagccagctcctttctacagatattccagctgcccagttggcttcttgaagctttgcagagcctcaggacgccaggagaggcagccccacctcccacttctctctctagcctccctgcctccacttcatcccccttccaagaggtcctctacttgggtcatataactccagcctctcgccaagaggatcaaccccaaatccaccttgcatcatgcccaaagcccttgacaacccaacctaacttgtcagcctcccctcctgccccctcacctgtacacctcactctccaggtgtgctcttccctgaacacaccaggatctgctactctgtgctttctgtacaagttctgtcccctctaacgagaagactgctctcaccgtcctccccagcactctcacagtgcacttggcccatgtccccaccctgaccccacacatggaaagccaaatacaaataagctttgtccttgaggagctcatagtccactaggagaaatgggccttgggacacaattataggaggggtctctggaagagcccaggtgaactagccttaactctgcttctggcaacctgggcagactctctacagaggaggagatgagctggtcagtccccaggactggtttggcagatagagggagtaaaaggcactgcaaagcaagatgcattcactcatccagccaacacctgctctgcccatctccataggatactgagaatgaatgaatgaatgatcaatgaatatgattatgtgctttgcccatgagcactgtggttaagggcagtggagggtctgctgccagctcctactggaccagaactgcactcccatcctaaacacatacccaaggtcccagcaggaggcaggggtgcttattttgagactaccaatcttcccgctccacagccttggtgcagcttgcagccaggcctgaaaaggaagtctcccaatggagacaattcctagccagggagcctggcaagagggatccctgagtggcagcaagccttatcccttttttcttttttctcttttgttttttccaagtgaggtcacaggaagccctatcctttcttttctttttttcttttctttttttttgagacagagtcttgctcttgttgctcaggctggagtgcagtggtgcgatctcggctcactgcaacctcggcctcccgggttcaagcaattttcctgcctcagcctcctgagtagctgagattacaggcgcgtaccaccacatccaggtaattttcgtatttttacaatacaaatactcggctgccctatccctttttaagacttttatgtggttagacaaatgtcttaggctgggtgtgatggctcacgcctgcaatcccagcactttgggaggccaaggcaggcagatcacctgaggtcaggagttcgagaccagcctgcccagcatggcgaaaccctgtctctactaaaaatacaaaaatcagccaggcgtggtggtgtgcacctgtaatcccagctactcaggagcatgaggcaggagaattgcttgaacctgagaggcagaggttgcagtgagccaagatcgcaccatcacactcccgcctgggcaacagagcgagaatccatctcaaaaaaaaaaaaaaaaaaaaggacaaatgtcttgcaaataaaaaatcaatcaattttttccaaaatatggagcagccattgggacggataaaatcagctgggcacgatggctaaatgcctgtaatcccagtactttgggaggctgaggtcagaggatcacttgagcccaggagttcaagatcagcctgggcaacaaaatgagactccatctctacaaaaaaaataataaatatgactggcttatgcctgtaatcccagcactttgggaggctgaggcaggaggattgcttgaggccatgagacaagcctggggaaacttgtgagaccgtgtctctacaaaaaataaaattagctgggcatgacggtatgtgcctgtagtcccactacttgggaggctgaggtggtaggatcacttgagcctgggaggttgaggctgcagtgagccaagatcttgccactgtactccagcttgggcaacagagtgagactctatctcaaaaaaataaaataaaataaaataaaatacaataattagccgggtgtggtgacacatgcctgtagtctcagccacttgagagacttaggaggatcgcatgaagcccaggaaatcaaggctacaatgaactatgatcaggccactgcactccagcctgggtgacagagaccatgtctcaaaaaaaaaaaaaatttctttttaaaaataatcttaaagtggtgatatgtttgttttgttttgttcatttgtttgtatttgagatggagtcttgctctgtcgccaggctggagtaaagtggtatgatctccactcactgcaacctccacctcccgggttcaagtgattctcctgcctcagcctcccaagtagctgggactacagacgtgtgccaccacgcccagctaatttttgtatttttagtagagacggggttttactatgttggccaggatggtctcgatctctcgacctcatgatccacctgcctcggcctctcaaagtgctaggattacaagcatgagccactgcgctgggccaaagtggtgatatgtttgtataagcataaaaatgagaaatgggccgggcatggtggctcacgcctataattccagcactctgggaggccgaggcaggcggatcacttgagctcaggagtctgaagccctgtctctgcaataaataaaaaaattgctgggtacggtggctcacgcctgtaatcccaacactttaggaggccaaggcgggtggattacctgaggtcgggagtttgagaccagcctgaccaacatggagaaaccccatctctactaaaaatacaaaattagccaggcgtggtggtgcatgcctgtaatcccagctactcaggaggctggggcaggagaattgcttgaacccaggaggtggaggttgtagtaagccgagatcaggccattgcactccagcctgggcaacaagagtgaaactctgtctcaaaaaaaaaaaaaattagccaggtgtggtcgagtgtcaagtgcgcctgtagtcccagctactcaggaggctgaggtgggaagatcgcttgaacccaggaggcgtaggttgcagcaagctgagatcgggccactgcactccagcctgggcaacagagcagaccctgtctcaaaaaacaaaacaaaacaaaacaaaacaaaaaaagaggctgggcatggtggctcatgcctgtaatcctagcattttgggaggctgaggcgggcagattgctggagctcaggagttcacgactagcctgggcaacatggcaaaaccccatttccacttaaaaaaagatacaaaatattagccaggagtggtgatgtgtgcctgtagtcccagctactcgagagactgaggcagaactgcttgaatccaggaggcggaggctgcagtgagccaagatcacgccactgcacgccagcctggatgacagagtgagactccatcttcacaaaaaaaaaaaaaaaaaaaaaaaaaaaaaaagaaagaaaaagaaaagaaaataaattacttgtcccaaactgttaatactgcttacctgggaaagaggaataggagatggctaaatttttctttattcattgtaattttttataaagattttaaagtgtgttaagcatttctgaattcatgaactctctcgatcattgtacatgcatctgcttcattagcaaaaagacaattatcagcctggtgcggtggctcatgcctgtaatcccagcactttgggaggccgaggcgggcggattgcctgaggtcaggagtttgaggctagcctggccaacatggtgaaactcagtctctactaaaaatacaaaaattagctgggcatggtggtgcaatcctgtaatcccagctactcgggaggctgaggcaggagaatcacttgaacccgggaggcggaggttgcagtgagctgagatcgtgccattgcactccagactgggctacaagagcgaaactctgtctcaaaaaaaaaaaaaaaaaaagacaattatcattagatgggtagtgcggtctgtgaagtttttggaccagaataagggaggctctaagccagggatctgtgatgtacttttcagttgcaggatctcactgattctatgcaatgatcttatagtattggtactattagtattcccattctcgcgaggataaaatggaaagaagcccagagagtttaagggacttgcccaaggccgcacagaaaatcagagggcagagttaagaacccagcgctctttccttgaaagccaatccccacctcaggttgggcactgagggacctgacctttggttttaatgtagaggggctgcttcccctggagggagatgggcagtgaggagagcagctcctactatttatcaaccaagacctttgctctagaaaggactagacagagtaatttattaacatcagcactgaccaagataaatatcagtcaaatagccagccctgaagaaagagattaggggctggaacactggaaacttcaggagctctgatgggctcccgtctcttcccactactctaatccttcctgcctgtgggcctcagtttccccatctgtcaaatgagcagggtggtggagcccatccctaaagctgttttctacaggtaaaatccaagaaggagcttgtcaaagatctcagaggagggtttgaactccaagccagcatccccaagggtacatctgcaagagtacaaatgtcactttctcagtgaaattacaatgttctcctacccttgacctccccaagccctctcttcctgctctctatcttgttccagagcacgttctaaaacgctatactaggattagcccagtggctcatgcctataatcccagcactttgggaggctgacgcaagagggaaggattgcttgaacccaggagttgtttttttttttttgttttgtttgagatggagtctcagtctgtcgtccaggctgtagtgcagtggcgtgatctgggctcactgcaacctccgcctcccaggttcaagcaattctccagcctcagcctctcaagtagctgggactacaggcatgtgccaccacatccagctaattttttatttttagtagagatgggttttcaccatgttagccaggctggtctcgaactcttgacctcaggtgatcctcctgcctcagcctcccaaagtgctgggattacagacatgagctaccacacttggcctttttttttttttgtatttttttgagatggagtttcactctgttgcccaggctggagtgcagtggcgtaatctcagctcactgcaacctccacctcctgggttcaagcgattctcttgcctcagcctcccgagtagctgggactacaggtgcgtgctaccacacccggctaatttttgtatgttttagtagagacggggtttcaccatgttggtcaggctggtctcgaactcctgacctcaagtgatctgcctgacttggcctcccaaagtgatgggattacaggcatgatccaccatgcccggccgaacccaggagtttgagaccagcctgggaaacatagcaagacctcatctctactaaaaattaaaaacaaaaaaaaacactatactttttggcttattatgtgctttgtttattgtcagtctctaaactggaggcagccctagcggggcagaatccttgtctgttctgttgtatccctgctgtatcccctatgcttggagcagtgctgggcacatggtgagaatgcagtccaagtttgagaaatgaatgaaagaggagctaagacattcttgcatgaaaatgatgaaagctgaaaagtatgaaacaaaagaaatggtagaccttaggctgggcgtggtggctcacgcctgtaatcccagcactttgggaagccgaggcgggtggatcacaaggtcaggagttcaagaccagcctggccaagatggtgaaaccccgtctgtactaaaaatacaaaaaattagctgggtgcggtggcaggcgcctgtaatcccagctacttgggaggctgaggcaggagaatcgcttgaactcagagggcagaggttgcagtgagccgaaatcgcgccactgcactccagcctggctgacagaatgagactccgtctcaaaaaaaaaaaaaaaggtagaccttgacccagagtgacttcactcagggatcaggggtcctttccatccttaacaccaacagcagaactagtgcttatgagcacaagctctggacaaatccaggttttgatcctagctcagcttcatctttcttttttcttctattttttttttcttttttcgagacagggtctcactctgtcacccaggctggagtgcagtgacacaatcatggctcactgcatcctctatctcccagactcaaatgatcctcccacttcagcctcccaagtagctgagaccacaggtgagcaccaccacgtctggctaatttttgttgttgtttgagatggagtcttactctgttgcccaggctggagtgcaatggcacgatctcggctcactgcaacttccacctcccaggttcaagggattctcctgcctcagcctccggagtagttgggactatagacatgtgtcaccatgcctggctaattttttttttttttcttgagacgaagtctcgctcttgttccccaggctggagtgcaatggtacgatctcagctcactgcaacctccgccccctgggttcaagtgattctcctgtctcagtctcccaagtagctgggattacaggcatctgccaccacgcccaactaatttttgtatttttagtagagacagggtttcaccacgttggccaggtcgaactcctgacctcaggtgatctgcccgcctcggcctcccaaagtgctgggattacaggtgtgagccaacgcacccggcatgtttttttgttttgttttgttttgttttgtttttttgatacggagtctccctctgttgcccaggctggagtgcagtggcgcgatcttggctcactgcaacctccagctccccagttcaagcgattctcctgcctcagcctccagaatagctgggaatacaggaacacaccaccatgcctaatttttttttttttttttttttgagacagagtcttgctctatcacccaggctggagtgcactggtgcgatctcagctcactgcaacctccacctccctggtttaagcgattctcctgcctcagcctccagagtagctgggattacaggcgcacacaccatgcccagctaatttttgtatttttaataaagacggggtttcaccatgttggccaggctggtcttgaatacctgacctcatgatccgcctgcctgggcctcccaaagtgctaggattacaggtgggagtcaccaggcctggcctggctaatttttgtgtttttagtagagatggggtttcaccatgttggccaagctggtcttgaactcctggcctcaggtgatccacccgcctcagcctcctaaagtgctgggattacaggcatgacccactgtgcctggccaaatttttgtattttttatagagacaggatctcgccatgttgcccaggctggtctcaaactcctgggttcaagcaatcctcccaccttggcctaccgaagtgttgggattacaggcgtgagcaatggtgcctggcccaggtccatctgatttcaaagcccacactccatccccaccccagcagcctcattgcccccaaacctcacaggccagaagggctgctgctggccctactagtgactctggagagatatggggcagcctgaggggcagcaggacagagtgttctcaggtatccaatgtggaattaaggtataagtaactgcaagacagtccttgagggacttgataaacattaattcaagtggcttcatagcaatcctgccgaaaacaccaacatccccactttacagaaaaggaaactgaggctgacggaggttcagcaactcatccagggtcactgagtgaggggcagcaggctgactctgagacccatgctccttttacagcctctgggtgtttgccacacaaatggttttaccaccaatccattctgtcccttccccaatcttgatatttttatctggaaaacaaagggctcataaaagatgatcttcccagagccctttgagcctcaacattatgtgggtcacatgcagaaattgcttgaaacataggctaggggttaaggagcaacacttactgcatgttcgtcaagtgctagacacttcacaaccacggaatcttttttttttgtagacggagtctcgctctgtcacccgggttggagtgcagtagcgtgatctcggctcactgcaacctctgtctcccgggttcaattgattctcctgcctcagcttcctagtagctgggattacaggggtgagccatcacacccagctaattgtatttttagtagagacacgttttcaccaacatggtgaaatttttgtacttttttttttttttttttttttttgagacagagtctcactcttgtcgcccaggctggagtgcagtggcaggatctcggctcactgcaagctccgcctcctgggttcacgccattctcctgcctcagcctcctgagtagctgggactacaggcgcctgccaccgcgcccagctaattttttgtatttttagtagagatggggtttcaccgtgttagccaggatggtctcgatctcctgacctcgtgatccaccgcctcggcctcccaaagtgctgggattacaggcgtgagccaccgcgcccggccatttttgtactttttatagagacaggatctcgccgtgttgccaagctggtcttgaactgctgacctcaagtgatctgcctgcctcggcctcccaaagtgctgggattacaggcatgagccaccatacccgaccaaccacagcatctttaatcctcaacaaccctatgagatacatcctgattactcccattttacagatgaggaacccgaggcttaaagagtcctgaggtcaccccacctacaaagtctgagttagatctgttagtgccaggcaaactctaggcttttcccacggtgtcagctttatccctaattattgggcagtctaggtggggcgcttatgccactcctctttcccagctgtccaaaagccccactgctctgtgctgtaacatctcatggcaggcactatcagaactttgcagcttcattcctgggctgcagggcaggagggatggttgcttccttttcacaggttgggggagggggaacaggtggcctcacttctttggtaaatattccttgaccatacacagtcctgagccctctgagggtgggaggctggggaaacagagaaaaatgagatcatggtctagtgagagagacagacaagcaccaagtcataactgtgcagggtcatatatgcagagatgggggaagtacagggctgtggggaccaaggagtgaggggctgcccagggccagtcagggaggccaagccctagctcagcccagagcagggcccaaacaaaagcccaggctgagagcacatggcccagccagactcccactcccaggaggccaccagttgggtgcaaagtgcatggcgcattggcaggcctgggtcccagacctggtgctgccacggcacagcagggagggtgaccttggacaactcccattccctctcaggtccgtttccccacctgtacagttcgaggtggaggaacaaagggtctgtgcagccatggcccctggggatcccccactgctcccctgccatcatctctttcccacagaacttcccgacggaggagctgactaccagaagcccccagtgggtgttaaatcacaagctacgcctgggaatgggccactcctcctgtcttctgccctctcccactctccagggcccagtacctgcccttctcaccatctttcatcaggtccccatcacagcccggtcccaaccaggacaaagaccctacccatccctttctcacctcccccattctttgcccagacccctccctaggccttgatcctgccccgcctctaacccccagattccaagcgaggagtctcagcccctcccccacgacccagtccctggcccccgcgcctgcaccccaccccgcgcgcgtctatccctgcctggccgggctctcaccgcgccgcagctgcagacgcaacgtccccagcgcgaggccccgggccccccagcagccgccgcgccgtcacagagatgctgcacagccgcggagccatgttggagccgcaaaggttgcaggaaggccccgcccccaagccctggtggcggaggcggggcgcgaataaactccacccctccggctcgcccgccccctcactcacccggtcaggtgggcgtttcctgtgggcgtctccaactccgcaggtgctggacggaagtcagggttctaatcctctgcgcgctctgcgaccttggcaagccctttgcccactctgggcctcaggatccacctcggtaaaatgggagcgtggaacaataataccaagggttctttttttttttttttttttttttgagacggagtctcgctctgtcgcccaggctggagcgcagtggcgcgatctcggcccactgcaagctccgcctcctgggttcacgccattctcctgcctcagcctcccgagtagctggaactacaggcgtctgccaccacgcccagctaattttttgtatttttagtagaaacggggtttcaccgtgttagccaggatggtctcgatctcctgacctcgtgatctgcctgcctcgtgctcccaaagtgctgggattacaggcgtgagccaccatgcccagcctaccaagggttcttaacaaggctgtccgggatgtgcagcagagggtcagtgtaaccaccccatgggttcattttgcccgtttcccagacagcggatttatcaagacagaggaattgcaataagagtttaattcatgcagagccggctgaatgggagaccggagttttattattactcaaatcagtctccctgaaaattcggagactgggttttattaaggataatttggtgggtaggggccagagagtggagagtgctgattggtcaggtcggagatgcaatcatagggagtggaagccgtcctcttgtgctgagtggatctctgggtgggggccacaaaaccggatgatccggtttcttaatctgtgtatcgccagcggatccattgagtgcaggatcggaaaaatatcttgagcaccaatcttaggttttacagtagtgatgttatccctaggagcaactggggaggtttagaatctgtggccactacctgcatgactcctaaaccgtaatttctaatctcgtggctaatttgttagtcttacaaaagcagtctggtccccaggcaagaaaggggtttattttgggagagggctgttatctttgtttcaaagttgaactataaatttgctgccgggcatggtggctcatgcctgtaatcccagcattttgggaggcaaaggtggatcagaagtttaggtcaagagttcaagaccagcctggccaacagggtgaaaccccgtctctactaaaaatacaaaaaaattagccaggcatggtggcgggcacctgtaatcccagttactcgggaggctgaggcaggagaatctcttgaaccctggaggcagaggttgcagtgagccgagatcgcgccactgcactccagcctgggcaacaagagcgaaactccgtctcaaaaaacaaacaaaaagactgtaagtttggcctatgcccaggaatgaatatggacagtttgggggttagaagcaaaatggagtcggttaggtcagatcactttcactgtcataattttctcactgttaaaatttctgcaaaggggttgcatcagtaagccccctgaaattgtatacaacgttacgtgctcctctgtggtgcattctctggggaaaggcattcacatgccaggtttatcaccatcaaagaaacaaacttccttacaagtgaagacaggggcaaggctgtcagctgcagacactttatctccaccatctcctttccccttttcatccccctttgacttctctgcctgaaaatcctggggcctctttctgccctgcccagctcttttgcccgccctctaaactaatcccttctcagcccacaatcccccagatcacagacattggcaggggtggagagcctgcagaccccacagggggcaggggctctatccacttccaaaggggcagggacagctccccaaaagaatgtccacccactgactagtggttgcctcctgttatgcttggcatggggggagtggaggccaggccatgattgcaccactgcgctccagcctgggcaacagagcaagacccagtctctataaaaaaataataataattttaagattaggaccacgtgtggtggctcatgcctgtaatcccagcactttgggaggccaaggcaggaggatctatgaaaattcaaaaaattagctgagcatggtagcacacacctgtagtcccagctactcaggaggctgaggcaggaaaatcacttgaggtaggaggtccaggctgtagtgagttatgattttttaattaaataaataaatcaggctgggtgcggtggctcatgccagtaaatccagcactttgggaagccaaggtgggtggatcacctgaggtcaggagttcgagaccagcctggccaacatggtgaaaccccatctctactaaaaatacaaaaattaggccgggcgcagtggctcatgcctgtaatcccagcagtttgggaggccaaggcaggggaatcacctgaggtcaggggttcgagaccagcctgatcaatatgatgaaaccccatctctactaaaaatataaaaattagccggatgtggtggcatgtgcctgcaatcccagctactcaggaggctgaggcaggagaatcacttgaacccaggaggcagagattttagtgagccaagatcgcgccattgcactccagcctgggaaacaagagcgaaactccgtctcaacaaaacaaacaaataaataaaataaaaaataaaaatacaaaaattagccaggcatggcatggtgacgcacacctgtaaccccagctactccggagactgagtcaggaacatggcttaaacccaggaggcagaggttgcagtgagccaagatcgcgccactgcactccagcctgggtgatagagattccatctcgaaaaaaaaaaaaaaatcaaagtcagtatgatcttagcagagtccccagtcaaagccactcaggaaaaacccaggtgggttgatggaagcacagcaaatggtgtcatgtggtgggagcagctctttccttaggaacccagcgtggcagactgactgtggagtggtggaagtgaccacctccgccaacctgactttggacctgagcttcaaaggatgagtaggagtctgccaggagagagggaaggaccagcggaaactcagaggaagcaatgtgtactcagtatgtgaaggggctgccagaggccaggcgcggtggctcacgcctgtaatcccagcactttgggaggccgaggcaggtggatcaattaaggccaagagtttgagaccagtctggccaacatggcaaaacccgatctctattaaaaatacaaaaagttagccagtcatggtagccacacctgtggtcccagctactctggaggctgaagtatgagaatggcttgatcccaggaggcagaggttgcagtgagtggagattgtgccactgcactccagcctgggtgacagcaatactctgtctcaaaaaaaaaaaaaaaaaaaaaaaaatgaggggtgtgtgttgagggctcttccaggaagaaagcacagttgaatataatgaatgggtggagattatgtgatggcagcctctcattcagtacaggaataattttgtttctcttttttttttttttttttttgagacagggtctcactctgtcgcccaggctggagtgcaatggcgtgatctcagctcactgcaacctccacctcctaggctcaagcgattatcctgctttagcctcccgcatagctgggattacaggcttgcattaccacatccagctaatttttgtatttttagtagagatgggatttcaccacattggccaggccggtcttgaactcctgacctcaaatgatccacccacctcagcctcccaaagtgctggaattacaagtgtgagccaccgcacctggctggaataattttctaacaatggaatgggctgccttggtggcatgtcattgaattgtgtcaacagaggccgagtagcagcacgttggctatgtggtagagggcatttggcagtcaggccacagcaagctggacccaaggacagggaggagccggccttggtggtttagggtgagaggctctcaccaaagccttggcattcctggctgcctcacactgcctcccaggtgaggagaatgagggaggactgacctgcagcctcctcctgtgggtcttagcatttctaagaagggttttccatctctgtccagccaaatagggcaggagggtgaaaaaaggtggtgctgggagcatgcttccacccctgcctgggagagatgggatatgggcatccctccccaacccacatgaaccacagtgtggccgctgactagaagggcaacctcaaggcccctactcccacctcagctagggcaaccacatatcccagtttatcctggactttctcagttttagcactgaaagtcctccatcccagaaaacccctcagtcctggacaagccagaacctttggtcaccccaattacggccctagttctctccccaggagatatacccactccatcccagaatcttttccttgcttaactaaatctatttaccctccttttttttttttttttttttttttttgagatggagtctcgctctgttgcccaggctggagtgtagtggcgcaatctcggctcactgcaagctctgcctcccaggttcaggccattctcctacctcagcctcccgtctagctgggactacaggtgcccaccaccacgcccagctaatttttttttgtatttttagtagagacggggtttcactgtgttagccaggatggtctcgatctcctgacctcgtgatccgcccgccttggcctcccaaagtgctgggattacaggcgtgagccaccgtgcctggccctatttaccctccttgaaagggagctggggtctgggcgaggtagctcacgcctgtaatcccagcactttgggaggccgaggtgggtggatcacctgaggtcaggagttcaaggccagcctggccaatgtggtgaaacctcatctctaccaaaaatacaaaaattagccgggtgtggtggcaggtgcctgtggtcccagctactcgggaggctgaggcaggataatcagttgaacctaggaggtggaggttgcaatgagccaagatcatgccactacactccagcctgggcaacacagcaagactccgtgtcaaaaaaacaaaacaaaacaaaaaaacaaaagaaagaaagacagaaaggaaaggaaaaggaaaaggaaaggaagaaagagagcagggatggggtccaagctcagtggctcacacatgtaatcgcagcacactgggaggcccaggcaggaggattacttgaggccaggatttcaagaccaacctgggcaacatagtgagacccttgtctctactaaaaatttttaaaaatgaactgggtatggtaatgtgtgcctgtagtcccagctattcaggaggctgaggtgggagcactgcttgagcccaggagttggaggctgcagtgagctatggtcatgccactgcactccagcctgaacaacagaacaagacgttcactctaaaagaaaaggggtatgccgggcacggtggctcacgcctgtaattccagcactttgggaggccaaggtgggcagatcacctgaggtcaggagttcgagactagcctgaccaatgtggagaaaccccgtctctactaaaactacaaaattagctgggcatggtggcacgtgcctgtaatcccagctactcgagaagctgaggcaggagaatcgcttgaacctgggaggcggaggttgtggtgagcccagagtgcgctattgcactccggcctgggcaacaagagcaaaactccatctcaaaaaaaaaaaaaaaagaaaaagaaaaaaaaagagtgagggtggaactgggctctctttgtggcactcagtgacatacaatgctggttaactgggcacctgatgtgaactgtccttacccacagaccattcattctgtgtagcaaaccagttgctgtattctggtcagcaaaccagttaggataaaattccatcaataggccgggtgggatagctcatgcctgtaatcccactttgggaggccgaggtgggcagatagctttgagctcaggagttcgagaccaacctgggcaacatgacaaaaccccatctctacaaaaaatgcaaacattaactgggtgtggtggtgcacacctgtagtcccagcaattcaggaggctgaggtgggaggatggcttgaatccaggaggcggaggttgcagtaagccaatatcatatcactgcactccagcctgggtgacagagtcagaccctgtctccaaaaaaaaaaaaaaaaaaaaaattccaccagtaaaaatgtggctgagcacagtagctcacacctataatcccagcactttgggaagctgaggcaggaggatcacttgaggccagagtttaagaccagcctgggtaacataggaagaccccatctctataaaaataattttaaaatattagctggtggtgtgtgcctgtagtcccagctactcgggaggctgaggccagagtattgcctaagcccaagaagtcaaggcttcagtgagccatgatcatgccatgccactccagcctgggcaacagagggagatcttgtctttaaaaaaaaaaaaaagaaaaaaagaaaaattccacaaatagagatttagacaatttccaattactatggaataaattaccccaaatcttagcagcttgaaacaatcagcatttatgatctcacacagttcctgagggtcaggaattctggagtgggtggttagctggggcggttccttctctgggggtctcacaaggctgtaatcaagatattggcttgggttagtagtcatctgaagacttgaccaaggctggagaatccccttccacggtgagtcattcacatgcctggcaagttagcgctggtagttggcaggagacctcagttccttgctacatgggcttctccagagggctgcttgagtgtcttcaccacatggcggctggcttcccccagagcaagtgatccagtaaggtgaaaccttcaaggacttttgtgatctgaccttggaagtcacactgtcgtttttgtacatcccattggttggacatggagccctcctctgcaggagtcagggtcttgttctgttgcccaggctggagtgcagtggcacaatcatagctcactgaagtctccaactcctgggctcaagcagtccccctgactcagcctcctgagtcactaggactgcaggcatgcgccatccatgctcagaatataaatatcaatacgtgagcagggctgcatgtctaaccaataggtgtaaatatcaacatgcgagagtcacgtgggacatcctggaggctggctagcacaattagcttttgtactaggcccaacttaattattagggttggactcagttcttcaagctgtcttctacaaggcctccccagagtccccactgtcctctgtcctaggatctctctctctctgaagttcctttctgcccaccactatgtctgtgacatctttttctcctgaacatgtctcccacccacccctcctctccctgcagagagccgacccctcctctcctgccctcttcccttcccaaagctgccctcatggaatccaccttcataactctttgccgaagtccgttatccaatctgcaaaacgaaatgagaggagccagggacaaagacagttgggcagagccaggcagagaagaacaggcaggttcataagtgtaaaatattgacaaacctgccatcatccattccctcagacaaatagatcatcaccaaatgggctgcagacgagcaaagagacaaattacccagctgtggcagtgtcacctgctccttattaatgggcttttatgctcagacccaactgctgtctgagaactgtacccttcagttcttatgggaccccaaacaggagggaaagggacaagaaagcttttatgtctcacctggggcaagagccacagagctaagtcccagcctttctggactatgcatcatatacagatatgaatcatgtgcctttgacagagtgccacataaaaacattaacaggccaggcgaggtggctcacgcctgtaatcccagcactttgggaggctaaggcaggtggatcacttgaggtcagcagttcaagaccagcctgactaacatggtgaaactccatctctactaaaaatacaaaaattagccaggtgtggtggtgtgcgcccgtaatcccagctactcaggaggctgaggcaggagaatcgcttgaacccaggaggcagaggttgcagtgagccgagatggaggcagaggttgcagtgagccgagatcatgccactgtactccagcctgggcaacagagcgagactctgactcaaaaaaaaaatgaacaaaggccgggcgcggtggctcacgcctgtaatcccagcactttgggaggccgaggcgggtggatcatgaggtcaggagatcgagaccatcctggctaacaaagtgaaaccccatctcgactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaagaacaaaaagttccactccgcgtatagattataaataatacaaatgctaggggaaaaaattaacctgttaagtatagaacaatttcaaagctggtggagtggattataaactgtgtttatgctattgccacaaggtggcgccactttagcaaggaagcaaatgcccacatcctgtcattactgagcaaatcacacggttgttgacgtgcttgggacactagcaattgtttttttgtgctattatttggccagacactgttattataaaccactttaaaaggctataacaagactaggcgcggtggctcatgcctgtaatcccagcactttgggaggccaagagaggcggatcacaaggtcaggagttcgagaccagcctggccaacatggtgaaacctggtctctactaaaaatacaaaaattagctgggtgtggtggcacatgcctgtaatcctagctactcaggaggctgaggcaggagaattgcttgaatccaggagatggaggttgcaatgagctgagattgtgccactgcactccagcctgggtgacagagcaagactctatctcagaaaaaacaaaaacaaacaaataagaaaaaggatacaacaacatcattcaagcattcctgaaggagaggggctagtgctgaaaagcatgtcctcaaatcaacacctttggagtggatattggacatgatgagacaccatgaagaagaccaaaccacctccatgacaggtggtgctgttaatttaggagactgcccgcaggtacagataatgctgcaaagatacaaagcaggatcaaaagcaaaaatgtggtcagatggttgtgcagatttatgagttatgtgagtgcatttcatctcctactcgtattcttggaacacaaagttttgaatcatgttaagtttacagcatggcatccttcttgtaaaatatgacatttaaatgagggaggctggccaggagtggtggctcacgcctatgatcccaacactttgggaggctgaggtgggtggatcacctgaggttaggagtttgagaccagcctggacaacgtggtgaaacccggtctctactaaaaatacaaatattacccagacttggtggcccatgcctgtaatcccagctacttgggaggctgaggcagaagcagcacttgaacctgggaggtggaggttgcagcgagccgagatggtgccactgcactccagcctgggtgacagagctagactctgtctcaaaaaacaaacaaacaaataaatatgacattcctggtcctccccagcataaatatggccacttgagtccactcctgcaagcagggagctatgggttgaattgtgtttcctcaaaaagagatgttgaagtcctaacccctagtacctcggaatgtgaccttatttggaaatagggtcttgaaagaagtaataaaattaaaattaggtcattagggtgagccctaatccagtatgactaatgtccttgtgaacaggggacatttagactgggtgcaatggctcacacctgtaatcttagctctgtaggaggccgaggtgggcagatcatttgaacccaagagttcaagaccagcctgggcaacatggcaaaactcttatctctacaaaaatgcaaaaattgccgggcgtggtggctcatgcctataatcccagcactttgggaggccaaggcagaaggatcacctgaggctgggagttcgagaccagcctgaccaacgtggaaaaaccccgtctctactaaaaatacaaaattagccaggcatggtggtgcatgcctgtaatcccagctacttgggaggctgaggcaggagaatcgcttgaacccagaaggcgggttgcagtgacctgagatcgtgccactgcacttcagcctgagcaacaagagcgaaactccgtctcaagaaaaaaaaaaaaagagcattcagtaacaattcaataaatttgtgcttttaggatggatttactatttgaaattccatttctttttttttttttttttttttgagatggagtctcactctgttgcccaggctggagtgcgatggcgcggtctcggctcactgcaacctctgcctcgtgggttcaaacgattcccctgcctcagcctcctaagtagctgggattacaggcatgtgccaccatgcctggcctccatttcttttttaaaattatttttatttcttttgggtgggcagggtagctcatgcctgtaatcccagcactttgggaggtggaggcaggcagatcacttgaggtcaggagtttgagaccatcctggccaacatggtgaaatccagtgtctactaaaaatacaaaattagccaggcgtggtggtgcacgcttgtagtcccagctacttgggaggctgaggcaggagaatcacttcaaaccaggaggcagaggttgcagcaagccgagatcatgccactgcactccagcctgggtgacaaaatgagactccatctcaaaaaaataaaataattattattttttttcgagacaagatctcactcccattgcccaggctgaagtgtagtggtgcaatctcagctcactgcagcctggacttcttgggctcaagcgatcctcccatgtcagccttcagagtagctgggactgcaggctcgcaccaccatgtccagctaattttgttgttgttgttgttgttgtttttgtgccagagtctcgctctgtcgcccaggctggagtgcagtggcgcgatctcggctcactgcaggctctgccccccggggtttacgccattctcctgcctcagcctcccgagtagctgggactacaggcgtctgccacctcgcccggctaattttttgtatttttagtagagacggggtttcactgtgttagccaggatggtcttgatctcctgacctcgtgatccacccgcctgggcctcccaaagtgctgggattacaggcgtgagccaccgcgcccggctgttgttgttgttgagatggagttttgctcttattgcccaggctggagtgcaatagcgcaacctcagctcactgcaacctcagcctcccaggtacaagtgattcaatctcccaagtagctcagattacaggcatgagccaccacacctggctaatttttttgtatttagtaaagacggggtttcaccatgttggtcaggctggtcttgaactcctgacctcaggtaatccacctggctcagcctcccaaagtgctgggattacaggtgtgtgccactgcgtctggcctaattttttatatttttagtagagacggggttttgccatattgcccaggctcgtctcaaactgctgggctcaagtaatcctccctccttggcctcccaaagtgctgggattacaggggagccactgtgccttgcccccatttcttattctctcctttttaagtgatgatggaacgaaggccaggaaatggtaaaaaatctttttgaggtaacacagcaccttggacataggaggtgcttgataatttttttttttttttttttagacggagtttcactcgttgcccaggctggagtgcaatggtgtgatctcggctcactgcaacctctgactcccaggttcaagagattttcctgcctcagcctccctagtagctgggattacaggcacatgccaccacgcccggctaattttgtgtttttaatagagacggggtttctccatgttggtcaggctggtcttgaactcccgacctgaggtgatccaccccagtctcccaaaatgctgggattacaggcatgagccaccgcgcccggccgataaatattaattatggtttacgaggggttttaaacttgtcatagcatttattattacagtattaccatttttacaaacggggtaactgaaactcagagaagttaaattgcccaaggtcacagagaaatagaaattctacctcaggcctgtctgcctccaccatcaactgacatcctagagaaattcaaatctctgcaatctggcctgaagagaacagaggacacgaggagtactacttatttccaaaagtgttctaggtccagataggagttattacctgcagcctgctttcattcagcttcagtaccccagtgtggtgccttggctgagcctctgaccatgcaaggtcatctgggtcaggtgatgtttaatgagtcgggttacctcactgagcctcagactgcaagataggcaagaacctcttagtttgcttattgctatctcagctggtgcagcttacaaaaatgcatctagaacatcagtccaattctaagcaaatgtaagacaaaccaacgagacagacctttgagaaatatattctatcgatacttttttttttttttttgagatggaatttcgctctgtcacccaggttggagtgcagttgcacgatgttgactcactgcaacctcctcctcctgggttcaagagattctcctgcctcagcgtcccgagtagctggaattacaggcgtccaccaccacacccagctaattttttgtattgtcagtacagacagggtttcaccacattggccaggctggtgtcaaactcctgacctcaggtgatccacctgcctcagccccccagagtgctgggattacaggcatgagccactgcgcccagcccatacatactctttaaaaagtgtcaaggctggccggacacggtgactcatgcctgtaatcccaacactttgggaggccgaggcaggtggattaattgagcccaggagttcaagaccacattgagcaacatggcaaaacccttctctactgaaaatacaaaaattagctgggtgtggtggcacacgcctgtagtcccagctacaagggagggctgaggcacaagaatccttgaatccagggaggtggagctggcagtgagtagctgagactacatccatgcaccgccatgcccagctaatttatatttttagtagagatgaggttttgtcacattggccaggctcttcatcaactcctgagttcaggcaatccacccaccttgacctcccaaagtgttaagagttacaggcatgagccaggcaccaggcctcaatgttaatttcttgattttgatcattgtattacgattaactaaaatgttaacattagaggatgctaagtgaaggatatagagaaactctactatttttgcaggttttaagtccaatattaggtcaaaataaaaagcttataaattatacacattaaaaaatactttgttggtggggcgcggtagctcacgcctgtaatcccagcactttgggaggccgaagcaggcggatcacttgaggtcaggagttcgagactagcctggtcaacatggtgaaatcctgtctctactaaaaatacaaaaattagccatgcgtggtggcaggcacctgtaatcccagctactctggaggctgagacagaattgcttgaacctgggaggcggaggttgcagtgagccgagatcgcgccactgcactccagcctgggtgacagaccaagactccatctcaaaaaacaaatttgttatgtaaggtcttgtcccaagaagaataaacaataacaaaaccttaaataagagatctataactgtgtaaaaagaaatacagctagtgcaacaattaaatagtaagtgggtagggaaaaattcactgtaaagtaagcaagagcagcaagaataaaataaagccaaaaataaggcaaggtcaagtacaattgccagaggcagacatacaatttggctctgagcttcttaccagcaggaaggaaacttgattacttgagttacaatgtgtgtaagagaaaaaaacttaaaatttacatccatacataaagtcctgtacatttcttagaaaattatattataaaatatttagtgacgggtgaggatattaatgaatgaaaaattaacaaatggccaggcgtggtggctcacgcctgtaatcccagcactttgggaggccgaggtgggtgaatcacaaggtcctgagttcaagaccaaccaggccaagatggtgaaaccccgtctctactaaaacacaaaaattagccgggcgtggtggcgggcacctataatctcagctactcgggaggctgaggcagagaactgcttgaacccaggaggaggaggttgcagtgagccaagattgcgccactgcactccagcccagctaagactccgtctcaaaaaaaataaaattaacaaatcataaaacaataagtagtatgcgatagcagtgggtcagtggattatgcgagttaaattttttttttttttttgagacggaatctcgctctgtcatccaggctggggtgcagtggcgcgatctcagctcactgcaacttctgcttcctgggttcaagcgattctcctgcctcagccaccccagtagctgggactataagcacgcaccactgcgctcagctaacttttgtatttttttaagacacaggttctcaccatgttggtcaggctgctctcaaactcccgatctggtgatccacccgcctccgcctctcaaaatactgggattacaggagtgagccactgcgctcagccccaacagttgtttttcttggtcgggcgaggtgagctgggtgactcatacctgtaaccccagcactttcgaatgccaagctgggaggatcgcttgaggccaggagtttgagaccagcctgggcaacatagcaagatccttgtctctacaaaaaattttttaaaaattagcatggcatggtggtgcctttagcccccgctaattgggaggctgaggtgcaaggatctcttgaccctaggaactcagagccacaattagctatgatcgtgtcacagcagcactccagcttgggtgagagtgagttcccatttctttaccaaaaaatgtttttctttctggctgctttctattgctgtgcaataaattgctatacatttagtggcttaaagtaacatacaggccaagcacagtggctcgcatctgtaattccagcactttgggaggctgagacagaaaaatggcttgaaccccggagaccagcctgggcaacatcacaaaactgtctctaccaaaaaaaaaaaattaacgttgcgtgacggtgcatgcctgtagtcctgtgtccgggattggtgggttctcagtctcactgacttcaagaatgaagccgaggaccctcatgttgagtgtcacagttcttaaaggcgacgtgtccaaagtttgttccttctaatgttctgatgtgttccgcgtttcttccttctggtgggttcatggtcaccggctcagaagtgaaactccacacttccgcagtgactgttacagctcttaaggcggcgcttctggagttgttcctttctcccggtgggttcgtagtctcgctggcttcaggacttaagctgcagacctttgcaggtaatattacagctcataaaagcactgtggacccaaacaaggagcaaacaaacaaagctcccacaatatatgaaacaagctgcacaggttatcactgctagcaccggcagcctgcttttattttcttatctggccccacccacatcctgctgattggtccattttacagacagccgattggtctgttttacagagagctgattggtccattttgacagggtgctgattggtgcgtttacaatccctgagctagacacgaaagttctccacctccccactagattagctagatacagagtgtctattggtgtatttacaaaccctgagctagacatagagggatgattggtgcatttacaaaccttgagctagatacagagtgccgatttgtgcattccccttagctagacataaagattctccaagtccccaccagactagctagataacagagtatggagtggtgcattcacaaaccctgagctggacacagagtgctgattggtgtgcttacaaaccttgagctagatacagagtgctgattggtgtatttacaatcccttggctagacataaaggttctccaagtccccaccagactcaggagcccagctggcttcacccagtggattctgcaccgtggccgcagatggggctgcctgccagtcccccgccatgcgcctgcactcctcagccgtcggacggtcgatgggactgggcgccctggagcagggagcggcgctcgtcggggaggctccggctgcgcaggagcccacggcggtggcagagaggttcaggcatggcgggctgcaggtcccaagcccttctccgcggaggggcagctaagaccggcgagaaatcgagcacagcagctggtggcccaggtgctaagcccctcactgcccggggcttgccggcgggccggccgctctaagtgcggggcccgctgagcccacgcccacccgcaattcgcgctggcccgcaagcgccgcgcgcagccccagttcttgcccgtgcctctgcctctacacctccccgcaagctgagggagccggttccggccgtggccagcccagaaagggactcccacagtgcagcggcgggctgaagggctcctcaagcgcggccagagtgggtgccaaggccgaggaggcaccgagagcgagcgagggctgcgagggctgccagcatgacctcacctctcagtcccagctacgcgggaggctgaggcggagggatcacttgatccagtgaaggtctaggctgagccatgatcttgccactgcactgcagcctgggcgacagagcgagaccttgtctcagaaacaaacaaaaatctctgctctagagcacagtttctttatcttggcactattgacactttgacctggataattctttattgtggggagttgtcctgcgcattgtggaatgttgaacgccatcattggcttttacccttagaggccaggaacatcccccagttgtgacaaccaaaaaagtctccagacattgccaaatgtcccctgtagggcagggaccactatctgagaaacactgatctggaagagcaaagtgtaaatcaggagagatatggatgaaaccactcctagatgcaaattgcagctctaccaatcatggctgtgggtaaattacctcttttcagccttattcagtttcctcagatataaactgaggatattacacctaccaaatgtggttttgaaaaaggtcaaaatagtctgggcgcggtggctcatgtctgtaatcccagcactttgggaagctgaggcgggtggatcacctgaggtcaggagttccagaccagcctgggcaacatggtgaaaccccgtctctactaaaatacaaaaaattatctgggcgtggtggcgcacctgtagtcccacctactctggaggctgaggcaggagaattgcttgggccccagaggcagaggttgcagtgagccgagatcgtgccactgcaccatagcttgggctacagtgcaagactccatgtcaaaaaaaaaaaaaagaagatcaagataaacaaagcatgcaaagcactttgcagagtgctgtatatggtaagcatttaaaatatggtagctactaatattgtccagaccatagttgacaccgtaagtatttctttatgaccgtcactcattcattcaacagatatttattaactggggtctgtgtgccagatcataataagctctatctgaattccccctcagacccttatctggtgcatataattatcatctgtgtttatttatttattattattttttgttttgagatggattttcactcttgttgcccaggctagagtgcaatgacgcgatctcggctcactgcaacctctgcttcctgggtttaagagattctcctgcctcagcctcccgactagctgggattacaggcacccagcaccaagccaggctaagtttttgtatttttagtagagacgggagtttcaccatgttgtccaggctggtcttgaactcctgacctcaggtgatccacccacctcggcctcccaaattgctgggattagaagtgtgagccactgtgcctggccgtatttattcttttttttttttttttttttttgagacggagtctcgctctgttgcccaggctggagtgcagtggcgcgatctcggctcactgcaagctccacctcccgggttcacgccattctcctgcctcagcctcccgagtagctgggactacaggcgcccgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggcccgtatttattctttatgaatggcattttttggggagctgggggtctcactctgtcacccaggctggtatgcaataacaccatcatggctcatgtggactccaactcctggtctggtgtgaccatcccgcctcagccccactgagtagctgagactgcaggcacactccaccacacaggctaatttttttttctttttttttgagatgaagtcttgttctgtcacctaggctggagtgcaatggcatggtctcagctcactgcaacctctgcctcctgggttcaagcgattttcctctctcagcctctggagtagctgggattacaggcgtgcgccaccacgcccggctaattttttttgtatttttgtagagacggggtttcaccatgttggccaggctagccttgaactcctgatctcaagtgatccacctgcctccgcctcccaaagtgctgggattacaggtgtgagccaccacacctggcacacactggctaaatttttacttttttttgtagagatggggtcttactatgctgcccaggatggtctcgaactcctggcctcatgtgatcctccaaccttggtcttccaaagtgctgtgattacaggtgtaagccactgtgtccaacctgtgaatggcacttttaataccagcaaaagattctatcacatcgatttttattcctggccctgacctcccttctgggattcaaacccatatgtccagctggatgtcctcccaggaacattaaatttggcatttggggccaattagcccagtgcctagcacctggcaagtcttttcataaaaatgagctattaccaatcatcagtgtcgctttttagtccctgctagctgatccacctccttttgctactcctcactgggttcccagtgtcacgcattttctttttcctttttttttgagacggagtctcgcactctcgcccaggctggagtgcagtggcgccatctcggctcactgcaagctccgcctcccgggttcacgtcattctcctgcctccgcctcccgagtagctgggactacaggcgcccgccaccacgcccggctaattttttgtatttttagtagagacagggtttcaccgtgttagccaggatggtctcgatctcctgaccttgtgatctgcctgcctcccaaagtgctgggattacaggcgtgagccactgggcccggcccggtgtcacgtatttttatcagcagccatttgttgtccctgtggggagcccagaaaacccagcccggttctcccacctgcggggaagaaatgaagcaatgataatgaagacactcccatgccaagcccatactgccctgagcaatcagttttggtggggagaatttgctagcagaaggcaggacataaagtccccacagcagcctcactgggtgtggcagcaaatcattcctgaggcctggccggtgctaccaggcacagcaggggtccgtgcagaagaactagatttattccattaatataccgttacagcaacaatgtctgctgagtactccggaactgtaattcacatttcctgaggctgtagtagggagaatttggaagcagggcagcacagtgctaaccagcaggctctgggtgggacagacctgggtttgagtcctagctttgcctttcactatctgcattatagtcagcgagtggctctatcatatctctcagtatcttcacctgtggagttgggggggtgatgctaatgttagctaacatttatggggtgattattgttgttaaaactcagtacaccgggcgcggtggctcacgcctgtaatcccagcactttgggaggccaaggtgggcagatcacctgaggtcagaagtttgagaccagcctggctaacatggtgaaaccccgtccctactaaaaatacaaaaattagccgggcgtggtggcgggtgcctgtaatcccaactactggggaggctgaggcaggagaattgcttgaacccgggaggcggaggttgcagagagccgagaccgccccattgtactccagcctgggcaacaagagcgaaactctgtctcaaaacaaaaaacaaacgaaaaaacacagtaaattgtccctatttgactactaagagctattttaaaatagaatttattatctaagtacagaaaggtgtaattatcccccctacacccgttagaacccttgatgacactaaataaataatacatgaatacggttcaaaaatgggcatcatagagtataaaataaagaatgctttcattttcaacccaaattcagcaatttcataggatgccaggctcagctctaaagccttatatgtattcagtgcgctgaaattcaacaacctcacgaggtaggtataaccaataataattctaggcggggcgtggtggctcacgcctgtaatcctagcacttcgggaggccgaggcgggcggatcacctgaggttcgagaccagcctgacgaacatggagaaaccccgtctctaataaaaatacaaaattagccgggcgtggtgacgcatacctgtaatcccagctactcgggaggctgacgccggaaaatcgcttgaacccgggaggcggaggttgcagtgagccgagatcgcgccactgcactccagcctgggcaacaagagcgaaactccgtcccaataataataataattaataataataataataacaataataataataattctaaagggaagcagagggatctggcgggaaagtgccagcaaacctaacaggcctccacaagtgtctttaaagtttcataggggtcggtatatgtgattaactgccaaagaagaatattcgccgtgtgtccgaaacgcagtcccctggggcgccacactcggagcctacttgaaccgaagagtccctccctgggccaacgaaggacccaattcccctcgccccggatccagcctctaagtggtttcccgggtaaggtcagcagaggtccgccgcctcaaccagtcttgttagagtaggcacaaaagcattcagagtgactgccactgtagccactcaacgccgagcctaggcctgctttttttgcagttagagtgaaactttccattggtggagtcaccccaaaggaggcgggacggagcgggaaagtcctgcctaccttggccttcccagccaatcgcagcatctatgcgtcagcctccggttcggttgcgctgcgcgtagtggtctgggcgacctgagggcggggccgggagcaggccccgggctgtggggagggtgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaccggccggcagccccgactgctgcggtgacagtcgaggtggaagctcgagaggttctctttatatcatcttatgggtgtagctagagacgggcagaaccggaagggccaactaggcccaaaacctcatgttaaagatgattgctgctttttttcataggacttttgggttttggcatttcctgaaggttattttcattcattgttattggaagaagctggatgctcctgtgatagaaaattcaggatttcagtgtcaggcttaagttaggcttacgcttaaaagcttgaaagtttattctttcattaggtaatattgttatgtacccaggtattagaagttgcgtcttgtttattggaaagccaatacttgtttcccttttctaaagcttgcatattctgggaaaaaaaaccctttgaagaacgatataacatctcatacttactttccacatagtttccaacatgatgataacagctatcaattgttcagtattttcaaagtgctagacatttgcacatttaatcctcagaacaaacccatttatctagtaaatggcaaggtggggttttgaaccaagctcacagcccgtacagtactgcttctcaagtaatttaagttcttgctgctaaaagtgtggtttgtggaccagcagcattggcagcagtaagcaagggttggcatgctttttctgtacaggaccacatagtaaatattttcaactttgtagactagagaatctctgttggagttattcaactcttcaactctaccattgtaacacaaaagcagccttagataagatcagcttccagcatgacagcttaaggaacccattcctctgtaaaactggtgaaaattcttttttgttttgtttcgttttgagacagaatctcactctgtcaccgaggctggcatgcagtagtgtgatcatggcttactgcaaccctgaccaacctccctggctcaatcagtcctcctgcctcagcctctcgagtagctgggaccacaggcgtgtgccaccacacctggctaattttttttttttttttttttttgagacggagtctcgctctgtcacccagagtgcaccgggctagagtgcaatggcgcgatcttgtctcactgccacctccacttccaggttcaagtgattctcctgcttcagccttccaggtagctgggattacaggcgtgcgccacctcgtctggctaatttttctatttttagtagagacagggtttcaccatattgggcaggctgatctcgaactcctgacctcgtgaccagccgacctgggcctcccaaagtggtgggaaagtggtgcgattacagatgtgagccaccccgcccagcctcacctagctaatttttgtaaagacagggttttgccatgttgcccaggctgatcttgaactcctgagctcaagcaatccactcgccttggcctcccaaagtgatgggattacagatgcagccaccacgcctggcccaaaaattctttttttaaaatcaactatttaaaccctccggcaatggtcctgagggcaaacaacaaatgaaaaaacacctattcaagaaaatctacaaattcggtaagaaagatgagagggtatggtatttgaaccaagatcattccctccttactcactcctagcttagtgaggtggagcttctactccagactattgcaaactgtaataccgggcactgctcccccagctcccaatcaaatgctttcttcccaggaaaagcaggacatcagcatttctcatcctacctagagctacttgttgctgaggttaaaacctgtgtgagtgcaattgaaagttggagctctctttttttttcttttgagacggagttttgctcttgttgctcaaactggagtgcaatggtgtgatctcgcctcaccgcagcctctgcttcccgggttcaagcgattctcccacatcagcctcccaagtagctgggattgcaggcttgcgccaccatgtctggctaattttgtatttttagtagaggcagggtttctccatgttggtcaggctggtcttgaactccctacctcaggtgatccacctgcctcggcctcccaaagtgttgggattataggcgtgagccactgtgccctgcgaaaagttggagctcccttcttccacctagtccctacttgtggaacaggactgtaccttggacatgacatactgaaattactggtgccccaattgctcatcccccagttcttgcaggctgagcctcaggttattgcggtcccctgcctccttccaccaagtgctcagttcctagagtgagggtatttctcagagagaatctttccagggtccttccccacagctccagagccttggctccgggattttgcctcaggagagaagcaggccctaaaacagatagctcctaatctctttccaatggcagtgacttcatttgcaacacagtgtggagaaattcatgcctaagggcaatctggagatgtgaaggttttggtaagaggcaactgggagatctgcggatttaatggagatgcagcctagactgtaggcctcctggtttgctggaaagaattggggaataagacagctggaagaagccattctaggatcagaagaaggatcaaacattgaccgcagcatggtggctcacgcctgtaatcccagcactttgggaggctgaggcaggcagatcatctgaggtcgggagtttgagaccagcttgaccaatatggtgaaccccatctctactaaaaatacaaaaattagctgggcatgggggcatacacttgtaatcccagctacttgggaggctgaagcaggaaaatcacgtgaactgggaggtggaagttgcagtgagccaagatcacgccactgcactccagcctgggtgacagtgaagctctgtcctgtcacaaaacaaaacattgaccacagacctctgaggtggtggatgtccctcctgtcctggttgtatcattatacattgtatattaatgtatcgaaatactacaggtacccccaacatgtgtacaactattatgaatcaataaaaaacaatttgaaaagtaaggtatgtggcagaggtggaaaaaaatgctttcctccaaacagccacaatttgattgtatcagtttgtagagtaagagcaagttatgcctcagtgtgttgttgaaaataatagaacaatatgccacaattagtggagcttcatagctgggtgtggtcaaggagagaatagaagagaaccctaccaaaaccactgtcatcccagggtgactgtgagcatacccaaagctgcacctccctgaagagcaatatcataggccttaacacttttcaggggaaatggatttcactcaaataatccagccagtcgctaaacaaataaataacaattggccctggagagggggtaccaatccccagagttgctacagtatattatctaaaatgtccagtttccaacaagaaattgtgagacgtacaaagaaacaggaaaatatgacacatacactggaaaaaagctggcagcagcaactgcctgtgagacaaggggccaaattaatgaaaaaggcttcaaactggcctatatatatattcacagtactatatatattcacaatactaaaggaaaatatgatgacaaagaagtaaaggatggtatgacactgttgcatcaattaaagaatatccataaagatatagaaattataaaaaaagaatcaaatgaaaattctggagttgaaagtacaataacagctgggcgcggtggctcacacctgtaatcccagcactttgggaggctgaggcgggcggatcacctgaggtcgggagttcgagaccagcctgaccaacatggtaaaaccccgtctctgctaaaaatacaaaaattagccaggcgtggtggccggcacctgtagtcccagctacgcgggaggctgaggcaggagaattccttgaacctgggaggcggaggttgcagtgagccaagatcgagccactgcacaccagcctgggcaacagagcaagactctgtctcaaaaaaaaaaaaaaaaaaaaaaaaagtacaataacaaatttaaaaattaactagagggactcaggactcaataacagatttgaactgggtgaagaaagaattcgttaattttttttttctttttgagacagagtctcgctctgttgcctaggctggagtgcagtggggcaatctcggctcactgcaacctctgcctccctggttcaagcgattctcctgcctcagccaccgcacagtggctttgggagtactctgggaggctgaggtgggtggatcacctgaggtcaggagttcaagaccagcctggccaacatggtgaaaccccatctctacaaaaatacaaaaatttagttgggcatgatggcgggtgcctgtaaccccagctacttgggaggttgaggcgggagaattgcttgaacccgggaggcggaggttgtagtgagcagagatcgtgccactgccctccaacctgggtgacagagcgagactccatccctgccctgaaaaaaaaaaaaaagatgtgaaacacatacaaaaaaaagtaaaatggcagttgaatgccaagtaattagataacttcaataaaatggacaaactcctagaaagatataaaccaccaaaattgacccaagaagagacactatctgaatagacctataacaagtaaagatattaaattagtaattgaggggactcgtggggtaacttgcccttgggaaccagtagtatggcatcgggctgcaagattggcctgtccatcctcaatgctacctggccaatttaggggcccagtgcctctggatgctagactctggggtcgattatctccaccggaatgtaatggatgaacatgcatgtgatggtgtccaagccagaacagtgggtaaagccaatggctataagaggagccaatcagtacatctttcatctcgaggaaactgagaacccaggggctttgattaaagacattcaggagaatgggatgaaggttggccttgccataaaaccaggaacctcagttcagtatttggcaccatgggctaatcaactaggtatgaccttggttatgacagtggaaccagggtttggagggcataaattcatggaagatatgatgttaaaggttcactggttgaggatccagttcccatctttggctatagaggtcgctggtggaatagatcctgacactgtccataggtgtgcagaggcgaagctaacatgattgtgtctggcagtgctatggtgaggagtgaagaccctagatctgtgatcagcctgttaagaaacatttgctcagaagctgctcagaaagattctcttgattgatgaaaccttaaggagcccaatgtttgtttatgaaatctcctttttactggaaaacaggaatattgactaccaaatcatagtgtagttgaagccattctgcgtttttgagcagttattcgtttcagtgattataattgattgtgcagagtattctaagaagttagaaattggtgtgtataactacattttcagtgatgcaatttaatgattagtgagtgagatactgtttttattgagagccttgatttttataaagagtaaaaatatggctgcattaagggtacaaacagaaaagtgtcttaatgtctaaggagggcatattagctacactataaaaacaatttttttctgtatttctgaaaagaattttgttgtttctcagttgttttccaaaagcaaaggaagtcttaatgtttttttctatttcgtgttatgtgtgatttgtttatatgcttggtaatatgagtctaatggaatttaaaaatataagtttgggtaggatagtatacccttaaaaaataaataaataattagagagagagagagagagagagacctgggcacagtggctgttgcctgtaatctcagcactttgggaggtcaaggcaggaggatcctttgaggccaggagcttgagaccaacctgggcaacatagagagaccccaactctaaaatatacatactatatctaaactcagctaggcgtggtggtgtgagcctggagtcccagctactcaggaggttaaggtgtgaggatcacttgatcccaggaggttgaggaggcagtgagctatgattgtgccacagtgcttcagccagggtgacagagtgagaccctgtctcttaaaaaaaagaaaagaggctgggtgcagtggctcatgcctgtaatcccagcactttgggaagccaaggtgggcagatcacgaggtcaggagttcaagaccagcctgtctaatatggtgaaaccccatctctactaaaaatacaaaaattagccgagcatggtggagtgcgcctgtagtcccagctactcgagaggctgaggcaggagaatcgcttgaacccgggaagttggaggttgcagtgagctgagattgcgccactgcactccagcctgggtgacaaagtgagactccatctcaaaaaaaaaaaaaaagaagaaagaaaagcaaagcaaagcccaggcctgtacctactagaggtcctgataacttcaccactgaattctatcaaacatttcaagaaaaattaatacagttcttcacaaagtcttcaaaaatgaaaaagaggagaaaatacttacaaacgaattttatgagactggtattaccctgttgccaaaaaccaggaaaagacattacaagaaaagaaaaccatagacaaatatatcttacaaatgtggaagcaaaaatcctcaacaaaaatactagcaaactgaatccagtaacatataaaaataattatataccataaacaagcaggatttattccaggagtgcaaggttggtttaacatccaaaaatgaattagtgtaaataatgtaatgcattatatcaatagaataaaaaacaaaaatcaccttgtcatctcagtagacacagaaaaagcatttgacaaaattcagcatgtttttcatgataaaaacactaaataaactaagaagagaagagcagttcctcaacctgatacacagcagttatgaaaaacccacagctaacttcataatagtgagactgaggccaggcacagtggctcacgcctgtaatcctaacactttaggaggccaaggttggagggatcacttgaggtcaggagttcaagaacagcctggccaacatggtgaaaccctgtctctactacaaatacaaaaaaaaattagccaggtgtggtggtgcatacctataattgtagctacttgggaggctgaggtgggaggattgcttgaacctgggaggcagaggttgcagtgagctgagatagcactactgcacacaataggctgggcgacagagctcaaaacaaacaaacaaacaaacaaaatagtgaaagactgtatgcttatccttaagattaggaaaaagagagataagtctactttcactactgctattcagcattgtactggaggttctagccagggcaattaggcaagaaaatgcaataaaatacatctatgttggaagggaacaagtaagatcatctctgcagatgacatgatcttgcatatagaccctgaggaatccactaccaaagtattggaactaataaattattagtttagtaaggttataggatacaagatcattacacaaaacttagttgtaaatgtatccacttggaatgaacaatctgaaaaggaaattaagaaaattccatttacaataacctaaaaaataaaaatacttataacaaaagaggtatctttttttccatcctctgacagtttagtaaaagaaagtataaaacttatactctaaaagctgtaaaacatttttggttttgttttttaaattaattttttttgaaacggagtctcactctgtcgtccaggctggaatgcggtggcgcgatctcggctcactgcaacctctgcctcccaggttaaagcgattctcctgcctcagcctccggagtagctggagctacaggtgtgcaccaccatgcctggctaatttttgtatttttagtatagagggggtttcaccatgttggccaggctggtctcgaactcctgacctcaggtgatccacccgcctcagcctctgaaagtcctgggattacaggcgtgagctagtgcgcccagcctggccttttaaaatatttaattaattgatttttttttttctcggacttgcactgaagtgagaacaagtgcagtggtgcaatcatatctcagtgcagcctagaccttccaggcttaagtgatcctcctatatcagcctcccaagcagctcagaccacaggcatgcgcgatcatccctagctttttttttttgtttgtttgttttttaatttcttgtagagacagagtctccctgtgttacccaggctggtcttgaacctgacctcaagcaacctcccatgttggcccctcaaagtgctgggattacaggtgtgagccaccgtgcctggcctgtaaaacatttttaaaagaaagaagatataaataaataaataaatagaaaatagctcttgttcatggatcataagacataacgttgtcaaattggcagtattttggaaattgatctacacgtttgacataatccctgtcagaatcccagtttatttcattgtagaaattgacaagtctccaggcgtagtggctcatgcctgtaatcccagcactttgggaggccgaggcaggcggatcacctgaggtcaggagttcaagaccagcctggccaacatggagaaaccctgtctctactaaaactacaaaattagccgggtgtggtggcacatacctgtaatcccaggtactcgggaggctgaggcagggaatcgcttgaacctgggaggcggagcttgcggtgagctgagatcacgcgccactgcactccagcttgggcaacaagagcgaaactccatctcaaaaaaaaaaaagaaattgacaagtcaattcataaattcctatggaatcgcaagggacccacaatagctaaatcttgaaaaagaacaaagcagaaagactcacgctttgtgatttcaagacatactataaaacaactaatcaagacaacgtcaccaggcaccgtggcttatgcctataatcccaacactttgggaggccaaggcaggcagatcacttgaggacaggagttcgagaccagcctgggcaacatggcgaaatcttgtctctaccaaaaatacaaaaattaaccgggcgtgggggtgcacacttgtagtccaagctgcttgggagggctgaggcacaagaatcccttgaacccaggaggtggaggttgcagtgagtcgagatcgtgctattgcactccagcctgggggacagagcgagattccatttcaaaaaaataaaaataaaaagacagtgtggtactggtataaggataaatgtgtagatcagtggcatagaattgagagtccagaaataaacccagtggaatagagttgagagttcatggtcacctgattcttgacaagggtgcaaagaccattcagtgggggagaactgtcttgtcttgtcttttcttgctacatgccacagactgtgagaaggaatagtcctttcttttcttttttctttttttttttgagatggagtctcgctctgtcatctaggctggagtgcagtggtgcaatcttggctcactgcaacctccgcctcctgggttcaagtgattttcctgcctcagcctcctgagtacctggactacaggcgcctgtcacaacgcccggctaatttttgtatttttagtagagatagggttccactatgttggccaggctagtctcgaactcctgacctcgtgatccacctgcctcagcctcccaaagtgctgggattacaggtgtgagccaccgcacccggccggaatagtcctttcaacaaatggagctgagacaactggatagccacatgcaaaaaaaagaagaaattaaacccttacctcacactacatacaaaaattaactcatggctgggcacggtggctcacacctgtaatcccagcactttgggaggccaaggcaggtggatcatgaggtcaggagttcaagacgaggctggccaacatggtgaaaccccatctctactaaaaatacaaaaagtaggccgggtgcggtggctcaacacctgtaatcccagcacttcgggaggccgaggtgggtggctcacgaggtcaggagatcaagaccatcctggctaacatggtgaaaccctgtctgtactaaaaatacaaaaacaaaattagctgggcgtggtggcgggcgcctgtagtcccagctacttaggaggctgaggcaggagaatggcgtgaatccaggaggtggagcttgcagtaagccgagatcgcactactgcactccggcctgggcgacagagggagactccatctaaaaaaaaaaaaaaaaattagctgggcatggtggcgggcacctgtaatcacagctacttgggaggctgaggcaggagaatcgcttgaacccaggggtgagctgagatcacgccattgcactctagcctgggtgacagggtgagtctccatcccccacccaaaaaaaagcttaaaatggatcaaagggccagttgaggtggctcaccccagtaatctgagcactttaggatgttgaggtggatggatcacttgaggccaggagtttgagaccagtctggccaacatggtgaaaccctgtctatattaaaaatacagaaattaggctgggtgtggtggctcatgcctgtaatcctagcactttgggaggctgaggcaggtggactgcttgaggacaggagttcaagactaccttggccaacatagcaaaaccccatctctactaaaaatacaaaaattagccagccgtggtggcatgctcttgtagtgccatctactctggaggctgagacatgagaatcacttgaactcgggaggtggaggttgcagtgagctcagattgtgctactgcactccaacctgggcaacaaagcaagactctgtctggaaaaaacaaaaacaaaaacaaaaaacaaatgtggagaaatgtgaacccttttacactgctggtaagaccgtaaaatggtgcagccagtttgaaaagcaaactagttagccaggcatggtgggtcatacatgtaattcctgcactttgggagaccaaggtgggaggatcacttgaagccagaattttgagaccagcctgggcaacagagtgagaccttttctctacaaaaaatttaaaaattagccaggcgtggtggcttgcacctgtagtcttagttacttgggaggttgaggtgggaggatcacttgagcctgggagaggctatagtgaggcatgactgcaccactgcacctccagcctggtaatcaaagcgagaccctgtctcaaaaaaaggaagacaattagctgggtgtggtagcgttcctctgtagtcacagctacttgagaggccaaggtggtaggattccttgagcccagaattttgaggttgcagttagctgtgattgtggtgctatactccaggctgggcgacagagtgagacccagtctcaaaaaagataaaaagaaaaacatggtggcagttcctcaaacagttaaacacagagttaccatataaccccacaattcaacttacagatgtcttctcaagagaaatgaaaacatagctttacgagaaaaacttatatgtgaatgtttatagtagtattattcataatagccagaaggtagaaacagttcaaatatacatcagctgatgaatggataaacaaaatgtggtctatccttactatggaattacttggcaataaaatagaatgaagtaccagcacgtgcttcaacatggatggaccttgaaaacactatgctatgtgaaagaaaccagccgcaaaagaacacatatgattccattcatatgcaaatctaggataggcatatctacagagacaaagtagatcagtggttgttcagggctgggaaaaatgggtggggtagagggtgtgatagctgaaatatacaaggttttatttatgaagtgatgaaaatactctaaaactgactggtgatggttgtacacactgaatgtactaaaaactactgaattatacactttaaatgggtgaattttagggtatatgaattatatatcaagatgtttaaaaaaaaccttaggcaaaatgtaaacaatgggcatgactgtgttccaagaaaactttatggacacagaaatttgaatttcacataattttcacaagaaaataaacattaaaaaatgtaacatgctgggcactgtggctcacgcatgtaatcccagcacttcgggaggccgaggtggacggatgacgaggtcaggagtttcataccagcctggccaatatgtaaaaccctgcctctactgaaaatagaaaaattagctgggcgtgatggcacacgcctgtaatcccagctactcgggaggctgaggcaggagaatcacttgaacctggaaggcggaggttgtggtgagctgagatcacgccgttgcactccagcctgggcaacaagagtgaaactccgtctcaagaaaaaaaaaaaaaaaaagtaaaaatcattcttagttctcaggccacacaaaaataggtggtgggttggatttgtcctgtgggccatagtttgctgatctctgatctaagttactatttgatagatgttagatgttgtgagagggtaagagagactagcctataaggaaagggattttagttttttgggggtttttttttttgagacggagtctcgctctgtcgcccaggttggaaagcaatggtgtgatctcagctcactgcaacctctgtcacccaggctcaagcgattcttctgcctcagcctcccaagtagctgggattacaggcatgtgccaccatgcccggctaatttttgtatttttagtagagatgggctttcaccatgttggccaggctgatcttgaactcctgacttcaggtgatccgccctccttggtctcccaaagtgctgggattacaggtgtgaaccactgtgtccatccaggaaagggattttgtatgacatttttcagccgcaattttgccaggaaaagctcttttttcttcattaagtagattccagacccaaagatgttggacagtattatcagctagagcaaggtttttcaaccctggcactattgacattttggctggatgattctttgttgtggggagctgtcttgtatgttctaggatgtttagcaggatctctggcctctacctactagatgccagtagcattcccccaccccatcccagttgttgtgacaaccaaaaatgtcttcagacattgtcaagtgtccctggggtagggaggacaccctccaatctcctctttctccctacccaacctccatgaccacattgagaaccactgatctatagaaaaggataatagtagtgacattcagagaggcaggatggtatagtgcaaagcttgccaaactttaattttacataaatgacctggggaatcttggaaaaatgtaggttctgattcagtagttctgggatggaagtgagaattttgtattaataacaaactctcaggtgatgatacctgtgccaccggcccaaggaccacactttgaatagcagagcagtagtagaaagtgcatcggctttgaaagaagacagacctgggcttgaattctagctaaaatacttctactttggacaagttacatagctctctggaccttattttctcattggtaaaatgagactaataatgctgaccctgcagagttcttataaggattcatggaatgcatagtccctggcagaaaggaagatataggagggactataattggcctaaagtaggaggctctggttaccatgggcactgccctgttgtgatttatcaagccattacacctcactgaacctcagatttccagtggaaaaacctgtttgtaaaccatgttcacatattctgttgaaagtaatcatagtttgatttatgatgatagggctcaggtaagtgattagttttattctcctgcctgctttttatgttgtccattaatgagcaaggtgctgatgcaaggagatggcagatgcattttgaaaaaaaaggagagagagagtacttgtagaattcttgactttattgaggtcaaatgtaggtggcttttcaagaaggactcaatttcagaaccggtggcatttaacatatgagtcatgttaccttatgctaataagttcagactttttttctttttactgcagagatagggggaaaaatctcctgcactacttgctgcattgctcaattggctggatgctttggaagatttttccacttgaaagatttgttgtttgtcattttgagaaagtgggtgctgagtgtaatttgccaggaggctaaacggctatgttatttcttatctaggctggaattttactctaataattcaatctatcagtaagaaaagccaaataggaagttgtaagagatcctaatactatcttatattgaaaacaaagcctccttctcctgttgtttggcattctaaatgttttcacatacctaagtgagattatgattgtattaaataccaacattgcagatcattccagcatacaagtggacgtaagttgtccataacagaaggaactttctaaaggggaagacagatagaacaattctggcattttcagtaaaatcttaaatcctaggctccctaggaccaggcaaaccatccccttcaaggatgtaaactctggagggcagtgtagttgtacagggtaatagttctatactctatattagtgcaacaagaaacttctattcctgtttcagaagtaagactgttatctacctttttttttttgagatggagtttcactcttgttgcccagactggagtgcatgatctcagctcaccaaaacctctgcctcctgggttcaagtgattctccagcctcagcctcccgaatagctgggaatacaggcatgtgccaacacgccctgctaatttttagatttttagtaaagacagggtttctccatgttggtcatgctggtctcgaactcctgacctcaggtgatccacctgccttggcctcccaaagtgctgggattacaggcacgagccactacgcctggcctgttatctacctttttaccgctgtgctctcccatgggttttttttgtttgtttgtttgtttgtttgttttgagatggagtctcgctctgttgcccaggctggagtgcagtggcgtgatctcagctcacttcaacctctgtctcctgggttcaagcaattctcctgcctcaacctcctgagtagctggaattacaggtgcctgccatcatgccaggctaatttttgtatttttagtagagatggggtcttaccatgttggtcaggctggtcttgaactcctgacctcatgatctgcctggctcggcctcccaaagtgctgggattacaggcatgagccaccgtgcccgacctctcccatgggttttaagtagtgcctatggatggcatgggtgccactactcaggtctaggacaggcaggggtgagtgatgagtgcgtgcgtgctgatgaaggggtgcgaagaaacagatgctggctagtgctgccctccactggaccccattctgcctttgtgtgggacaaagggctagggactagcagttactttgtgctaggtaccatgctaaatgctttaaatgcacactacctcatttgatataacagggactcatttattcattcaagagatattataaaataggctaggcacagtggctgacacctgtaatcccagtgggaggccggggtggccagatcacttgaggccaggagttcgagaccagtttgggcacatggtgaaatcctgtctctactgaaaacacaaaaattagccaggcgtggtagtgggcgcctgtagtcccagctactccggaggttgaggcaggagaattgcttgaacctgggaggtgagggttgcagtgagctgagatcgcgtcactgcactccagcctgggcgacaagagcgagactctgtctcaaaaaaaagacaataattaggcgtggttgtgcgcacctgtagtcctaactacttggtaggctgagacaagaggatcacttgagcccaggagttcgaggctgcagtgagctatgttcgtaccactgcatgaagcctgggtgacagagtgagactctgtctcttttatttatttgttttttaaataatagagacagggttggccgggcatggtggctcattcctgtaatcccagcactttgggaggctgaggcaggtggatccctgaggtcaggagttcaagaccagcctggccaacatgggaaaaactcgtctctactaaaaatagaaaaattagccgggggcaatggcatgtgcctgtaattccagctacttgggaggctgaggcaggataattgcctgaggtggaggttgcctgagattgagccactgcactccagcctggatgacagggagagactccgactccaaaaaaaaaaatagagatgggggtctccctacgttggttgctcaggctggtctcaaactcctgtgctcaagggatcctcctgcctcagcctcccaaagtgctaggattataggtgtgaaccaccacacgcagctctgatttactgggtgcccacgttgaccaggcagggaacacctcctagcagtgatcaaggactactttggacctaggttctgtaactgacttcatctttaagtggggaaacagaggctcagacaggatacatagcatgcttaaaggcttagtgcagccactatctattctgaaagaggcagaataggacagggacaggtaggtagtgagagaatagggagaatagatgggcacaccctttaacttaatatcgaccagtaaagcctgcagttgcttatttgaacctcacattgaggctgacatgtaagttgagcaaatcttaactcaagcttcagtttccttgttggggccgctgaggcagcatagcctagagattacaagcatagacttcagagtttgattcctggctctgcctctaaccagctttgcaaccttaaagctccttaaccccctcacatgcctctgttccctaactgtaaaatggtgaatgtaattaattcttcctgcatagtgttacaagaattaaatttgagtaattactggtaaagtacgtagaatagtacctaacacaagataagtgctatatataatggttgttacctaaagaaataacagcctgggcaacatggcgaaaccctatctctacaaaaaatacaaaaattagccggttgtggtggtgtgcacctgtggtcctagcatctcgggaggctgaggtgggaggatcacatgagcctgggaggtcgaggttgccataagcttcctgattgcaccactgcactccagcctgggtgacagagtgagaccttgtctcaaaaaataaataaataaaataaattaaaaaaataaaaaggaaataagttcagtgcctgtcgttagcttgctccctttctcagcctctcctccacttcctcacgcaccctcttgctctgagcctattatcctggtccctccttcacactgccacatctttgcataggctgttctctttgcctggaatgccattctcatttgttgcttggcagaactgaactcattctccttctaggctctgctcaagggtttcctcttctttgtgtccaaagtcaccacatagcttctaagtgatgggactgagatttgaagccaggtcatctgtctttcaggccagccctctttccactaccctatgctacccaaataggaagcgtaaaagagaagtaggagagaaaaagttagaaacctggagagaacttaggtatttggtaaacaggaaaaagaaagtggaaagaagagatcatttgaaggacttcctcaacttaacaactatttgcctatggcattattttattgcatttggtgtatgatactatctcaaaagcattttgtaaacttgccagtggcttacatttttgccggatgaatgacatgactaacgatccgtgctacattacctcagtgtctagtttgtcattttgaatcaagtggacattttctgtaagtgaatcattttcacttgctcatgatataatgagaattccttacctttggcttaaaatgaggcttatgttataacagttaagcattgtctagttgcatatttaacatagtcagaatgctcctgcctgtattcagcctggtgtcttataatatttggtatgcccacctagatagcaattggtaacatctttattctgagactctttcatgtatggattttgaaaagttagttaactgttcagacgacattgtttctttgacttttacaatccgcttccctctcactgacagttcagttttggaagaccctgtatttttttttttttttttttttttttttgagacagagactcgctctgtcgcccaggctggagtgcagtggcgtgatctctgctcactgcaacctccacctcccgggttcaagcaattctcttgcctcagcctcctgagtagctgggattatgggtgtgcaccaccacacatggctaatttttgtatttttagtagagacgaagtttcaccatgttggccaggacggtctcgatctcctgaccttgtgatcagcctgcctcggcctcccaaagtgctgggattacaggcgtgaaccaccgtgcccggccttttttttttttttttttttttcgagatggggtctcactcagactggagtgcagtggtgctatcacagctcactacagacttgacctgctgggctcaagtgattctcctgcctaagcctcccaagtagctgggactacaggcacatgccaccaatacctggctaatttttttgaagaaatgggatcccgctatgttgcctaggctggtctggaacttctgggctcaagcgatccttccgcctcagcctctcaaagtgctgggattacaggcatgagccaacatgcccagctagagatgtgtgtgaattggtagcttcaagctagatattggaggctcatgaagcccaggttaaagaggcttgtattcatcagatgcgatgaagagctttgaagtttttactagaagtgtgatttaaagtggttggcatgcaaaatgatttggaacgtttggggtttggggtagggagagagaggttggaagtaggaaacaattagaaggcaaacgctttgggcaaggtatcacattgaaacctgaacagcagtgggacttgctgggggttgggacaaaactaggcagatgtaagcatctagtgaatctagagattagggtgttctgtgaccaagaatgagcagaagacctgctaggctcaagattcaggagattctcaggtccaaagccagtcctcagtctccgaagtcagtcaggcagaagggaagttggatcaagctggccagagttgagctcaggaagtcagtgcactttctcttgtctggttcctgcatcgttttacttgtgtaaaatcatcaagatccctaaaccgatgtctgaacaccaggcttctaggcagagctccaccgtgtgaccttgggcgcatcacttatttcccccaggcctcagttcttctgaaagatgaggggaagaactcacattcaaaggccctcagctttagcgtcttattttaggtgatctgggcagaagagtctcactgtgctcctctccctttcatatttcctgctttggtaggaagtcatctcaagacttgagtgtataggcatgaggaagtctgctagaggacaggaagaatattgcttaaagaataagagctacagccctgatggaaggggtaaattggcctgggaaaagccctgcctctgctacctgcttcccaagtgaccttgaacttaactctttaaacctcagttgctgcatctataaaatgagaataatagtatcttttttatagggttttttttgttttgtttgtttgtttttagacggaatctccctctgttgcccaggctggagtgcagtggcacgatctcggctcactgcaacctttgcctcccgggttcaagcgattctcgtgcctcagcctcctgagtagctgggattataggagtgcaccaccacgcctagctaatttttgtatttttagtagagatggggttttgccatgttggctaggctggcctggaactcctaacctcaagtgattctcctgccttgacctccctaagtgctaggattacaggtgtgagccaacgtgcctggccagggttgttttgagacatgaatgaggtggacctttacaggcacttggttcagggcctgacccgtagtgagcatttgataaatgttacctatctatgttgtcatgggctgggagtgtgggaacaggaagtgtctcatgccagaagcactgtgaattttctcctttaatcattgccttcattttctttgaaccttattcagattgtccatgcctttgtaattgtagaccctctaaactataattagtccaaataaaatggactcaccttatgccatgttcttgttgaagggtcctctttctttctttctttctttctttctttctttctttctttctttctttctttctttctttctttctttctctttctctcctctttctgtctctctcttctttctctctctctctctctctctttctttctttctttctttctttttctttctttctcttttcttgctctattgccaggctggagtgcagtggtgagatctcggctcactgcaacctccgcctctgcctcccaggtttaagcgattctcctttctcagccttccgagaagctgggactacaggcgtgcgccactaatttttgtatttttaggagagacggggtttcaccatgttggccaggatggtctcgatctcttgacctcgtgatccacgctcctcggcctcccaaagtgttgggattacaggcacgagccattgcacccggccagatcttcttttttgtaacatgctaagtaatacaatctctatttagcttgatgtccacggtgatagcaggattcttttcggatttctgccatagttaattattctgcattcttttgtccctagtgtgtcatattgaaatttttcttttttctttgtttttgatgacttctccagttattcatgctagttttgcattcctgtccaagaacatttttgctgcttgtttatttttaatttcataaactaaagcgtttgaggttttaaaaacccagaattgagttttctcagagctgctaatctttctagccagctggtgacgaggcttctcaattcttgttacaggatgatgtgttctgtcctcctgtctgtgctttgtctaatttagattctaaatccacatgtttaggacatttttagcgtgtcaaaatttattaccaaagtagtgctgacttcagggaaaaatttttaatggaatctttagtcactcatgttgacacaaggtgcttgtcctagtgcaggaatctgtgtggcaccactaggtggtgccagactgcatcatttttaaagacagccttttctcttccaactcttttgccactgttctcttttttgcttctttgccaaatttggaccgagctttgaaaacttcatataaactttctcttagtgagttatgttgcttatagcttttccctccaccttgcctgttttagtcttcttgtttcaatagttttgatagtttgacattcagataaaacttaaaactgaagcccaaagtaattactaaatgtatctcgactgatctgtggttttaaattcaccaacagtgcatctccctacttgcttaatcatattgattttgagattaaatcagtctcataaatatgttagtcttcagcccacggtagttctcatccatctgcagactttttttttttttttttttgagatggagtctaactctgtcaccaggctggagtacagtggcgccatctcagctcatggcaatctctgcctcctgggttcaagcgattctcttgcctcagcctcccgagtagctgggactacaggtgcttgctaccacgcccagctaatttttgtatttttagtagagacagggtttcaccatgttggccaggatggtctcgatctcttgatctcgtgatccacccgcttcggtctcccaaagtgctgggattacatgtgcgagccaccacgcccagccccatctgcagatatttttaccagtcctatccactcatgcctgtaccttctaatgttattaaagtcagttttattatcattgatgaccatgagacttaatcaaaaggtcaagctagaaacagagaatattcaaaatttctttccaggcaaacatctgggttcaatagaagctagttcacatgaatggatcatgctctagctctgttgtgctggagcttttttgaaggaatgcattgttacatactaaccacaatttttacattgtccagggcaggagtaaccagttggttgatacttagtcaggggttgtgtttcgtaatctgctagttgtacttgatgtttaggcatttgaaatttaaccttgtgccttatttgtgctgaatttactattgtttcctatttgtagtgctctgcaaaattattctcagtatatcacacatttgtaatcattgccaatcactgaatatcaataacatgctaggtgataagaacttctatttttcagcagcattatcattcccaattttactacatcagagagttcatcattatacagtcaactcatgattattaggagtaaggaacgtaatagcagaccctgaatgagggaaaagaatgtgaaaccacacataaactaaaggtgaagtcatttacatccctgaaaatgattttaagatacagaatgagatgttaaaggatcaaaagaaaattatcgtagcaatgaaaaatgctacatggtttatacaaagtcatgtcaagctcatagactcagagagtggtgttaatcctgaagaccacttgatgattatggaagccgagacccaaagaggttaagtgacttacccagcacagcgggtttgggtgttttatagctgtttgactatatgagctatgattgctctcatgttgtgagctaaattccaaagatattgtcgtgtttgcttttgtggggactgtattgctttcatagcatgatggttgtattgtttctttttgctttgtcatctgtcagtcaactttgaagtgaatcttctttgtttacagcatagtaaaatatggtgattgcatggctcataagagatttacaaatgaagaaactgaggcccggttgagctgcatggcacacccaagtcatagacttgtgtgtggttgaggcagagaatctaggatacagacctccctgctgggttcctcccgctcccataactgctctgcacttcagcgggaaagatgccagaaactgcaagcataaggcctttttttcccctaaaaaactgtaattcatttggttttgaaagacttaccagagtttaaaagctccattttgtggcttcccaaggtgctgtgatttgtttcttactagtctcctttgttctgtggaaaattttcttctttggttgtttgagatttagatttccttgccaaggtatttttagagagaggaaatcagtatgtttcaccaaaggggtaaaatatataccttaaggcctaattatgcaattacatttttaataacgagtgtcataaattcttgcttcattgcaatcattaattggaagactgttctgctcagaagcctcatctagttatcatgattatcatcaacatcgtcaaccaaccacaagcatcaagcatttatggagtatccacagattatgcagcacttgccagggttctgggagacttaatctgtgtgtgtgtgtgtgtgtgtgtgtgtgtgtgtgtgtgtgtgtgtacacccttgccttcaaggagtttgtgatctgcagaactggaggaaagacagaaaacttggggaaagacaagtacctcatttttcaatatgtgtaaagcccatactgattcatgtatgtggcattgggggacatggacagcagggagacaaagggatagatcttagaaaggtctagttacaaataaatggaagcacataagtttgctgacatgggaggacataggctgggttgtaataaggtagggtaattggttgaaggagggaggaagaaattggtgaagagttgaaggcagtaattaaatagatttggcataataacagagatgattggagaactgggagaagaaaattacttgctgtagttgattatggcagaaactgacagggcaagagattacagttgggattttttgcaaagaggagctttcaagtttgtgacatctttttttttttttttttttttttgagatagtcttgctctgtcaccctagctggagtgcagtggcgtgatcttggtttactgcaacctctgcctcccaagttcaagcgattctcctgcctcagcttcccaagtagctgggactacaggtatgcgccaccacgcccaactagtttttgtatttttagtagagacggggtttcaccatgttggccaggctggtctcgaactcctgacctcaggtgatccacctgtctcggcctcccaaagtgctggagttacaggcatgagccactgcgcctggcctccaagtttgtgagatcttgcccagatttaaatgaaggatgtggggttcaggattggtacagcagaggaaaaaagtctctctctctccccactcccctctttttgctgtgatctattttttttcccacacttttcacaggtgttgtcctgtgatctatttctatttggtggatctcttttcccctcatgttgagaataatggctgaggtgtggtgtatcctttaattttgaaaggaaacggcatgatggttttgcggtttaatcatgagacacaagaacagcttttgttgtgtggtgataccataccctgaattgagattatcagtgtcagacatatattactgcacttttttatcttcttcgcttaatcaaaatagattttaatggaatttattattcacttactgtacagtaaaattacttttataactttccattgtgtttttcttgtaaattgaggtatttggcctctatttttcaaaacagacaaaagttgtattcaggttaggtttggatctggtatattagcatcttaaattctcaagtctcctataaacctgttctcttaggccagctatggctgcagaagtcagttatagataaacattgagaggggagatcacatcatcctttgttttccatttctgaaataacggcagacacgtggcacatgtcctgagcctggggtggtgccgttccttttgttgctctatctgtatgggagctaaccttttgacaatttttatggcaaatgctagggcagcttgtgagctaattagaagaaactgataagtgaatgctgagtttgtcgattctctttcattttctgcagaggagacagccgttgaaacggcattcttcgtgtggctgataatttagcccaccagacccctatgaaagggaatattgcttctctcttagctttttccacattttagtattctctttaaagccaacatttctccataggttctaatacctaggcatttcatatatagtagccaaattcagttcactttcttcaagaaagttgtccttttcaaactgtggccttttcctgtcatgggtctggtttcttactcaccccgcactgttgtatcagcaggtactaggatttgattgctgatgactgtatgtcccaaagaaaacagtgggagaaatgcagctgtcaaagcaaaaaacaaatagcagttttaaggttgagtctcaacctggccagttgcaagatggctgttcagtagatgttattcctaatgcttccctggttaatagaactcaatcagtcctgcaggttattggtgctggttgcttcctataacagaaaagtactgcattccagctacgttcctgctgtggaacataagtgcttagtgctatttacttaaaacattctaggttgataaattacaagcccttcactctgggtaaagctcataaatccagctcctacaaaaaaaatagcaagctgatagcacttagtcctgtttataaagttcatacacatctatccatgatataggcacaagtatatatctatgaaatagcactgcagcctgttaaagtaatgggtgagcacagccacaaaggcgagaagcatccgacttccagactcctcctattagtctctatgcctgaagggcaccttgaggaggaggtctgtggaagggagcttccaggcattggagtccacatttgtgctcctttctctctttcttcttcccgcaagtcacctttctcacgccctccacctctctctttccttctgcaaaatgagcatctgcctcttagcctccctcttcgtcactaggctgagatgaggcagggaaccgtggtggatccagagcagtttgaacactttggctgcgtggaaagcgatggggttaaatgagcatttaatcagaaccaggagctgttcttttggcaacctgttgaggaaaaatgataaaccctaacaaaaaggccctcaagtggcacgagtgcagggcctgaaagcgttacgtgccatcagttatccaaaaagaacattttttaaccagaaaataaacatgagactcatcccactagtcctaggttcttggagccccacaggtattgttgcaggatgcatcattgcttcgaatcagtgactgaacaacccagttcctaatcagcgtggagagtcagaattgtcacacgcactgggctgaagctgcatattcagtactgcattgaacattcagtactgcagataggataattatgctgtttgtcagatactagaaaagtgcaaagaacattccttcactttgcaacagcttggacccaagtggcagacctgctgttccctcaggctggcgtgacctccctattgtcagccccttcaccacagctcaactacccccctggctttcaagatacagctcaaacagcatctctcctcaggaaagaccttactcccggagacccaggcccgagttgtgttgccactgtaccctgttctgttagcacttaccaggttgcatttttgtgatccatttacctgtcttccctgtcagacatgaacagggacagtgtcttgtcctcaattcatcatttttctcctgttttgagcacaatgaccaggacgtagtggatgctcaataaaggtttgtcaaatgactgatagtatggttagctcagtgagaattgatggtgccctttgtgatctgtcatccatcatccttggtgtgaagcagggctgggaggctttaaacagtgccacttgagaatctaaggagaggtggcagagttacaattaacaataactaccccttactgagtatttatttgctatgggccaagcactctcttagggtttttaaatgaatcaatgcacttaatccttagatcaatctgctaagacgagttctgtttattatcccctttgcaaagcacaaggaagttcagtcacttgcccaaggtcacacagtgacagtgcagagattcataccaatggagacaaccatcacttatctatattccttttagactagttcctggaaagattaagccctcatgtcctgaggcatccatcttaggtaacaatttaacttctctcttgtttctagaatggtattagtgtgttccctacttgggagaatggagaaaatggtcaccagataactttctgtgttttttggttcagatgagataggtagagttagttgacaaagaattgattttatgtatttatttttattttgttttttttgttcttgattttagatggtagtttcggtccttttggaaacatagcattatcctccagccagactgaactatcctactcccatttcctgtaaggacgactgacctcttttttgcctctagacttgtgcatatgctattccctctgcctggaacatacttacctgcttgctcctctttccccaagcccagtcttcacttggttcctcttttctaccatgagccagtttagatgtcatttccctacctgcccaggataggaggttcccacagccgctgggtgtcctgttgtggcactcacaagtgttatagtgctgaaagcccactcctggggtttttatgtgtgcgatgaaggaggtgattatcttttcccagctagttcatatcctagtcctctgagtgtagagacttgtttctttttccccatttgtcccctgcaccttgggcggtgcttggacacaatgtgtgtgttcactaactatttgtggaagaggtgggtgagcgggagttaactggctttaagtctttgagttttgggtttttgaagtagtcaagtccgtccacagtccgtcctgtggacagccattgtttgccatgtcttgtatgtacacacttgcctgggcactgtggggagcagaaagaggactaatactgcccttgtgctgaggcacctacagtctcgggagatgttcagaggacagtgagtcacttcacagcatcagcatggtatagtggatgagtgatgacactgaagatgagcttggtcatattctggcaagttggctgacacctggaagtcccgtccacaccccaagacctcttttcccagggtgtcctgagaaccacccagagcaactgtgaccaatggcgcttgtttttaaagaagtagaaacccaaattaggaagactgagcaaacctcatgcatttggggaagggcttgttggaaagtggaacctgatgtaggtagcaacatgttgaggttagatttaaccaaacagaaagacttcttaattgcttaaagacaaaattttattttataagtggaattagggctttaaatcaaatatgtttgaacgtctttacttggtttcctcaggcaccttcactcatcttgtctaaaacttaattgctggtctatccctgccagatttgctgcttctccttgattccatctctcctttagtggaaccacctggtactcaagccagacacacaggtgtccctcttaattctgtctcctctggtcctgttcaggcacctgttctgtgactctgcctcttttccgtttctcaggctgccttctctcccttctactgccttccttatgtcaggggttggcctactttctggccttcttgatccagggcttcttttgttcaactcatactccaccctgttgtcagagcccatccagattgcagattggagcctatgactcgtctgctcaagggtcttcaaagactttgcagcttttggctgaagttgagccacctggtcccaaatggagccccattcccgccatgccacctcctgtctgtttaagctttacaagatgacttgcagtttcctgtagaaagcatgacttttaaaaaaagacttatttccttctctcctgcatctaactctcacttgctctttaaagccttctctgacctaggtcttgcctgtttctcctgcagaacactgcttccaccattttgtagcatcagtgtctaacattggttggcatgtagggtgtgctctataatccttgttgaaagaataagtgggaggtaacagaggcttaattcacattgagctgtaaacgagcaatatctgactcttctgagaatggattttgtttcaaacactggttacttactggaaaaggtgtctggggagtgctggacagcaagaacaaagggaccccacagaacaggaaaagaggcactctagggtctgcggtttgcctatgttagatcaccgtgaaaaaggccagtgtatgctttggcagctggcaaagaatcctgtgactcagtttccttatttgcacaaaaagggtatgagtctacattaggtaattactcatgctcatttccaactcttgacagtctacgatcctttgtgtcaaagttaaaaatctaagtagggcattctgaattggtgtcagagttgatgcacttctcactgtattgcaagtgccaaggggacaaatacattgtctttttgcattcaacaaagacagttttgcattttaaaaacaaagtagaagggaatacaggaaaactgcattaatacaattttatgctggagaatttaaactcccatgtcaggaaattcactcatcattcccttggcagcttttgtttctctgcactgcacaccccacttacagacagccccttcttgccaaagcccagcccagccatgaccatgagttatggcagattgggaatcgttaccttgatcttctcaacccttgggtgtttaccttttccaagttaatgcctgttctttaatgttacattatcttgtagcaaggtagtcatttataatttatatactagagctgccttaaaatagagacaagaggataatcagcatcctgaaacttctagttttccaaaataacatttcttcagtgaagtctgcctgtaggaattaaaacttttggtgaattaaaaagctttttgtcctattgtcagactgggaaatggatgtgcccattactcagccttaaaaacgaggaaggagatcatctgttaaaaataaaactcatcattttcttttattcttctcaaaataatccctaaagacctcaatctttatagtgttccagtggccccactatagtcagagaggagacagggcagaagttgaaggacagataggagaaacggccctgctaaaagataaaagccagtatgcatctcagctacttgtctgctgtggtcctgatattcttccatctaggttgctgctttgcttgactttgactgcaaacacagagaagggatgggctttcctgttgagtaccttgtagagaacccactgttcattcatatgtgttaaaaatgaaaagcctacttgaaaactcccctgtagaatcaggttttagcaaaaaccaatcaggtatcagaggtctaacttatttttcccttcttggttttatagcaagtctctaaaccctaagattttttgtttgtttgtttgagatggagtcttgctttgtcgccaggctggagtgcagtggcatgatctcggctcactgcaacctccgcctcccggtttcgagtgattcccctgcctcagcctcccgagtagctgggactacaggcatgcgctaccacacctggctaattttttagtattttactagagacagggtttcaccatgttggccaggatggtctcgatctcctgacctcatgattcgcctgcctcagcctcccaaagtgctgggattacaggtgtgaaccaccacgcccggctgcctaagaatttttttcattccttttcattatatacatcttcagtgtgccaagactttgagtggagatttctaatgagggcaggaagggacggatgcttctgcaattgagtggtctcatttttcccatgtctgtcgaaagattactctttcatgaccaccatttctatgatgcatctcatatgatcctaatgcactcgagtttgtatttgaatgtccatctgatatttaggggtggttggggcaaggagggggcaagcagcaactaaggggttgtatgggaacatcctggtggtttaacttgaaagccactaggtggcaacatttactaagttgccagccattctcttcccttaagacattgaacttgcttttccacatagcagatggaatagctgagaaaagagattgccattgcttcaggttcttttgaaagtgaggctataggataaacacactacagtatattgatatctattcgtcacctgggtttagataccaggagtttgaatttgctctgggtgactgggtgagtagcttcccctttggcctcagttaggcatccttgacaggacagacctgtgattggactgtctggtctctcatggttctttttctccatgatttatgactttgattatgatttctttatattaaaaaaaaacttgtagtaaaaccagtcttatttaaaggaatactagccttttatcaaagggcaaagtaatgatttaaaaaaaaaatcaacaacaaaatttcaagggaatgaatgtccctagaagctagccatctccccgagttaacttaagaggctagactctcctaaatgaggatgcttatttaccagctttcctaaattagcagctttggagatgttaaaatccgtaaggaactgtccaagggatgtattgtgtatgctttgcagtgattaagccattaagctctaattggtattttcccactcatgggtttgtaaaggaagctttaaaattatttaggaattcagtcctcatcagctgtcttagtgtcatccccacgttttggaacctgagagtggagagtgcagagaaaaggttttattaatgatttttgctcacagtgtccttccccattggtttgttattgcagatgaagtggaaagggaaggacctctttgatttggtgtgccggactctggggctccgagaaacctggttctttggactgcagtacacaatcaaggacacagtggcctggctcaaaatggacaagaaggttgggctagaactcgatgaaactggtggggctgacgtgagctttccagtttttccctgagcaggcgcctagctcatcactggggcgctgtagctgtatagtagagaagggggcacattcctgaattaagtcatgcagaaagcaggacgtagagatgctaccagtttccttctcctcacaggctctcctgggcaagcagaagttaccaggattagactgctgctggccctggcttctttacccattgttaccagcctgattgcttctggctttatgcctttcagtttatgaataaaaacttcatgaataaaaattactgttatcttcatatacttaaaaataaccaatttgtgtcttttagagagtattggggcttgtgttctttagggaattttttaaagtctttttgaggaacaccatagtctgacatgaagtaatcattaatatgatctaaggaatagagagtgcctggtccccagggtgaaagaatgtccattttgtcctcaggattctctggggcttctgacacatggccaagaaagctgggctcctggcaattttaatgtggcttggaaatgaatattgcctaaaggaactgccctctgcatgggttcatatgttcacacaaggatacacttgcttactgacctgcctacctagccatgaaaggcaggcggggagcaggaccatatgcttttgtcagtaactcctaaaagacacctgaacttcaaagtaagtcaatgtctaattcttaccccaaatgatgccccctccagttgcctacctgagcataataaataatgaaagcttcctattttttttttttttaccagtttgactcaaagcttaagtgttcgaattgtgttcacatatgtacacagtaatctaaataatcacatgggaatccctgctggttgtaagttcaatggtaattcccaatgatcatgagcatctaagtgccactgggggccactgtcagtgagggtgtcgtagaccagattttgaatctccttggcattgccatctagaatttgggcaggagcatggagagttatgtgtcaaagacagcaaaactttttgtatgtttttcatgattcttagcaaagtgaattttaatgatagctgagtgtaggccaaatggatattagactgggggcatcaggagccgtggaacttgctgctcaagggaaatacatcatgacacatgttaatggagccttgtagcctgtcacatggcgtgtttatgtcttgaaattcactctggagagcagatggttcaagctttacaggggtgaatggaattgttagaagatttaaaggcagtggtttacagactgtgcttcaagtattttgtggggcatctctggaggttccttgaaacaaagggttgccatgatggacacattttattctgttgctcagttaatgtttagatgacttcataatgatctagttcatcatctctaagctgtattttttttttttttttttaagacagagttttgctcttgttgcccaggctgcagtacaatgacgcagtctcggctcactgcaacctctacctcctgggttcaagagattctcctgcctcagcctcccgagtagctggaattacaggtgtccaccaccacacctggctaattttttgtatttttagtagagatggggtttcaccatgttggccaggctggtcttgaactcctgacctcaggtgatccacccgctgtggcctcccagcgtgctgggattataggtgtgagccaccacgcccagcgctctaagccgtattctatcacggacctaaatattggcagtaggcaccaagaaaaaagaaataaaggaagattccactacttcagataattaaaaaaccttccacctaccataaaggacagtgtccaagactgctgagtgatacatttctagtttttaactattctgtggccctgagaacatttatgccttaatcctagctctgctcacttcttggggctattgattaatttgtttcagaaacaccataggaagtgaatattacctcttgctataggtgactttgtgaatacttcaaactgtaaaatcacaactttcaggaaatgtgataaatttagtgggaaaaaaatttaatgcacgccttgcaaaggcttctttgagggtagcacaggaggaagtgccaatatagtgtgtttgtcttttgctctgcaattctgcaggtactggatcatgatgtttcaaaggaagaaccagtcacctttcacttcttggccaaattttatcctgagaatgctgaagaggagctggttcaggagatcacacaacatttattcttcttacaggtacatcagtcaaggctaccccccagttctgagagaacttgcccaggagtggttgcagagttggcctcagagttgaccacaaacacctttgtattgcaaaaatattctacctctggaaggtcagcccctttggttctgtaatggaaaaaaggcttcagaacagaactatacttgagtgatgaaaattggtgtcagatgaaattgtgaaggtgtgatggtgaagaatggatacaagtagctacctaacttaaaacctccttgaaaatgggtcctattttcttctagctaacttaaaagtactcaatagtttcaaaggaaggctaaagagagagtcttataaagcagtagttcttccaaaagtttaaaatctgctctcattaagagaggactggccgggcatggtggctcaggcctgtaatcccagcactttaggaggccgaggcgggcagatcacaaggtcaggagatcgagaccatctggctaacatggtgaaaccccgtctctactaaatatacaaaaattagccgggtgtggtggcaggtgcctgtagtcccagctactcgggaggctgaggcaggagaatcacttgaacctggaagatggaggttgcagtgagccaagatcgcgccactgcactccagcttgggcaacagagtgaggttccgtctcaaaaaaaaaaaaaaaaaaaaaaaaaaggacttcagccgggcgggttggctcacccctgtaatcccagcactttgggaggctgaggcgggcagatcacgaggtcaggagttcaagaccagcctgaccaacatggtgaaactccatgtctactaaaaatacaaaaattagccaggcatggtgatgcatgcctgtaatcccagctactcaggaggctgaggcaggagaatcacttgaacccaggaggcggaggttgcagtgagccaaaattgagtcacttcactctagcctgggtgacagagtgagactctgtcttaaaaaaaaaaaaaaaaaaaaaaaaagaggacttcagagctctagtgacacttggtttgtcccccatatgtggtacttcagacatcgtgcttcatgctatgctgtgtctctaattgtcctatttcttccttaattcctcattagattgtaagccccttaaaggcaagcctcattaagtacacagtaggcattccataagtaattgtcccaccgaattgaagaaattaagaaattcacaattacaggttgaccatccagaggcacagggaggggaactggtctgaggatgaaaaccttatcagtttcacttatgttcttactgcaggtcagagtggctccccagtttcatggccagttgcagtgattggcactggggctatttgtgtgctcaaaggtttcagtaatgtaaaagatggcagtaggggcattaattacatgatttcccagagatagttgggtagtctgtcacatagccctcctgtaattaatttcagcctcagtatattgtggtcagcaaatattaagttaaatataataaaaccccctaaattctttttaaaaaaggtctggggggcgtgtgtgtgtgtgtgtgtgtgtgcacgcgcaaaagaggtgacaaatttatttctgatgtttgcagatcaaagggacactcttaggctgggcgtggtggctcatgcctgtaatcccagcaatttgggaggccgaggcgggtggatcacctgaggtcaggagtttgagaccaccctgaccaacatggagaaaccccgtccctactaaaaatacaaaattagccgggcatggtggcacatgcctgtaatcccagctacttgggagactgaggcaggggaatcacttgaacccgggaggtggaggttgcagtgagccgagattgcgccattgcactccagcctgggcaaccagagtgaaactccttctcaaaagaaaagggatgttcttgcagtttttctatagcgttgctttttcccccctctctttggaaatgaaaccaagggattagaaagttgcactgcttgagaaacatctcaggtttcattttctctctaagaatgtaaaatcacttttaaaacctaagaagaatttttgtgtttgaacgtaaacacctaacaatctcctaggtcccagaatgtcctaatgttatagaaatggctttcttgtaagtacttggaagcactgcctgtctcttgtgtgactgacttgattttccccatactgaaatgttaaggcatttttatgactgagcaaggcaaaatttactgcttttatgaatccggtgactgttgacatctgtgagaggagagctggctttcctgctgtgtttatttcagtgtccccctgccacgtcatgcagttgtcttgcttctgtgtctggaacatcccaagttgcaccattctaagaaaattaagtgcaatgaaatatgttaattcaacattatggcttaagaattatatttcctggacctcacgtgtacttaaaagttgaatcgatcaaattttattgcttccttttcccttagagcagcacgttgagagtgatggttttttctgcaatcataactcagtggccttggtgacttttgtcttgtgttaatacttaaaagtagatccatttcctctggggccatgcatattcaaaggggctgaggctgtagtcatccccagagctgctcttgacacttcttgagttcatagcgctctgtcacacagcctctgttgtaactacagagaccgtttttactcttcagcattgatcatgaagagaagagataaggggtttttatgcatagccgtcataccagtaacttctgtgactgaactctccacctgtctgcatcagtaaaaaaaaaattgtaccctttgtcagaaaattattaacaggctgctctggcagccctcattagaacgccgtgaggccatctgttgtgatcagcctacacacctcacttccactcacagagtatcatgtctcccttgttgctcctttcaggtaaagaagcagattttagatgaaaagatctactgccctcctgaggcttctgtgctcctggcttcttacgccgtccaggccaaggtaggctcaaagaagaaaaatgtatttttcctgggcgttaatttgggtcatgggatcactcctatcttctctttctttgggttttctgtacttcagagagacttgccccagaaagtgagatgttatgggacttgtggacttgaagaaccactgtcactgttccagtgtttgtataatcttgtgtgtgtatgtgtgtgtgtgtgtatgtgtgtgtgtggtgtgcagaaattataagtatcgttctaatgaattagaattcattctaagtgaattcattcagaaagatgaatttcctgtgtaatctcattatgtacatgtggtttatgacatttactggaaaaaccttttttcttttttttttttaaaccataaactcaaccatgtggtacaacctttctattagccaggaaaaatgaatttatggtctccaattttagccaaacatggcctttaggtcagaaaggcccaggtcctcactccaaactcatttgcaaacaagctgccttgtgtgtggacactacactacaccttcagagaatgccctgcttcatctgcccctgattgacatgctagctgttcatgtggctaagcactgcaggtgctgtggcccaccaagcccacttgagctgtctggttagctgaaaatcgttcacttccgttaaatcactatagaccttttttttttttttacaagaccgatgagagggttagccacggagtttcatgtccctcagatttttcacttcagtcatatatcaccttctcttggttcccctgatccctgcctttcaccagagcacaagatgttgtccccagaattggggctccttgattacttgtgtgattttattttatttatgttttatttgtatttttatagagatggggtctcactatgttgtccaggctggtcttgaactcctgagctcaagtgatccttccaccttggcctcccaaagtgctgggattacaggtctgagtcaccatgcctggtcttacttgtgtgatttttttttttttttttattgatcattcttgggtgtttctcacagagggggctttggcagggtcataggacaatagtggagggaaggtcagcagataaacaagtgaacaaaggtctctggttttcctaggcagaggaccctgcggacttccgcagcgtttgtgtccctgggtacttgagattagggagtggtgatgactcttaatgagcatgctgccttcaagcatctgtttaacaaagcacatcttgcaccgcccttaatccatttaaccctgagtggacatagcacatgtttcagagagcacagggttgggggtaaggtcacagatcaacaggatcccaaggcagaagaatttttcttagtacagaacaaaatgaaaagtctcccgtgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctccttacttcccagtaggggcggccgggcagaggcgcccctcacctcccggatggggcggctggccgggcggggggctgaccccccaacctccctcccggacggggcggctggcctggcggggggctgacccccccacctccctcccggacggggcggctggcctggccggggggctgacccccccacctccctcccggacggggtggctgccgggcggagacgctcctcacttcccagacggggtggctgccgggcggaggggctcctcacttctcatatggggcggctgcctggcggaggagctcctcacttcacagacggggcggttgccaggcagagggtctcctcacttctcagacggggcggccgggcagagatgctcctcacctcccagacggggtggcggccgggcagaggcgctcctcacatcccagacggggcggcggggcagaggcgctccccacatcccagacgatgggcggccgggcagagacgctcctcacttcctagatgtgatggcggccgggaagaggcgctcctcacttcccagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccggcccggccaacacagcgaaaccccgtctccaccaaaaaaatacgaaaacccgtcaggcgtggtggcgcgcgcctgcaattgcaggcactcggcaggctgaggcaggagaatcaggcagggaggttgcagtgagccgagatggcagcagtatagtccagctttggctcggcatgagagggagaccgtggaaagagagggagagggagaccatggggagagggagaccatggggagagggagagggagagggcacttgtgtgattttaaaacataatcttttcacttatttttctttttaattaaaggtgttcatgaagccatttcccttaaggttagaaaaaataataaaatactcttaactcactttttggggtagattaatgcaatttcagatcaaagccaggaagtaactgtcatttgtggggaaaaaaggctatacatgctagtcagaccaatagaagcaccaaagtcaatttaatcatttgatggctcatgtaatatttgctgagtattcatcaggcccagggtggggagagagcatgagagttgttgaccatctcatagttgcaggcactaaagcaagtatctgccctcagtgatttgcccaagatcattcagacaatcttgggcaaagctaagagcagaagggtagaattcatggctttgagattgcattttgtgcctccaatattctactttcctgaaaaattagtaattgagaaaacagaaaatgggccctcattcaactaaaacatatgcttccttttatgctttgatcaagaatattagtaagaggaaaaatgtgtcctttcaatcagtatcaccccgacagtgatgaagcagtcattggcactttgattaaatccgagcacttcctggcctggagttgagttccttttcgcacgctttctccccagcgagagcagacccagcctctcaaggacaccacctctctttgaagggcttccatctcaaaggctacattttctttccatggatttttgggccacaaattcaaaggccacctgtagaaaaaaattacttttcagtgaaccagcagatgtttgcttaaacaggtttcactgtaggaaagccctgctaatttggatcgtactaatttggagatgaaagtgattcacagacgacatatgtggctcacatggaggaggatgttctagctattttttctggtgtaaattttaaggatcttacaaataaaggtaatctatggcttaaagtcttcatttgggaaactaaggcttactatgacatacttccagtttctaggactgctggttaatagttaaaggatatctgattataatattaataagatcttacatgcccatagtgttttctagttttaccaaagcaatacaaatgaatattttgtgcgacactcagtgtagtctttccagaagccaaggcttgagagtattatgcctgttttgcagatgaggaatttaaggctcagaaagggatttgtgacttgtgcaaactcacaatacttttatgttaagcctatttttatgaaatttttagcccacttctcgatggagaggatttcaggccaaatagaatgagtggagctgggatgggaaccctagtgtccaggctgcctaagttagcacattgcacttgcctgtcactgtctagcttgagggaggtctttgggtagcaaccactgcctttcactaaaggctagtttcatttatatgatcacatttgtctaagttcttcagtaagtcatactggttccttccattatattcagcttgttttcttccacaacctttctgaaacagaaaggaactttagaagtgtggaagggaaagcgaattgagctcattaacacatggaatgtaattatgcacaaatgtattcattacagtatttcagctgttggaatgatatagacacagttaattccaaagcataaagaaacaattaccctcaaagtataaatacaatactaatcacatggttcagttaacaagaaccatatatgagttatacttgaatcaaaagtgtaggcagggactgggcacagtggctcacacctgtaatcctagcactttgggaggccaaggaggatggatcacctgaggtcaggagttctagaccagcctgaccaatgtggtgaaacctaatctctactaaaaatacaaaaattagccaggcgtggtggtgtagtcccagctacttgggaggctgagacaggaggattgcttgaacctgggaggtggaggttacagtgagctgagattgagccattgcactccagcctgggtgacaaagtgagactccatctcaaaaaaaaaaaaaaaaatgtagtcagggtttttttggtgcagtcacatgacacactaaaccatcttgcaatgtttaagtcacctgttggattgtatattgaccatttggtgttggaaatgtgttcttattgaaaatgactttgggagagaatggcatataatttatgaatctcatgttgctgtgtgcagactcctagtgatcagaagagagaaaagaattgtgggaagggaagcttagtttcttagtactctttaatgcaaatcagggacagagtgccaaagtacaattgagttagaaaattgagtgtgtaaagtgtaggtagagagtggcaagagttgaggctggagaggtatgcaaaaaatcagatcttaaaaggtcttaactttatcctgtaggcgatgcagtgaagggtttatattttagatagagcctgtagtggctgtgtgatggacagattggagtgagacaactttggaaacagggagacctattagaaggctgtgatagttgccctggtgagagaatattaggttcacacttcaggtggttggttggatgggggctgactgatttaaaaatatccaggagataaaaagttgattagatggtgctatactctgcatatccctttttttcatatccttttacagaatggtatttttcttcccactcagcatctactttgagatgtatccatgttgtgtgtatagatgtagctcactgattttaattgatttaatatggtaaccactgataaataaacctagtttatttatctgttcctcttctgagggagaggtagtttgtttccactttttccttattatctaaacagtgctcaaatgaagatccttttatgtgattccttatgtacatgtgcaaatgctttttccccttaaggtaggtgcctacgaaaataaataaataaatacatacatacaaaaaatagctgggtgcagtggtgggcgcctgtagtcccagctacttgggagactgaggcagaagaatcgcttgaatccgggaggcagaagttgcagagagccaagatcacaccactgcactccagcctggacgacagagtgagactccatctcaaaataaataaataaataaataaataaataaataaagtaaaaaaattaaaaaaggtaggtgtctagaagaagaattgcatagaattgacagaagaggtgaaccccaatataaaaaaaatcttaagttgataaaaagacaaatgctataaacagggcatgaaacatgcactttatagaagagaaaacaagaatggtcataaatacaaaaagatgtttcatctcacaggtaatcaagaaaaagaaaaaacaacaataaggcaacatttcaaacccataagattggcagggattactagattgggtaactgcattgttggtgctcatttacctgccaaagggattgtgaaattggcataacctctgtagagcaccaagtgtggaagggacgggtggaagtgaggagacacaccgctggctgttccaggtggctactccagaggaatctctgcacacacatccttttcacttaaaactgtcacaacagatagacccacttcattttctttttctttttgagacagcagtctctctctgtcacccaggtggcacaatctccacccactacaacttctgcctcccaggctcaagggatcctcccacctcagcctcagcgtatgccctgctaatttttgtgttttttgtagagacagggtttccccttgttgcccaggcaggtcccaaactccagggcacaaactctatacccgcctcagcctcccaaagtgcagggattacaggcatgaatcactgcacctgaccccagctcattttcatttaactgccgaactatgtttcatagaaaggagggactggattatttaaatatatctttattggtagatatttaggtttgtttttctttctgttgtttttctattggtgaaacagatgcaatggacatccttgaatatgcatctttgggcatatatggataatatctctctataatagatatcaagacatggtataactgggttaaagaataagaacatttaaaatgtaagtaatgtgaagcaaaaaaaaaagccagacacaaaaggccacatattttatgcttccacttacctgtagatgaaatgtccagaacaggcaaatccatagagacagaaagtagatttagtggttgccagggaaagggagaaggaggaaattaggagtgactgatactggccaggcacggtggctcacacctgtaatcccaacactttgggaggctgaagtgggtggatcactggaggccaggagcttgagaccagcttggccacatggcaaaaccctgtctctacttggccgggtgcggtggctcacgcctgtaatcccaactctcagggaggcaagaggtgggaggatagcttgagcccaggagttcgagacctgcctgggcaatatagcgagacccctttctccagaaaaaggcaaaaacaaaacaaaacaaaacaaaacaaaagacaaaaaatatataaaagccagctgtggtggcatatgcctgtaatcccagctactcaggaggctgaggcacgagaatcacttgaacccaggaggcagaggttgcagtgagctgagattgcacccctgcactctagcctggggtgacagagtgagactctgtctgaaaaataaaataaaaataaaaaaggagccactggtacaaaaaaaaaaaagaaaaaatgagtaagacctactatttgatagcacaacagggtgactatagtcaataataattatacacttaaaaataactacaagaacataattggattgtttgtaaaacaaaggataaatgcttgaggggatggacaccccattctccatgatgtgattatttcacattgcacaccgtatcaaaacatctcaggtaccacacaaatatatatatacctactatgtacccacaaacattaaaaattaaaaataaatataacttacaaagattaaaaatgaaattagaagtgatggctagtgggtacaggacttctttttggggtgatggaaatgttctggaattagatagtggtgatggttgcacaagattctgaatatactaaaaaacactgaattgtacacttaatgtaaattttatgtatataaattttatctcaataaaaaatttaaatagatatagccaaatcaccctccaaaactgatgtcataatttaactttcaataacagtgtgtgagaatacctgtttttccacattcttgcgaacagtagatactatcagtctttaaaatttttgctaattgatagaaaaagattttttaaaatttgcatttccttgattgctattgggactgaacgtcttttcataaacttactgtccatttgtatttctttgttctgtgaatcaaccgtttatgacttgcctactactgtattgtttgtttgtttctttctttttctttctttctctttctctttctttctctctctctctccttcctccctccccttccttttctttcctttttcttttctttctcccttcccttcccttctctcccctttgctcccctcccctccccttctgtttctttttcttttctttcttcctttcttcctttcccaggttcaagtgatccatccgcctcagcctccagaggagccgggactataggcatgcgccaccatgccaagctaatttttgtatttttagtacagatgaggtttcaccatgttggccagactggtctggaactcctgacctcaggtgatccatccgcctcggcctctcaaagtgctgggattacaggcatgagccactgcacccaacctgttcatctttttccgattgatttgtagatgctccatgtattatgagttatcaaccttttgtctattttacgtataggactggtcaatctttttctttgtatgttttgagtgacttttagaatgcgtttaccaaccattattatatccatactctgttatgttttgttctggtatttttatggattttcatttataggtttaagaatttattgactggtgtgtgggtatagtagggagggggtctgtcttttttctatatatgtagtaatctaacctttatgtttttgtgaaatcctactcagagcattttatctcatttctcatagttatagacaggaaattatttcatatccagatagagcctccgtttaacctaagtattggctccacaagtcttttaaatggtaaactccttgaatttaaattcaattagtttatgtcacgagtaggtccaggttttctgggtctgaattttaataatttaggggattgtctttaatgcaagagtaccaaattaggtacaggcatatgaaggtgcagagacctgaaatccaagcttccttagcttcccagtaaattcaccctggttacattatcagaatgcatctgttacataaaacgatgaggagcagccatctccatccctggagtggtatgactttcttttgtattcaccagctaccacaacttcaggatttttttcttcccttgttgtttaaagagacatttaagagcagacacatacatcaaggtggctttaatgttggaagcagagttagtccagtggagaagttctttcagcagggtctttgccacctctgcattgctcaaatgtgatgtatttgatcagtggactagctgagaacttggtataataatgggggttgttaatcttgcatgcctttggaacctgaatttacagctttaactttgcatatctgcttgcttttgcattagagcttggtcagcactgttgagagatttgcaaatgcaactaacagggctttcttttagcatcctaccctttcaaaaatccaggaggcaaacaatgatcaatgttgtcataagtaatgcagaggatggcaataataataatacctgactttcaccataagccatgtgctgtgcgaaatgcttacctgtattgttttacttcatcctcatcatcccctataaggcagatgctattatgaccctcactctacagatgaggaagttgaggcttagagagaggatgccttactcaaggcctcagaaggggtacttcagcacccccccacttcccttcaggatcctctaaggccagtgctctcatttgacaaatgaaagacagatttggagagacctgagatcttttggacatcaggtttatgtgtcaagcatagttttatttattttattttattttgttattttttgagatggagttttgctcttgttgcccaggctgtagtgcaatggcatgatcttggctcactgcaacctccgcctcccgggttcaagcgattctcctgcctcagcctcccgaatagctgggattacaggcatgtaccaccacgcctggctgattttgtatttttagtagagacgggtttctccatttggtcaggctgctctcaaactctcaacttcaggtgatctgcccgcctaggcctcccaaaagtgctgggattacaggtgtgagccaccacgcccagccaagcatagttttaaaaactttgctggtcttatttaattaaatccctgtaagagtcctgcaagataaatactattattattcctgttttacagatgagaaagctgagacacaaaaatttccaaggccacatagctactatgtgaaagatgtaggataaaaccttaggcagcctgcctccagagccaggctcctaccctcactctacagctgccttgcagggagtactgttaaagcttagtacagttacgacttactgcatcacatctctgagcctcccagaaatagagagataccaaggcctttcatttataatttctaagttattttttatttttatagacagggtcttccactgtcactcaggctggagtgtagtggcacaatcacagctcactgtagccttaacccgtgggctcaagtgaccctcccattttggcctcccaaagtcctaggattacaggcatgagccatggtgcccaccctatttttttaaatgaagaaatgcctaaactgtgttacaaaaactgtggcatgtttaaaatgtttaaatttgacaaattaggccaggcgcggtggctgacgcctgtaatctcagcactttgggaggctgaggcgggcagatcacaacatcagaagtccgagaccagcctggccaacatggtgaaaccctgtctctactaaaaatacagaaattagcccggggtggtggcgtgcacctgtaatcccagttgctcaggatactgaggcaggagaattgcttgaacctgggaggtggaggttgcggtgagctgagatcacgccattgcactccagcctgggtgacagagcgagactctgtctcaaaaaaaaaaaaaaaaaaaattgacaaattaattctcttaagattcaaaaaaaacaatgcaatacaattctgctatttgaaagataattatgagattcaaaagaaatatgaattcatggggcttttacagttaaggtgatatgggaatgagacatgatttaaagttaatgatgaatatcttctttcactcctgtgtctgtagttttaggccgcttcatttggagaacacaccagaagtcttaacttgaggctctttgagaatgagagaacataacgaaataatgagatttggtggtatatagaaacagcagccttgtgcctgacctttgttttttcactgttggtggctaaaagaataaatgtttatagattatactgaagtactgagctttgttgtttttggtaaaatgaagagccactgtacgctgattgataagagataggctttgattttatattctactgtatgtttcagttagtttctttttaaacattctttaacttttgattatttccttatcagacttgagttttctaggaaaggagtttttttttttaatcagagaataaatttccaagtcattgtccccggagggataaattaaaatgcagggcctatttccaaccgcattagtgacttctctgtagctttaggaagatcaattaaccttttactcacttctttgtctgtacaataggaatggcagtgttgacatcagatttttccaaagtatttttcagaaacttgggtgaaaggtattaaaactactgcctgcattattcctggatccccctagtaatgggctccaattaccagtcacttataagaatttataggtaagactcttatcatatgttgttaatcacaactttcacagttgtgatttggtgttttaattcaaaagctactgttttggaagtgactgctttctttgagggttagaaaacatgcccacatttccatacaagtgtcacattcttgttagcacatcacccatccatctcttacaggattatgcaactcagttcatagatataatcagctttgtattttcattcaaggataacaaactagcaaggttgaaatcttgacttgtcatcggaattgaattgctccctggagctgggagggaatgagattggtccagctctgttcagaaatggcagttatctttagaatctcaatcgcctgctctccctttcttctttccagtatggtgactacgaccccagtgttcacaagcggggatttttggcccaagaggaattgcttccaaaaagggtaagagattaaattcccttttcaggaagacatagcagatatgtggtctaaaagaaagctaaccaaaggacttgaaggaatattggaagtacatagcaatttaattttaataaatattttgtaatctccagtaaacagtgtgggatctctgttaagaatattaaaaagcaaaggtttttggagttagtttggggtcaccaggactagcatggcctgtaaatgttttttctagcgtggttgttttttcagatgcagttgagcatcattgattcccaaagaggaggctggagcagagtgtattcagcttggggaattgagctgtttgcagtggcgaggggcggatagaggagatgaggtaggggtgggcattgtggtttttaatcctcagtgttgttcatcttattcattagccacagaagcaggcccgccctcccttttgctcctgccgattttacagccctcactcatctgtcactgggtaataaaggcccgtttctcacctctcactctctttacctgtccctcgatggcttctgagcatgtgaaggcctgagatgagtgagcattgcttctgactgagctccgctgtcagaggtggtctctgtgatgtatcgcccaggcagggacaggggcactgccagatgagggttgcacctaggtctgagttatcatgcagctttctgagttgctcctccaatagaatggtgccttatttacacgccctctctctgtgtgactatctccctgggtgtagctttttaaaaatagctttactgttttgtaaaaatgatgcataattataaaagtggcaaacaataccaaatttacttcatgtgtaggttttttattttgctctattttttggtaggtaataaatctgtatcagatgactccggaaatgtgggaggagagaattactgcttggtacgcagagcaccgaggccgagccaggtgaggcccattcattgttggtttacattcctttatgggcttttttttttttttttgccttaaagaactgcaaaactaggacatgcttgttaaacaaaatgcagtactgaagtctataaaagaaaaggggagagctggggagctgggagtaacgttggtcttcagttttgtgtgtgtccttttctagtacgtatgacataaagtaggtatgtgtactgcctgtcaagatatatagacctgtactcactggtaattaagtttaagatttttttttttttttgagacagagtcttgctctgttgtccaggctgaaatgcagtggcgccatctcagctcactgcagccttgacctcctgggttcaagcaaacctcctgcctcagcacccccagtagctggcactacaggcacacgccaccatgcccagctagtttttctatttttagtagagatggggtttcaacatgttacccaggctggtcttcaactcctgggctcaaagcaatctgcccacctcggcctcccaaagtgttgggattagaggcgtgagctgagccactgtgcctagcctgaattttaagaattctattgtatggctatcccattgcttttgcatccatccctttattgatggcatttgagtatctgtaggtttttcacttttacaaaaatttctgcagtgcacaatcttttatttttatacaattgtatgagtagttctggggatatattctttttttttttttttttttttttgagacggagtctcactcagtcacccaggctggagtgcagtggcgcgatctcggctcactgcatctccgcctcccaggttcacgccattctcctgcctcagcctcccgagtagctgggactacaggcacccgccaccacgcctaggctaattttttgtgtttttagtagagatggggtttcactgtgttagccgggatggtctcgatctcctgacctcgtgatctgcctgcctcggcctcccaaagtgctgggattacaggcatgagccaccgcgcccagccaatatattctttaaaacaagagttgttgggacaaaggatgtgagcattttgcattttgccaggtaccaccaaattgttctccaaaaaggctgtacctgtttatacatgcctgtcgacaagtgttatgagagtgtcccaccccccacccccagtctatcctcaacaattgtttttatcagtctaatttttgtaatctaaaaagtgaaaagttgtattatgttagaattccattcccttgattaggaattggtcatgttttcattagcctttaacatttttttctcttcttcaaatcagtttcctaacacttttttttttaaacttaagtgcaacatgcatatggaaaagtagacaaattataagtatacaacttgatcaattattgtaaggtgaaaacaccagaggaagaaataacctgtgtctccctacccccaattcccctttcttcctccccaaaggcaaccagtctcctgatttttaattccagattggcgttgcccatcttaaactttgcattctgttttttgtgtctccttttactcagcatcatgttgtcagattggggtttgtggcatgtggcaatagttttctcattttcattgctgtatagacttccactgtattagtatattaaaaattatttattcattctactaatgatggacagttaggttgttgggttgtcccctgagttttgctattacaataatgtcaaacaatttcccaaagtaattgtaccaatttacgtcaatgtgcatgatttctgatttctccaccttttcaccaacacttggcgttctctcaggctgggtttttaaaaattcattgagagcatttggagattggagagagaaggaagaggacaaggtcatagggagacttgagttaaaatatttcagtatgatacctgtttgggagttttctgcaagttattgctacttcaagagcttactttaaattataacttagatgaaggtgatctgacttgggttttacaacccagataactcttgccctaacctccaacaatactcaggaagcttgcagagagagctgtttcatttccagaaccttccaggtaaagaaagtacacaaaggaaaagcaagaacttaaataaaattccaacacccaaatctgtttgagggtagaagataacataccacacactcttgttgaattacttgagatgagtttactgtttaccaagggcaaggtgggaaactaaggccaagaaactccgtgatgagtctgttctctgactatcttttgatggggatgggaaattctgcttgacctcagtgtgtttaatagactcagggccgggcagagctttgctggtgtctgctgtggcttttgtcttctggcagcgacgtggctctagaggaatggcagggtcagaatgcttgatttggtgcccacccgctctccacccatctcacttagctccaatgacagtgtcttccgttctccccacagggatgaagctgaaatggaatatctgaagatagctcaggacctggagatgtacggtgtgaactactttgcaatccgggtgtgttgaaacctctctgagctccttgtgtagtagacagagactgagtgagggccagactgctaaaatggttacttcttcattccaaggcgatagactcttttatggttctgtggtaaagaaggaaagaggaaggaaagagaggtcttagtgcctaactttctatttttggacttcaattagatcataggtaattaagtgtcacttgagccttgggggacttggacctggttctgctctcagcagaaacctgtttgaatgctctgagtgtaagatttgattatttctggctctgtgagatctccgtccacagggagcacttgtaagtacttctccccccaacacacaccccacccccatccccacccccacccccaccccaggcactagtagagtagatctgcctttatagattactgatttgtttgggattctcactatgaggctaattggttttctattcagactattaatagtctgctgtctgctgggaacccactgcttctgcagggagaggcatttgtgtgcagcccagatctgggcctttagaatgtctttctcctgtgggtcagtatctggatgcagtgtataggcagcttcttacaaagggatgcatgcgatttgccaaagcatttcactacggactccaaactgcagatgagtagatgttaaaacaatgaggcgggtccacctttattttcatagtcatgctttgctttcccttattgggttcctacagttgttgtattaaattcaggtaaattgaaacatattttaaatattctaggatagctttctacttcatttgtattttgtaaatacagatttgtatggattacactgcataagaaaataaggcacacttaaagtgcctaaaagatgctccataatagtacaggaagttcttttctaaagttctgtcagtttgtatttgctaattgcttggtttctttaaggtcaaactaatgtaacacatttctgtggttttgtcaactcaactcctcttgccccatgttctggccacctagattctagaaaactaaagttttataatcctcagaaaacagtttttttggtttttaaaaatcttttttgttttttagaggtggagttttgctatatcgcccaggcctgctaggctcaagtgatccttccaccccagccttccaagtagctggggagtatcactgtgcctggctgaaaaggtttcttattagggaatatttctacatcagtcagactaatggatactgttttttgtgtgtgtttcctatattgagcaatagacaaagctactggctatcttagtgtcttttatgttaaatttcctgaaatctcaccattaactaaggaagatgtatgcttaaaacagtttaaaaggggctgcttgagtcctcacctctctctctgtttaatctctaggagtgttggagtcataatggtaggaggcagaaggctgaatctttttttaaaaatttaaactaaatagtcagaaactattttctgactattgaaacacaatgaaacatctcattttccaaaatgtactgcagatgtaaaagtacaaagcctcacttctattaatgcagtagctttcatggctttgctgacgagcagaagagtctctcatggtttggtgatagcacctgacttcaggatgttaggagtaaaaagatttatgctggagtactcactcctcagtctgatatctgctgttagatgggtacttctcttcacagtcccagtaccttctcagtttgcagacctgtttttctgcccttgagtcttggttcagtttccattatcgtcaaggggtcaggagctgtagtatccttgtgcagcgagtttccttccactccaaatgagggctagaccacagcactggcgggtggacctgcacgtgaagatacagccactcagtccgtcgcaggttcagtgctgtgggagcccagggcacccgccgcgggctgctctgactgctggccaggaccgctgtcaggggcagagcataagtacggcttttagacaactttgttgatgaatagaattctttttgatatgtatttcccatcatgcaattattaaaaatttcaaacttacaggaaaactgaaagaatttttcagtgaatacccatatatatgcacaatctagattctacagttaacattttaccagacttgctttatcacatgaagactacattttatcataaaatgagaccatccagccccaggcactgaaaattttcttcctagtagtccaacaatggtttctttaaatataagaaatcattaaacctatgggttttttttgttttgttttttaacgaagtctctctttgtcgaccaggctggagtgccggggcaccatctcagctcactgcagccttctgggttcaaccagttctcctgctcagcctcctgagtagctgggattacaggcgcgtgccaccatgcccggctaatttttttgtgtgtatttttagtagagatggggtttcaccatgctggccaggctggtcttgaactcctgacctcgtgaaccgcccgcctcggcctcccaaagtgctgggattacaggcatgagccactgctccccgcctaaacctatgggctttaattctatacctatgatagcctgcttatttaaccagagggaacaacacttatgttactcttcctttagccatcgagccagtgacagaagccctcagtgattgttctgggggacccagaagtcacaagaatggaacagttttgcttctacctgccccaattcagaaagctgaaatcttcttggtttataagacagctgtgacttctgttgggacctgctgaaacttgtcacatgtgacagtgtgtgccagattctttggaaggttgaataaaattttgagcctcagctggcgcttacagtagctgttcttattggatccacagaataaaaagggcacagagctgctgcttggagtggatgccctggggcttcacatttatgaccctgagaacagactgacccccaagatctccttcccgtggaatgaaatccgaaacatctcgtacagtgacaaggaggtaggacatgtgtgtactgcagatgggtccagcagatctttccctgtctgcccccctcactggagcctccccagccagggcatctccttgttattcatagagtcctttaattcccaggctttgagggtgtggttgttgattttcgaagtctttacagaacagtattggcatcaataaccccactatgactaataggaaactgggaagctcaactggccagggagaaaccccaaagaatagtgaacaaaaacagtaacattttcttattacttggctttctatttttgtcgatacattctctttgtatgttttcttttcttttttagagacaggatttcattatgcatgcccagactggatttgaatcctgggctcaagcaatccttccacctcagcctcctgagtagctactacaggtgtgcgccacagcacctggcttaaattctcttcgtattttaagtgtggtctttattgagctttctttctgtgtccggtgcttgatacatgtggcagagaaatacatatacacacatatacacatatggacatatatgtgttttgtgtgtgtatctctcagtaattatataaataagtatattaggttaatatgcttacaagaattccaaaataattaaggtggaataacttagataaatgctcttagaatttaaatatttccatatagggtggtgacttttaccaaaaaggtcccataatgtataatcttatgtttactcatccatccattcattcattcactcatccattcattcattcttcattcattttattttattattatcattttttgagacaggctctcattctgtcaccgaggctggaatgcagtggcacatgatcacggctcactgcagccttgacctccctgggctcaggtgatcctctcacctcagcctcccaggtaacagactacaggcgtgtgccaccacatctggctaattttttgtagagatggggttttgccacattgcccaccaggctggtcttgaacttctgggcttgagcaatcctcccacctcagcctcccaaagtgctggaattacaggtgtgagccactgtgctcagcagttcttcattaattttaaaggaattattgagcatctgctttgtgttagatttcatgggggaaacaaagatgtagaaaatccagtcttagcattcaaggaagtcaagtaactactcacctgctataataaataagtgccgtggaagagacatgatgacaacaaatgtagtcttccacatacaagcacattcaccctgaccgtctgaatttaatctctataagaacactgctgtaaaggcaggggctgtgttgtcaatatctctgtgtcacatcaggaagcagagacacagaaggatcaagtgacctgtgtctgagtgaagtagcagagattaggagccagagttgctgatgccacagcccccgcctttcagggaggcccagaggctgagtcctgagagcacaggggcactggggagagggaggctccactcagtgacctcctggtacctgcacagccaggacacagactagagagtgaagaacaggaacagcttatgttgctgcctgcagagccccaaacctgagcatatttcctgttttctctttttcatggcaactcaaggaagggaacaccaggcccctggtttccagtatatggttgggatctactcagccatgcttgataagacagactgagccccttaattcaaaacattctgactttgaagtttttgttagtagttagcccaggagataagcagttaggtatttcttttttaaagtacttaaattgaaagttccacatgacataaagctgtatgtgtgccaccgtatggtagtttttcatctcccaatttcataaagtctgtttattgcacgtccacacatttgtgtgctaaaggctccctaaacacccgttcttcaaagaagccaaggattgaaatctcccatactatggcctgacacagtaaactctaatatgccctctccgggggacaggcgccatcatgttccatcatgtcaataactcatgcagtaagcagaccccaagctgacttgacataaaagaagtagtcttggtagttatgcatgacagccatgctgtcaaaacagaaatgttagtttattttaaatgatccattgattctttgtgtacgccctggcatggtgcagagcctgcggtttccccactacttgtggtttcccaatgacagctccagggtttgacagcaaagccaaaaataagctcacaaaattcatgaatagcagcctacacaagagcaacactgcttctaagttaacttggctgaaagctaaacaaaggatcattttctgtcctcagtgtactaaccccttcttgggcaatataacgtgtgaaagaaatatatcttcccaaacatatttatctgcttagcaagtctttcttgggaatggatatccattttgtaagtgcatcttggaaatctaggatctgtttggtcttatcgggagtggttgagagcagcagccatttgttccttgcaggctttcctgctagtggtctaaccctaggttctcctaccaagccaccaccctgtctttatcattcatctttctctccattttgatttcagcatcaagaactgttttcccttctactatagtccattttttccccatttgattctattaacagcttttaccaaattattcccatgttcagaaacctgtggtgagctcaggtatcctgtcacatcaaacctaaacccttcttttttttgagataggggtctgctctgttgcccagcctggagtgcagttgtgcaattacagctcactgcagcctcaaactcttggcctcaagcgatcctcctgctttggccttccaaagtgttgggattacgggtgtgagccaccatatctggccgcctctgacttttattctcactgccagcccctacacccaccccttcctccctctcaggctaaacctattatatcatcttagtcaccaaaaagctaataccacacacacacacacacacacacacacacacacacagctcatttccctgtctctaccttatttctggttttgccctgtgcagaatgccccttcacctgccttttagctaccctgttggattgttcttctaagatcagcttcactctctcttgcttatggtggatctactctgaacctccacatatttgtgatttgtaccacccagtgaagcactaatatttgatgtgatttcttgagtaattggctgttgttagcctagttccaactagatggtgagcttcatgaaggtgggcccatgccctcgactacagtagccctccagtgttggcctcagggttgggcccattaaggatgcttattttaggttgtcaagaatcccttcccacactcatgcctaagatggtctagagagcgtacctttagggtcctgagcttccacagcccgagacttggtgctcctaattccctgaggtttagtgcctggatactgggaagccaggacaaggcataacttcatgctggtctgtggccagtgtggttgcgcatttgtggaatttccaattgctggtaacattccaggctgtcggactgaaactgtgttctgcttcattcttccagtttactattaaaccactggataagaaaattgatgtcttcaagtttaactcctcaaagcttcgtgttaataagctggtaagttgagatcctggttttcattactgataatggtagcttttctgagaattgaatacttctttttaaaggatatcagagtgacatcttgtgaagtatagaatggtatctcacttggcgcatactttctgtttagcttaaagagttaaaactaaattatatcatgaagaagtttttttttttgttttttttttgagacagagtctcgctctgtcgcccaggctggagtgcagtggcagtgccatctcggctcactgcaacgtccgcctcccagattcaagagattctcctggctcagcctcccaagtagctgggattacaggcatgagacaccatgcccagctaatttttgtattttcagtagagacggggtttcaccatattggtaaggctggtctcgaactcctgacctcaggtgacccatccgcctgggcttcccaaagtgctgggattacagtcatgacccactgcgcccagccgatgaggaatttttaaaaaggatttttaatgcagtatttcatacatataaaaggataagtgtaacatatgaattataaagaataacaaaagtgaatagctgtgtacccacaaccccactttaagaaatagcacagtcctggccgggtgcggtggcttacgcctgtaatcccagcactttgggtggccgagacgggtggatcacaaggtcaggaaaaaaaaaaaaaaagaaaaagaaaaaggaaaaaagaaatagcacagtcccaatactgttgagacccttcatgttaacaccctgctggtctctcctttccctctccccaagggtgatcactgttttgagttgagtattcatcatcctcttgcttttcaacagaattttatttcatatatggcaaaagaaaaataccattcaatgtcatatgtttatgaaatttatctaaatgctgtcaagtatatatattcttttgtcattttccttttcctttttcattatttttttgagatatatctttgttgatgcttaaagatagtctgttcattctcacctctgtagcactctgttatatatttttctgattcttctgttaatggataattaagtgctttttacttctatacttttttttttgaaatggggtctcactctgttgcccaggcacaatctcggctcactgcaacctccgcctcccggatttaagcaattctcctgcctcagcctcctgagtagctgggattacaggcggccactaccacgcccggctaatttttgtatttttagtagagatggtgtttcaccatgttggtcaggctggtctcgaactcctgaccttgtgatctgcccaccttggcctcccaaagtgctgggattacaggcgtgagccactgcacccagccacttctatactgttttaacaggctgttatgaaaacttttgtatctgcctcctggtgcacataggcaatagtttctttggagtcttgagtatactgggctaggtggggtggctcacgcctgtaatctcagcacttggagaggtcaaggcaggataactgtttgaggccaggagttcgagaccaacctgggcaacatagcaagaccctgtctccaaaaaaatgaaaataaataaaatttttaaataataaaaaagagggccaggcacagtggctcaactcctgtaatcccagcactttgggaggctgaggcaggcggatcacctgaggtcaggagttcaagaccagcctgaccaacatggagaaatcctgtctctactaaaaatacaaaattagctgggcgtggtggcgcatgcctataaatcccagctacttaggaggctgaggcaggagatcgcttgaacccaggaggtggaggttgcagtgagccgagatcatgccattgcactccagcctgggcaacaagagtaaaacttcgtctccaaaaaaaaaataaatacataaaaataaatcaaaaatagagcttagagtatatacacaggagtagaagtacagggcttggtatatgtttaaatttcaaaattatgacacattgttttctaaagaaggtgaatcgatttttacagacccaacagtagtgggtgaagtttgttttttgctatccttaatacttgtattatcagccttttaaaatttttgccaatcttgtgcatctaaaatggtatctcattatcaaatgaactttttttttttgagattttgagatagggtctcactctgttgcccaggctgaaatgtaatgacacgatcatgtctcactgcagcatggacctgcccaggctcagtgatcctcccacctcaccctccccagtagctgggactacagacacacaccaccatgcccagctaattttttgtattttttttatagagacaaagttttgccatgttgtccaggcttgtcttaaactcctgggctcaagcaatctgcctgcctccccttcccaaagtgctaggattacacttcccaaagtgctgagccaccaggtctggccaaatgttttgagttttttgtggagatggcgtctcactatgtcacccaggctggtcttgaactcctgggctcaaggatcctctcaccttggcctccgaaagtgctgggattacaggtgtgagctactgcacctagcctgttttctttattggctatatcttccagtttgttgctctttttctttttttatgtcttgacaataagaatttttaattttaatgtagacaaatatatacattttttccttaatcactttttgtgtcttacttggcatcttctcttatcctatgatcataaagatattcttctatattgtcttctaaaagtttcaagggcttaatctttgcatttaagtatttaatccttctggagttgatttttgtgtaaggtgtaagggagggatacaacttatttttttccacatgcataacctgttgcctcagcccagcttactgaacgagctttcctatcctccctggtctgcagaaccacatcttgatgtaggagagtaaggtgcacccagaagacatggtgaagtgtcctccagtcctctcttgatttatgatttttacctcctggcatatctgaggcgccttcattttgcatgtttccagagctgacggcactagaggccactagtagggctttggtgtttcactctatgcattcatcttcacgtttactgctacctgcaagagctcaaactgctatggcactagtgggccagtaggcagtgaagtaaatttgtggatattaacctttttgtctgcttctgtggccacagattctccagctatgtatcgggaaccatgatctatttatgaggagaaggaaagccgattctttggaagttcagcagatgaaagcccaggccagggaggagaaggctagaaagcaggtgagcacaaccttgttttaactgatgatgtcactgtgtggtcagtcctggcctgggaggcgaggagtggtcatgggctggcaggagtcttttggccgtggacatacctgctcttgttttataccttttggatcttcatttgccgatgcctacctggtgggatgtcatctctggaaatgaggaataaaccctaatagcatatctaaaagaaacatctctagtaatttctacgcttggagaaattaagtgtgattaacaccagtttgggatgaaatagccaagagtgcatgcatctatccgtccggctagctagcttgctttctttttttgcctgtctgcctccttgtgcagccttctccttttctaattagatggtgatagaatgccaggtggcatttcagtgcttgcggctggaatgctaatttgactctggctgcaattccccactgcaggtcaggccttatggcatgtcacctgccccaggaggtgccaggagcatctatcagcagactggatgatctgcatcattgttttctactcataaaccttctctgctcatggaaatccacacaactaatttgggccttactgctgagaatatcaattgtgtttttggataaactactagatagagtagcagcagctgcagttggctgcccgcaggacttgcaagctcagaagtgtaataattagtctgtgtgcacctttctgatttggatacattggagaggctggtcccagccctaggatttagaatgaaatgcccagtgtgctttcagctctctatctctttgctttctgaggtagtgggccacaaatgtgttctttgggatgctttcagggtgatgggatggatttgttggacaaagaaatcctactgagccagcatggggtcatagtggcagtttcatgaagagctcgtggcagtggctcatccctataactccagcactttgggaggccaaggcaggaggatcacttgcctaggaatttgaggctgcagtgagctatgattgcaccactacattccagcctgggtgaccaagcaagaccctgttttaaaacagaagcagaaacaaaataccaaaataaataaataaataagtaaataaataagaaggaggaggagagctttctttgacctttttcttagcagagcaaagcttagaagtaagaaatctgaaagtgtcagggaatatgcagtctgtgggccctggcagagaatagcaggaacactgcagatcggcactgcttacagcacagcagagccacaaacctggcatctgggcaaccacagatcaggtggacagacactgaccttggagccagatctgaaatttagaatgtgagtaagtcaatgacttaccttccagaccttagttttctcatccatcaggtgaaactaatgatataccttctccatctcagatgaagggacgtatattacaccttacagtctttgtatgcagtaaacttcttttgtgaataggaggtcttttatattggggtagaggtctcagggaaagtacagggccaggaactgaaggagattacctggcttttttttttaataaaagggtcttgttctgtcactgaggctggagtgcagtggtgccatcatagctcactgtaacctcaagctcctgggcttgagcaatccttctgcctcagcccctcaagtagctgggactacaagtgcatgctaccacacctagttaattttaattgtttcgtagagatcaggtcttgctatgttacccaggctgatctcaaactcctgggctcaaacattcctcctacttcagccccccaaagtgctagggttacaggcatgagctgctatgcctgcctggcctgactgggctttttctttctttctttcttagtttctttttttttaaaagaattgtagatatgtagtaagccaccttatggaaattgtaatatgatggaaattagagaacaaattggccaagcttttcattgacttacaaggagaaaattggagaagaactttcactgttttattgcttgtctttgcattatctttttgagcttgtgtgtgtgtgtgtgtgtgtgtgtgtgtgtgtgtatttggcttaggatttagaaaaagcagcagtcttagaaaccttgtatgaccagagtgtgggataagattgaagcaagaagtaattaaatgtgctttaattatttaaggcagaaaatagtgcagtggtcacttctgggttctgctttttgaactcagttagtaccctgggatcacagaggaatggcactgtcttgtgcttgttccccttattaagctcagcatgtggcccaattaatgcagtgatccagaaggcaagggaggtagtggtggctttgtgctgttgccttaaggacacggggctgtgtttcccgcctggctccctcctgtcctaggcctggctcaggagttgtctccacatgaggctgtgcaagtctgtgctgtggctgttgcagctcccccctgtgaaatacaatgtgtgaactattgatgcatcacgtagaatgattccatcttctctgtgggtcagaggcaagagtggagctattgttgatgaaatcagagatgtgagaggggtccatgtggattagaaatggtgagatggcttgcctgcccagatgagaaagctgcttatttctggggctctatctgagggaggaggtcctgcattgcatcccatcggccatggggcagagccacctggggtttcccaacaaaaagcaacattggcaaggtagccatttcagtgcaccgtgtataagaatgcctccttctgccaggcgcggcggctcatgcctgtaatcccagcactttgggaggccaaggtgggtggatcataaggtcaggagttcaagaccagcctggccaatatggtgaaacctgatctctactaaaaatacaaaaattagccaggcatggtggcgggtgcctatagtcccagctactcgggaggctgaggcaggagaattgattgaacctgggaggcggaggttgcagtgagccgagatcgcgccactgcactccagcctgggtgacagagcaaaactctgtcccctccaccaaaaaaaaagaatgcctttttctatccgggtcaagactcaacaggtttttattgtttgttcatttgttcattcaccactagactgtttttcaagtggcacagctttcaactctgcaactggtttagaaggacggggtggggggcaataagaatgaccctggctacctaaaggaaagggaaggaaaaaggtcccaaaaggggagactggagatggggcatctttgggcccttgtggcaccctaggtctcgagccctgtgattcaatgactgtttttcttcacccctcgcagatggagcggcagcgcctcgctcgagagaagcagatgagggaggaggctgaacgcacgagggatgagttggagaggaggctgctgcagatgaaagaagaagcaacaatggccaacgaagcactggtgatttctgaggggctggggttccaggaggctacttggggacttccttggcttttctggagcttggtctcctgaaaaccatgagttagcagcgtttgctttgaaatacttaatttcagctttgaaaaaatcagtgccttttcttttcacctgtgttggcagaagcagatttaggttgagcttatgtgcagccaaactccactttcaccacgaggttgcctttatagcagggcttctcagcctgggcactactgacatttggggctgaccatcctttgctgtaggaactagatcccagtagcagcacctcaccctccatttgtaacaatccaaaacatcttcagacattgccacatgtctcttttttttttttttttttttgagacggagtctcgctctgttgcctaggctggagtgtacagtggcacgatctcagcttactgcaatcttcacctcccaggttcaagcaattctcctgcctcagcctcctgagcagctgggattacaggcatgcatcaccatgcccagctaatttttgtatttttagtagagatggggtttccccatgttggtcaggctggtttcgaactcctgacctcgtgatctgcccgcctcagcctcccaaagtgctgggattataggtgttagccaccgtgcccagctgtacttttattttttttttttgagatggagtttcactcttgttgcccaagctggagtgcaatggcatgatcttggctcactgcaacctccgcctcctgggttcaagcgattctcctgcctcagcctcccaagtagctgggattacaggtgcgcgccaacacatccagcttttttttttttgtatttttagtagaaatgggttttcaccatgttagccaggctggtcttgaactcctgacctcaggtgatctgcccgcctcagcctcccaaaaggctgggattataggcgtgagccaccgtgccccacctgccacatgtctcttgcaggggacaaaaaactcctctggttctaaccactgatttaaagggaaagaacagagtttaagttgtttttctccacgtgaagcataagcctgagctgaggtgggtactcagagaaggtgctcttgttactccccatgggtgcagcccgaagggcccttctgaaaagttggggaatgtggcttgtcatttcttgtcagagggtcatggagggcactcagcagcagggccccaggagtccgagactctggtttgtcccatctcagtgttcaaggcagatctgggcgggagaacagcacatgatcccacttcagctaagagcactgtgccctccagatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggaggtgagggggcaccgggcaccagactggcgaggaggctggcgaagggccgcagaccagcctgccctgaggctgagctctacagcagttgtcctcaagctgcttgcccatcttctgggccgtggggaggctcctccttggctgatggtgactggtgctttatccattttggggctggcgctactggttgggcacaggaactcagttccccctccaggggggcctctctggtcatacttgtgtctctttgataagcccctgtccctctgatggccgtgtgtgcaggaaaacccctgagcatatccacagaccgctttcagctgaagagatgtgaggaggctctttgtgcatttaaaaaaagtgtggttcttttctgctttcattcagtggggctgcaggagaacagcagctgcctacctttaaagggaagctagtgcctgcatcccccagcctttcttggcacatgggggaggagggctaggatgatctctgtgactgggatgtcccactcatggccaggttgaaggatggaactgttgtctgtacttttgaaagactattctaggcctgcaaccttcagataaacactgacacattccccacagcttttggctctgttgatttagagcacttgaatttggcttttagctaccaaggtgcattcactacagttttcctcaccacgctttgcatgtcgttctgggaatatggttcctttttgcctgccctgcttcaggccccttactgtattcgggggtcactccctgtgcatgatgcaggttgggccaggtccctgcaccaggcctcacatgccgtgaccacctgagccccataggatgaggatctgcaccagggtgcgggtgccctcagtgactgggctcatctttctgctggagaaagtgggcacaaggcccactggtgttttatccgggggctgtgaagacgcagttcttgcacattctgccctttgcgatccaatataagaactttgatcctccaggttcttcctttgcccagctcactctcacccaaaaataaagcagagaaagctgctggtgccctctccagctcctctgtctcctggctgcagaaggtctggtttctctcattccccaccagttttcctgctcttccagtttagatttaccaactcaaacaaaagtcctcaggaatgttgtccttgcttggaagttctgatttcatgtaaatatccctgtctcactgtcctttttcacctctttgggtgccatcctcagggttagcccaggtccctcctctgcaggggtggggtggtgtcttttcctgctacctgccctcttctgtgaagctgacatctcatcctttccttgcagggccaaagaggcagatcagctgaagcaggacctgcaggaagcacgcgaggcggagcgaagagccaagcagaagctcctggagattgccaccaagcccacgtacccggtgagcctgggggccaccagctggggctgccttagtcctggtgatgttctctttcctcccggcccttcagttcatctggcggtgccttcagggtgaccattcaggcaaacacatggctggatgagaggtgcagagagcctgcagttagggactgggtagaacatcctggtctgccatttggctttggactagttagttgtctctttggttgcctggataacaggcaacagggccttttccagctctggaatgtttttctttttctaagtaatatagtcccaaattatcctcaagagaatttgctctcttgcctcttaatgctgagctgaatgtaatcttcaactatcagtatataccatatatcataattatagttctgggaagggattggctgtacacctcagagtgaattactgccgtgcaagaacgagcagccactctcagtttggggacagagagtcagacttccattaaatggggtcacaaaatgaatagaagcctctttccttcctttcttctgtgcattcagtttggcatttttttttttttcatatttgttcagtgtccacatagtgccatgcagttggaagtctctatcctgacaggtgttctcagggtgcacaggtgcctagaggaggaggacacagcccaccctggaggagcaggagaggctcagtgtggtgtctacactgatgcttgaagggggagcaggaagtagccaggtggagaagagaacatagggtattcagggtgagggcacagatgcacacatggcccagactcacacacagcacagtcatctacatggcacagacacacacacgtacccatacatacattgatgcacatagcacatccacacacacagcacggacacacacgcacccatacttacattcatgcacatggcacaggcacatacatgacccagatgcacaaagggcaccagaggcacaagctgcccagggtttgaggtggggaaaatgtaagcagtttgctgttgccgtatatcccggttctccgttactgtgtaacaacccacccaagccagctgtgtggctttgttagtacctctggtggcttgttgggttgactgggccagacagagatccttgctggggatctctctggtggtcacagtcagatggtagctgggactggagtcgtctgagcagtcaactgggctgaacacctgagatgtgttatgtttttattttttattttatttattatttttttttttagagagagagagttttatttactctgtcacccaggctggaatgcggtggcagaatctcggctcactgcaaccttagcctcataggctcaagcgatcttcccgccccagtctcctgagtagctgggaccacagacatgcaccaccacgcccagctaatttttttttttatttggtagggacagggttttgccatgttgccacagctggtctcaaactcccgagctcaagtgatctgcctgcctcagcttcccaaagtgctgggattataggcatgagccactgtgcccagcctatatgtgttgtttttaaaatatacactggagcaaagcttatacactgctgtaactgctctttcctcttagcagtcaatcctgaaggagatcatccatatcagctttttaatcatgttttgttgtgtggatggattgtaatttatttaaccagtccctcatggatgagtatttagtctgttttcttttgcaattttgaacaaaatgacactgaacatccctgaacacaaatcttgacacacacacgtggatatattggtagaataaattcttataatagaactgtggggtcaaattttcgattttgatactctccaaagaagtcataccagttcatgctctcactagtggtgcagcaactagtacgcgtttttgctgaaaatttttatgatgtgtaacatacacatagagaagtgcccaaattacaactgtacagtttgaagaattttcacaaactgaacatacccatgtacccagcacccagatcagaaaacaggacatccctggcacccaaggagccttctctcagcacccttgcagacggtctgcctcaggccttgagaatgtctcaaatgaatgttccaagcctctgctctttcccagacactgtcctagactcaatacgggatccaaggatgaaaaagaggcagattgtttgcaggaaacttgcaaatagtagaaagaagatacagccaaaaagaaatcttttacagggtggaatcgcagaagaaccattagagaaccgtaaacacagcgttaagggacagcaaagaaaagggttgccggctggctgggaggggctagaaaggctttggtgagagatcgtggtgtttgagaagggccttgaaagagggatggagcatagggaggagaaatgggataggcaggggtacagagatgggaaggcagtagtccaggggataataaacaatactgtctgtgacttagtagggcaaatagtaggagaagccgggaagctagattggggtcctctttagatgaccctttgtgctgggatgaaagtccaaaaaaaaaaaaaactacaccacccctgcttcaggccctactccggttccattgtccaagcccaagcccctcggtgggccggtggggagccctttgtggtggtgcccatctcccaccccacctctccacactgcatggcagactcctggcaccctcactgggcactgccccacccattgccatacttcccgtccggcagaccttctcctggcactgccttggatcccagcaaaagcagcatctcttctagcctctgttcgctccctggctacagtgtttaccttttttaacagtgatgatctgtgaacacatctatttcctgaacaagactttcagctgctcaaagccaaggatgctgtcttgttttctgcatctccagccccttgcacagggcctgggagtttcctaaatgaaaaagcgagtgggagtttgtgtttgattcagctgagcatgaagaacggttagagatttgagggatgattttcctggatttgtagtctttgatattgtttacctggcagtggcaaatgtggagggagtgaagtggagggatggggactcgtggtggcattgggaggtgggacccgagttgtgcccattgcctctgtggctgctggaggatcggttgtcaacacagtagtgtccttctgtgcttgtatgacccaagctcctaatccgaaatttctcattaacagcccatgaacccaattccagcaccgttgcctcctgacataccaagcttcaacctcattggtgacagcctgtctttcgacttcaaagatactgacatgaagcggctttccatggagatagagaaagaaaagtatgtagccccctgtgccctgctgtgggcagctgtgaactagactgagtgattggggccttgggaagctggggcagaggtgagaggtcgctgcagcagcctgtcattactcctgcaaaggtttgctctgctcttacaccctggaggaagaatttccttaatcagaaattaaggacaacagatcagcattcattctgaacgaataaaaataacaatttttatccaggataaaaataacacttgactggtgagctggagtttttggtggctctaagcctcacctaaagtgtaggactgggttgttagcatctctgagtcagttcaactgctgttatactactggactgtagtcacctcctagttgtgttctccagcaactgggatctgtggtggttcccatgtctagaacaaacaaaggtgagagaagagactcaggctcgaggctaaggaaagctgacagctggtggggccactttgctgcagtgggtggcactgggcagggccccagcatggcctgatcatggcagcaattgctgagctgccctccgtcttccctttattgtgggtagaagtggatcagagatggaaaggaaaggatccccactgcagaggaaatctaagcgagggcccctagttcccagagctagcggtaagttggttaactgctgctgcttgctagaggacaaccacagtagctaccatgcattgagtgcctgtgtgtcaggggttttggcttttgtctcatttaattcctgctaacttacaaacatcaaaatgacatcaaaggtaggttttcatgttcccattttataagtgagaactcagatttagagagtttagtgaactccaccagcatcccacagctgatgcagaggggttgaaacccctcacccatctgactctgcagcccatgtgcttttaccatgggtggtatcctcaggaaaaccctttggggaaagtgtctccatggagtccagtatgggcaaccagaacccaggctgtttttctttgggctctcacactgagggtatagctaagtagccaatgaaccagagcctctagctgtcatatctgctgtccatgttcctttcaccattatccagacatatacatttatgtggttgggatccgggatcagggtgaagctgttctgtgtctgctattttatagtttgtattttgttactatcttagtttgttttggctactgtaacaaaataccagaggctgggtagcttataaacaacagaaatttatttcttggccaggcacagtggctcatgcctgtaattccagcactttgggagtccaaggggggcagatctcttgagccaggagttcaagaccagcctgggcaacatggcaaaaccccatttctactaagaatacaaaaattagctgggtgtggtggcacatgcctgtggtcccagctactcgggaggctgaggtgggaggattgcttgagcctgggaggcagaggttgcagtgagcccagattgcaccactgcactccagcctgggcaacagagagacaccctgtctcaaaaaaaaaaaaaagaaaagaaagaaattgatttctcacagtttgggaggctgagaaggccaagatcaaggcacgggcagaggtggagtctagtgagggcattcttgctggttcataatcagcccctttttgctgcatgctcacccagtggaagggatgaggggtctctctggagtctcttttataagggcactaatcccattcatgaggctctaccctcatgactgcccaaaggccccacctcctgacactttttttttttttgagatggagtctcactccatcgcccaggctggagtgcagtggtgcgatctcggctcactgtaacctccacctcctgggtgcaagcgattctcctgcctcagcctcctgagtagctgggattacaggcgcatgctatcacgcccagctaacttttgtatttttagtagagatggggtttcaccatgttggtcaggctggtctcgaactcctgacctcatgatccgcccaccttggcctcccaaagtgttgggattacaggcgtgagccaccacacccagccggtgattaggtttccacatatgaattttgaagacacgaacattcagaccatagcacttcttacccttgcacatattggcagagtctctatactaaccatggcaatccctatggagtgtttttggtatttgtattgcatggtttttctggccatgccttgtagttggacactttgtgggtggtttccagattttcaccatcatagatgctgtcactcagtgttatctgttctcaggtgagggtggggatcttttcttccttgcgttgggtgagcttctgagtgagcttctgtcatctttagatgaagtctcagaacaagtgggaatgtggatgtggcctatcaaaagagatcacgtgaagctgggcgctgtggcttatgcctataatcccagccctttgagaccaggggttcaaagccagcctgggcagcatagcaagatcctataaaaaaaaaaaagagtttacttgaattactgctccaagaagggttgagacaaggagattgttctgggttcccaggaagcttgtttcacgtatgttttttttttgtacagaacgaaaagctgtccatgagagctggtatttgtagagccccctatgagaatttaccaagggcttttctactctttctttttctttccttttctttttttttttttaaaaatagagacagggtcttgctatgtttcccaagctggtctccaactcctgggctcaagcaatcctcctgcctcagccacccaaagtactgggattacaggtggagccaccgtgcctggcctcctacactgttttatttaatcctaaccacggccctgtgatcattatcccaattttaatgatgaggaaacattcatagcatttaagtgaccagcccaagctcccatggcctgtgagtggccaagtagagacgtgaaccccaggcctcaaaccctagatcgcacaccaagcagcttgtgggccgcagagcacctgagccgtgtctcactgtctgcccaagccctgatgcatgataccctcttgccggcagagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaaggtacccagggtctctttcttgtattttgctgatcaggaccatcattaatgaaatgtgcggttggcatctggtttcctcagtagccaagtcactagactattggcatcttttgtatgtacttagttgaggaaattttttaacttatgccagaaagggaatttaatctgccaatgactatgaacccattggctggatggaagttgagcttgtgttaaaagctctgatgtaatgaacccctgttacagggtggattttgagccctcatttagcagtaaagcataatgcccttttaagccaaggggtgttatacccagggagctgccttactttatgagaaagcagaatgaaatggaggctattgagaatggactttccctctagtcttgtggtgtctttaagtggcaaggactataaaaccaaactgaatttttaacttttttcatacttaaaaggaagtgtctaggaaagaacctctttgttttaaaagagaagactttattactttgcaaatggtttcatatctttctctactggtattttgagctttcagcattgtcgagattcagaagctaaattccatactaattatcagcccaagagcatacctctctcatttgggccaagcagaagggtcctctcataccaaataatgctctgctcttaactgatagcccaggaccaggttaacacctataaaataggtgttattaagataagactgtccattgagtttaggtgatactgatacagttaattttttattctttacctcagtctttaaaataggcttccagttttatggactgtctctgtttttagtggttaagctgtatctgaaaactccaggggatctgtttctgcctgccttcgttgttgggtacagtaggcagccctgacttctacctctcgactccagtcacaactggcaccgggtagagaattccttttaatagtgcaacctagaaggaaaggcatttccacattccacattcttctttcctctggcttctgtaatttactgggcttcccttccaaaacaaaattattaaacagtaaaggggagttcaagggaggcctcggtcattaaggaaagaggtaaaacgatggctgagccagtgagccagtcagcccttaaatgaactgcctcagacaccccatctcaccccttacccccagccttgtcatctgggtcccaggaacagtctcaccatttccactgctgctgcaatgagcagtgccctcagccacagaaacctgcagtgtgagagctggagagaccccgttccaagccattaaaacaaacaaaatcactcatcacgatttcaggcctatccaagcattttgcagatggcacttatggcattgttgatatcacagggtatgtttttgtttttcttcattttattttgctggtttagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtcagtggttccaagaatccatgacatgaaccctgttttgtatgcgacactttcatttagcgggctcctgtttcttcagctttcatatccttgttggcattgataccctgatacagaacagtccgcgctctgagcagggcagttatggccagcattgtcacgggcaggccagctcatggcacccagagcagccaggtggacccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcctgttttgtttttaataaggttttttgtttgttttgttttgtttgagacaggatctcactctgtcacccaccttggtgacagcctcgacctcctgggctcaagcgatcctcccacgtcagcctcccaagtagctgggactacaggcatttgccaccatgcctgactgatttttttatttttatttttgtaaagatgggtttcgccatgtttccaggctggtctcgaactcctgagctcaagtgatcttcctgccacagcctcccaaaatgctgggattacagacatgagccatcttgcctggccattgtatttgtcctcgttttcagtactcttctgcctcactgagaggtctcagagtctgctgtgtggtttcagcagtacccatgggggctgtgtaacattgaagctgattcaaggagtttgcccttaggttaccaggggttaccgcattccctgaggaatgctgagcggccatccagtctgattaaccgaggttcctacttctctgccacttcctttctctataattcttactcgctcgctctctctttttttttttttattatactttaagttctagggtacatgtgcacaacgtgcaggtttgttacatatgtatacatgcagctataaaaaaggatgaattcttactctctcttgaggcacagtgtcctcacctgcaaaaggtggataaaaatagtctttgcccccaggagtgttgtgaggaataaatgagagaatgtgtgtgcaacactcagtgcacagtcagagctcagtaaggggttaaaactctgaaaagggaaaatctgcttgtgatcctgcagcaaagggcgaaggacggcatgtgggccacaccgccacatctaggtacactgcttgtgctgggcatattcattcattgtattaattgctacgtggctgaaagtaaaaacttttaaaaagccataattggccgggcacagtggctcatgcctataatcccagcacgttgggaggccgaggcaggtgaatcacctgaggtcaggagttcgagaccagcctgaccaacatggagaaaccccgtctctaccaaaaatacaaaatttgccaggtgtggtggcgcatgcctgtaaacccagctacttgggaggctgaggcaggagaattgcttgaacctgggaggtgggggttgcagtgagccaagatcgtgccattgcactccagcctgggcaacaagagcaagattccatctcataaataaataaataaatagccataattaacttcactgtttccttgtaatatttcacttgggtttgcaaggatgtatttttctcctcttgctaatcttaacttcctgtatttccatttttcccaattgatgatcagtacaactagtttgccatttgcatctgagtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaaattgcagtggcgatctgaactcttcctctccgcctcctggctctgtggaagcccagggaaggcattaggaactgcaggctgctcttagtgctcctcccggatgggacaccttgggctcatccctgaaggccactcctaccactctcacacactgagttcctggtgtctcgtaactgttgagagcttagttttcttgcttgtttctggtagctctagatagaagactgtatcggcctcttctaaaagtcaacaagccaatcctgtttttggttaagagactttacctggtcaagcagttgttctttgggaggtgttgaagagcctacaaacctgccttgcctgcctaggtactttaccaccatttggagatgcctgaggatattaccaggccttatttgaggcagtaaaacaccctgttcggcccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgctgctgctggattcagctgtcacctttctgctctgagtctgctttctccctgtggatccggtgccagaggatctgcacgtccttttgtgtctacaccctcccccgctccttcgttttcaatatgtagtagtggagaggaagtgtaacatgattttagggctcacatttcaattccactgcatttttatgggacaagcagagacccagcgcctggagttattaggttagtatctaaaatgggttcagtactgtgagtcttattgtttaaaatgaatgagatggtcccctcctaccttcttttctcctcccctgggatgagtggattgaggcaaggcccccagagactagttgaaggaatcctggtgctctgattagttttgttccccagcttaattgtacagcttcctttctctcaccactgatagccaaagtagctctgtgtctcccccaaccttcccttgctttaggaacaagatgatcacaatgcagccttgtgaatcaattttctgtctgtgctgatgaaagtgtaattcattcttaatcaagcagccttgctgctgcaggctccgtgccggaatacatttagttaccctcccatcactttgggaaacgatcccccaaaagggcttttagaggagagctggaaggagagttggccgtgcgcctcatgctgtggttttccagcagggggcactcaggaacgatgctggcggaggctttgtagctggaagccgtctgctgctggcagggcagcaggagaatgtttgtcacaggtgccttccaggcttgctttctccagaccctggggccatttctcagaagtaccctaatgggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcctcttctggctctagcaagcaggtgttgctgggcagtgtagagggacccaggccggttgctgagcaggaagatgtacctaacactgatgggcctgcacaccttagggtatgagagcatcgcaggggaaccaggaaacttgttagctggttttcatgtgtttaaaaagaagactcggaggcagagtttattttatgaagggctagctttttgccatttcttctgagcttttgccttttcctttatgaatacttcctgcctatgggtgtactgtaaatgtaacagccagtgagctttctagaagcagcagatggtgaaagatccacaggtgaggagcctgcccactggaggggcgagacagtgcccaggcagggcgtgcaggtggcagagctgtttgcatgctccgcggggtggcttcccaagctctctgtagaaaaactgcctgagggcaaatggctccactgagctgctacctgcaggaaagaagctcaagggctctcctcgtctcactgcctgccttcttcacctgctgggaggagggcattgtggtgtctgagataaaggatacccccaaggtggaagcagagccatgggggtggcctccagcagcagggaggagcattgtgcagtaaattctgactccggggctcctgtggggattggaacccataggaattgcacaatgagggtaaaggatggggcggcagcagccaggtctgtctaaggggcgagcagcagtggccgaaggctcccagggccctcgggcagcagcccttgctgaccagtgcagccaggtcgtggctgcctccagctggtgggtctgccttcccctctgaccgcctcagtgccttctggaggactgtggctctctctcctgcccagtggctgtggtgccttcctacttctgtgtgggcagactgatttccctctctacctttacttgtggctgaggcgaagctcctgctcttgcaagataagaggtggggctgaggcgctgcagtgcagctcaggtggggctcaggaagcaccccacccaccccagagcactctgcatcctaataagcacatgctcgagtcactggaatctggtgctgctggcagtgccagaaccctcccctagcacctcgaggggacagccagcatgctcctcgggtggaggatccaggaattcttggagccaacattgcacaaatgggcaggagcctctcaaggcccccacagcctgggctccctgcctggggaagtggccaggcttcataggggcatcacttggcccgcctggtaggcatggaggccagtgccatacgtgaccttgttgttgcctgcaccccttcctaacgagcaccctgctccccactggaaggagaggggccagggctcctccctccccagggaggggagaaacgtgatgttgctattagcaataacagctgccgagttcccaccatgcgccaggtgcagtgttgagtgcatcacacgcggttcccaattcctctgcctgtcaccccacgaggaaggggctgccatcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaatacttgccttgggcttcctcagtttgcctgttgctcaggccattgaggcgtcaagaacacggctgggtggtggggctgtcttgtggttctgtggagaaacgagccctctgctgtctctcactgcttgggccttcacctctggccccttgtctttggtggcaaaagaatcacctccttccacagacctctaatgacaccttcgccagggaactgcctccctcttcctggggcacttggggggtggcaagggccctgcatggcgtcccagcactccatttcctctctgtggtccctgcccatccgtgatttcagaccagagaactagggagctgggctgggtgatccttccagacatttctgttttcggcgttccaggctctgggggtgcatgcagagcccctggggcccaggcgctgtctgcagagtaaatgaggcgcagccactgtcagggctatgtgacatttgcacttgaagttggaaatcaccactgcagagcttatagtttgggttttgcttctgttttcttaagcaacaaaagtcctttattaagaccaaaacttctataggataactctgtcccgaagcactgcagccccagttggagagtcagacagcacagtgtggctgccgggacttctaagggacccactcgacacacttgtcaggacatacttcaggtttccattgcacaagccagtgaggaaaacagcctatcaaaatacacaacgtctttccaaaatgttttgagttatacataacttgtgtttgtttttttttttagaaagatgtttgaagtggataaactaaagaatatgaaaagttttttcttttttcttttttttttgagacagagtctcactgtgtcacccaggctggagtgcagtggcctgatctcaggtcactgcaacctctgcctccccggttcaagtgattctgctgcctcagcgtcctgagtagctgggattacaggcacctgccaccatgccaagctaatttttttgtatttttagtagagacggggtttcaccatgttggccaggctggtctcgaactcctgacctcaagcaatctgcccgcctcggcctcccaaagtgctgggattacaggcgtgagccaccgtgtccggcaagaatatgaaaagttttaacaatttgttgttagctttgaatatatagaattggtcaacctgggccacatagagagaccccgtgtctacaaaaaaatttaaaaattagccaggtgtggctgcacctataggcccagctttttgggaggctgaggtgggaagatcacttaaacctgggagtgtgaggctgtagtgagtcaagatcatgccactaccctccagcctgggtaacagcgagactgtctcaaaaaaaaaaaaaagtgacagagtgagaccatctcaaaaaaaaaaggtaactaattagactttttattagatgaataatataaactcattttgcaaatgtagattgttatttttagtaattggaagcagtttgatttcctccgtagtctaagccaaagaaagcactttgaaaaatattggtcatttaaagccgtccaggcaatatttttacctaacctttctattaaagacaacccgacgcccccccacccccaccaaaatagtaaatgggacctgaggtcagaggtccccgctaagtagagttagaattactaataccagagttccaatgactgattctaatggtattttggtatcgaggagatcagttgaattctttgctgttttttctagtctgtagtgaccctgctgtaaatgcaaagcgggggggccagacctcagtgcttcactgtggcatttgccgccagtcccatcggagccccaagtggctcattctggcctccctgctagcacttcattctttgcctttggtcctcgcctgagtggggagttcctgacagctgttccccagggctgcctaccccagaagccttcgtgtggcagagaggataaggagccacccacatataatgaagagttggcagtgaaactctggggggaaaggtattggcgagaagactgctgtgactgtatctagtccaatttcttagccgtctggggaagagaaagtcgggcacccgcatgttctccgtctccctttcagacagcccaggcagcgtcatctccagcagagagagggaggccaagggctcctctccccctcccctgccaggccgtgtggggctccctggcagcctgtcattactgcattatggcaggatcctagccacagccccagctccggtagggagaccgcagctcgcttccagagagatggctctggacctctgcgccgtgatgggagcacctggggaaaattacagggccgttaatctgcccagcaaggactcgagctgactcggagaggaacccccgccgtgtcctctcctggtttccacttgatgcccatttctcaccaacttggccccagaatagcacctggcattttgcctctgagctgaaatcaagacttctcttgaagggctccgcagtgggagcagccagaggcatctcgcccctcccctaagccacacttgcccagggcagagaggtggagggcacctggctcttccttccccacaagggccagaccttccaccccctgtgaagacagttgacagtgaggcctctgggtacccgggggatgttgtcaggataacgtgaaaaacaggaacaaaatgcactcaggtttctaagaaaaggggtgtggacctgtcgcagtgttaccgtaacttacaagtaatagacgcagctggcctgaagaaaggtgaaatctctaccattagctgcagggggagctggggaaacggcacagctgagaggctaagagccctccctgcctcagaacacagacaaacctgcgttcctgctaggccactgaccagccatgtgagcctacgtaaattgtccagtctattgggcactgcagttttcttcacctgtaaaatgggaattttatagggttttgtggggattacgaatgcccagaaagctctaagcaccttgcctagatgtgagtcaccacttggtacacggtggctttttttctgatacttcttttgggggcagagggcaagaggaagcaaaggaaagagccatagtgactcaggggatgtcacagctcagagggatcaggcccactcacggctcccctgtggcctccatcccctccacctgcaccctgagcttaatgagcctgcagctggtctgtttgtccaagcccatgtttgcccagtgccagctgcaaagcccgggaaatgatagataactccgggctggagctgcctgcgaaggatgttctcattttgtcccattaatactggctgctcaggtcaataattgactggaggctcagggtgggagagaaccaggtgggccacactgtgcacatgagctcttccctgagcctgtgagtacctgggctgtaaaaacccaactgcagacgccagggaggcacgggagtgacctaattttctcttatcaggcataaggaagaagtcccatggagccttgcccatttctgatataaataatgtcattccccatctgcctgctcagggaggaaggggcagcctttgatctgaaggaattaagtcggtaaacaaagcaaagaaggctgctgaggtgtcccaggcaggcacctgctgtgccatttaccctgagagagagagagaggagttaaatttggaggagtggagtggaccgacagggacagcccagcctcaggccggccctccccggatctctgaagtctccctttatccccagctgagccaggcagcgcctccccaggaaccctggcacacccctgctgtggcaagctgcgcatggtgtctccatcctccccagcaggggccctccttgggccctggggattttcagcagaggataattcccagggaatatatctgagaaagtcaagtgctctgggatgagcagattagcctggagcccggggctggagaggagctccactctgggaggacagggccctgtctgtcccagcagaaggcagctcaatggtccagcctgcgcttcaggccagctggctgtgggctctgatcccctgcagctctccgcctgttgctgtgtggccttgagtaagtcccttccactctctgggcttccatgccttggctatagaaggtcaggtttggaccagcagaactcgaggcccccttaggttccaactccacagactggtcccccgaggtcctccaaggccatgtcaagccagcttcaccttccaaggagccaaaatgggagtgactggcccaggataccgcaggagtggctatggctacagccatggccgggagccggagtggaaccaggtgccctgcagggaccccagcctggggcctgtgttagagctcccaccacatccctcctttctcttggacccactatcctctggcacaaattcgggaggggccaccatgctgccagcccccgagctcaagtgaaaggcagcaggcgccagggcggggattggcatggccactctgggttttcctcttgagcaaccaggcccagcgcctgtcagcccgggtggcagaggggggtggcaggagccgcagcgtcggccgggcctgctgtgacagttgctctgccccgaaacccatgggacctcccttctttgcccacgccttcatccttccccctcctcactcgccagccttccgcacccagcccgagttcctgagttcctgaggctgaatctattaagtccttcatattaaccagcaaagggggaaacaaccctctttcatcttaactggagtgaatttgcattaacacctggggagttttgtttgccttgagaaggcgcattgctattctgagccgcacatgctgtggggttagtgcagtatcctattcttttattaatacggctttcctctcctccctcctcttttcccatggaagggggagagcggctggggatgccagggctccccacatcacgtaggaagggcccctggaaatgccaagttgggagagcagctcccagctggggcagattcttcccctcagaaggtggtgggggcagctcccagccccagtccagagtcccctccctgctgtgtccagtgcatgctgtgtgtagggtggagaaccctgcaaggcagggctcagggaaacaccccaccctcaggagctcctcagggcagggaaggtatggggagggggacaccagggggccaagagctgtggatactcaaggatgacctccactgggctcaggggccccgtgaggtctctcccccagcgttacaggggagcctgacttggtggctgctgtgtgtctgccccaagcgtgctgcttctgaccctccggtgacaggactggtattagccaccttcggtcctgtccaggctggagcacatggatgcaatttaggatgctcgagagtgcctgggaaatgctgagtctaggatgggggtgggttgggcaaaccttggttttcaggcctcagacctggagatcaagatcaaggttctagaaagagagaagtttaaggcaggggagggaacatgaagagtgaatgcctccccaggacccctcacccccgaactcctgaccaccccgccaccctcccctcccctcccctcccacctcctaaccacctcgcccccctcccctcccctcccacctcctgaccaccccgccaccctcccctcccctccccccacctcctgaccaccccgccaccctcccctcccctcccccaccacctcctgaccaccccgccaccctcccctcccctcccccaccacctcctgaccaccccaccaccctcccctcaacccccacctcctgaccatcccatgagatggcgaaggggagaaaggtgcagggcagatgggggtggggagctggggcagagaaggggtcccatgaggaccgtgggtgaactggggatgggggtgtccgggccccccagtgctgctcagagttaagaacttggcctctcagcctcacattcccctcctgaacaacggagtgcattcagaatccaccacagggtcgctgtggggttgaatgagatcacagggaccggttctgagccagtgccggctgcagtgagagtttattaaacaaggcctgccgctgtgtggttatggctgtttactcttagcttgtcctgagccagttatcaaaggagacagctcagggttgggagggcagtgggccaggaggggtcctcacatggctgcgccttgactcctgggccctgggcccatctctagaccaccctaaacggcccccccagtaaagaaacgggcaaccctcccagcaacgggcatcagtccattgtatattgacagcaggagaggggctggtggttgcagatgtccccaggggggtggcagcttcagctggcctgacacagcccctcctcagggattggtgggagagtctggaggctctggagaccctggactggtatcagcatttcatgggcatccccagcccctctggcagcctgccagcccccactcactactggacccatgccaggtgccacggctgcactctccagtgacatttaccagctgggaagtggccacggagacttgaaatcaatgtggcctgcagctagcccacttcattagagccggctcagctccactgggtagggcagcacaggctaagcgcagccccctctccaagcctcccagctcctcctggacccacctgcttggctgatgggccccgtcccaaccccagcactgatcctgtgtgcgtggggttggggccacaatgtcttctgaatgcctgctctggccaggccctagggaggatgaaaagaacgccagcagtgacctgagtgggcctcggcacacttggtctctccctaatcctcacagcagtacccagaggaggccgcgaccattaggcacactagggcccagtgaatgccagcagctcccacttaggccttacctggagtcatcaccagagacccccatgagagccccatagagttaccattatccccatgtaagacagaggaggaaactgaggctcagggaggccaactgacttctcggagctgggacttgaaccttgtcctcctcatgggcctggctcattcagcaactcaacctcagagaagaatccccccagccccaccccgctcagagtgggtgggacaggagaccctcccctcacatttcctgggtgcagcccacgaccctctgagggggctcagcagtgggaggcccagcggggctcggtatgggctaagcagtggtggtcccggtcttggccttcccctcctcatggcaggggaggaacctgggatgtgggactgggctcggtgctccctggtgaggaggaaagaacccaagtctggggagcagatgctgctctgcctcctccagctgggggccccaagcaagacacttcacctctttgtgctccagtttgctcagctagaaaacggggtcactgatgtctgccttggatgagtaagtaagatgatgtacttacagtgcttgcacagcgcctggcacagagtgaggacccagaatgccagggagctcgagccaccagaagggatgatgtcccataacatttgcgtttatctggcaggcctatgcagatgcaaaactcagactgagccacatgtaacctccagagtgcccggggtgagctggtggcccaagcctacttgtctggcccccatccccagcaccatgcccagcacagcacctggcacgtagtaggtgcccaggacatatctactcagtgaataaatgagtgtctgtttacccatctcgagcatctcagtgcctgagaaactcatcccactcccaggctgctgtgcaattcaggtgaaatgatggcttggaaagggcttgtttttataattaaaatgcagagaaggaggaagagggaggcggtgacttcccagcaaatgggtgtgggggctgggagagggtacggggcctgatgtccccctggccagctggttgggccagctgagctgtaatcaccacgggcccaatcatcaatcagccacccactccccacgcctctctggccaggaggagcatccgtcaaagtctccttccccatgacggcccagacaatcaggcagtcccgcctgaatccaccgcttgaagcctccgcctcctcctcctgtcagtccaagaggcaggggccaggcagggtcacacccccaagccaggccagcctgtcctgagccctgtctgcatgccaggcacaatgcccacctctgcacatcctcctctcccttggcggggggcactgctgcatccccagtctttacagatgaggatgtggtctcccgagactcactcgggtcacacaagtgagtcccacaagagctatcactctgagcccccacttttaacctctgcagcccttctccaggcctcagtttcccttgtgcaccagcgagcagcagttttctaaaggttccaccccgaggagccggctggcccccagccagcatcgcagggacagcatgatggatgaggatcccgcggggggcaggtgcgacacgcacacacacccgccgaccgaccgttgggtgatggatcttttcctcctctccccctccccaggagctcggctccatctggtcaggcgcagtgccaggctgatggatgggccactcactgggccaccctcgccgaggctgcctcctgcactctggatactgcacaccagggtcagcagggtaggtctgcggatgctcattcagtcattcaacaaacacgtattcaccagggcctactatgtgctagaatgaagcagtgagcaaaacagactaggaaaccagccatcaccctccatgtgacaaatatggtcacagggcaagcagagggtgactgtgcaagccagaggaagcctctgagctgactcgagggaccagggcaaggagtcttcacaggacaaagcgagcagcttctaaaaaggcctccatgtgagaaagggcaaggcatgtctacacaatagtgacaagttcaggatggtggggttgggacgggggcaagggccagggcaggctgagaggtgaagcaaggccagtttgggctcaccccagggcaggagggtgctgggccaggttggcatttccaaaagaccctgctgctgccagggaaggaggcatgctgaaggtctgctgaaattcaggagcaggcaaggcgtggtgctgtgcacctgtaatcccagcactttgggaggctgagacaggaggatcgcttgagcccaggagtttgagtctgcagtgagccatgatcaccccactacactccaggctgggtgacagagcaagaccctgtgtcaaaaaaagaaaagaaggcagggcacagtggctcatgcctgtaatcccaacaatttgggaggccaaggcgagcagatgacttgaagtcaggagttcgagaccatcctggctcgaacatggtgaaaccttcatttctatgaaaaatacaaaaacggccaggcatggtggctcacgcctgtaatcccaacactttgggaagccagggtaggcaggagctcgagaccagcctgaccaacacagtgaaaccccatctactaaaaatacaaaaattagttgggcatggtggcatgtgcctgtagtcccagctactcaggaggctgaggtaggagaatcgcttgaacccgggaggcggaggttgcagtgagctgagattgcgccattgcactccagcctgggcaaaagagcgagactccatttcaacaaaacaaaaattagccgggtgtggtagcacgcgcctgtaatcccagctacttgggaggctgagacaggagactcgcttgaatccgggaggcagaggttgcagtgagccaagattgtgctattgcactccagcctgggcgacagagcaagactgtctcaaaagtagaaaaaaaagaaagaaagaaatgaaaagaaaaatgcagaagcagatcagccctggtgcaggggatactggaagagccagcgaagagcagggatgtgaaatcctggaaccaacggcggtcagtaccagaagccaggggtggtcgcatttgccccattttaaagatgagaaactgaggctcggagttggggaaggattcacccaaaaggtcatgcggggcagagaaacagagctgggcaggaggcaatgctcggtgagagctctcggcccgttggacctccatgtccaggcgccctccccctctgcctgtagaggctcagcagcctgaggacacccccaccagcaccagcaactcctcattcagggaggcagctgtccccttcgcgccgccatggacaggagccaggcaagaaatatcacatcattaaaatgacaaatcccttcactaactgaaccagaaggcctgcctccccaccttggatcccctctagctcatctcccctcccaggctggcaggtgggcaggggagcctgtgcggggtatggcctgttgtggtcaggaccatcgccttgctcctgagatgaccttggtccccagacttctgcttcacggcatggctttggtgtctgggatcccatcagcacttcccagcaggagcccgggagaagtaggggctccattctacaggtggggaaactgaggcttggagaggcgaccctccaggtaggacacccctctgcaaagctcctggccactgggcctgagcagagaccctgccatccctgccattccacagcccatgtcctgcccctgctcagaacaagaacaaagcatgacccacgcctcaggatattttcccagcccataaccagctgcagagcctgtcttcagggtcaatcctgccccctaccagggtgggacatgtttttgtctgagccccaccttgtcaggaggccagggcaggcatcattctcctgaattgaccgggcaggaacctggctgccttgggcaggctgctgccctcagtttccccatctggcaatgggaagctgcccctgttctttttttttttgctttgagacagagtttcgctcttgttgcccaggctggagtgcaatggctcgatcttggctcaccgaaacctccgcctcccaggttcaagcgattctcctgcctcagtctcctgagtagctgggattacaggcatgtgccaccacgcccggctaatttttgtatttttagtagacgggatttctccatgttggtcaggctggtctcaaactcccgacctcaggtgatctgcctgcctcggcctcccaaagtgctgggattacaggcgtgagccactacgcctggccagcccctgttccttttgactgaggctgagcttgcacagggcctaatggatgtggagtgagcacctgtaacacgtgcatgtacaccgcacattagatgcctgtgatgtgtgcacacttgccacatgtatgtttccacctgcatctgccctggccccgggtcctcagagtgtcagacccctgtgtgtgcacatccaccctggcacccagacacccagccacagatgcacacatctgcaccaacagcccacatccacccagacctgttcgtgcacatcagtgtcacatgcccacagacactgagagcccacatggggtccctgttcctctggggagcagggcaggtgagcagatggcaggagatgtcacctggccccgctggcagccctggttcccagaatgacccctctctctgctccctcatccttcctccgggcccagctggcaaggacacaccgtccgtccgcccagtgtcctggtctccttggacgcagacagagcccacggaagcgtctggcgcatcctgacttggccgcagcagctgcaccagcacccccagccctcttccctgtgcccagcgctgtcctgcctgtccttccccacctgctgggtggccgaagcagccgccacacgctaccatgtccccatggtggggagggggcttcctgcagcagctaccacgaggggcctctccagccctcccgcctgaccttggataggtccttcctctctcaaggcctcagttttcccatctggaaaatcggagggaggctaaactgactttccaaggtcctttccacgtctggctgtgggattctcccaaagaccgggaaaggaaggtgaggccagggctctggtggggagattcaggaggaggaagcggggatttagggacaggcctgcagcgctgggttcagggctctgcttcaagtgcattctctcagttcgtaccccccactgcctcccaatggggcttcaacgccattttacagatgaggaaactgaggcctggagagatactacgcagggcaagaaccccccacctccagctccctgcactccctacgccaagggccagagcatgggagccatgcccaaaacatcccgcacttgctgtcctgccctcggtcagggaggtggcattccgggaatggctgtctccagagccaggcctctccccaccccctgctcaaggctcctggctctgagcccgcccaggcactgcccgtccatctgctgttgcttcctggcagggcgagcgggccatacatcacttagccatgccgaggaggctgggccgggcagctgggcagggtatttctgggctcgggtgcaaccccctctgtgggatgtcaggcatggacacctgcctgggaacaggggtcttcttggggccccaacctcacccccatcccccagatggcaggagcctgaaggaggcagctggaggccacagggtgacctggctgaaggggagtggaggtcagactgacagccaggaaggtctgaggtggtgcggctctgtggcatttggcaggaggacagagatttttatctccccagcccctccacttcgccatgcaacgtgctgatgtaggtcgctggggtgctgcctcctgactgagctgctgccggggggatgggtgggggacaggtgggagctggggcagccggaagaaaaaggttcacagccaggggcgtctcagccaccactcctgtccccaaacccacaaacctgccccccacctggccctgcctaccagggccgctcctgcaggcagtccctagctcttcatccatcccacaactaagtacgagcatcctctgtgtaccccaaaaccagggacgcagcagcgagcaaaacccagccccaggcaaggaaggagtctgcggtgtcactaggagaagggcaaggtttgtcttttacttgtttatttttaaagctagggtctccagagaagacccagggagaaggtgaattttgagtaaagactgggcatggtggctcccattcggtaatcccagcacttagcgaggtcaaggcaggaggatcgcttgagccagaagttggagaccagtctgagcaacatagcgagactctgtctctacaaaaaaattttttaaaattagccgggtgtggtggcacatgcctgtagtcccagctactcggtaggctgaggcccaggaggtggagactgcagtgagctatgattgtgtcactgcacccagcctgggtgacagagtgagaccctgtctctaaaaaaagagaaaaaaagaaaaaagagaagaagaaagaaagagagagagagaaagagaaagaaagcaagaaagcaagaagaaagaaaagaaagaaagaaagaaagaaagagaagggaaagaaggaaggaaggaaggaaggacctgaaaaagtgattgtatttgggaggagagcattcctggcagagcacacagcaagtgcaagggccctggggtgggagtgcgcctgccaggcgaggccagcagagcaggtgagctgggggaggaaatgagagtagagaggggaggagggagacactgtgggtcctggggcaactttgctgacttcagctcttccttggaatagggtgggagccactggaggactgggaagggaccgtgctgtttgggggagtgattggtggtagcttaagggcccaaagggagatgttggagggtcagtgggagggtcctagaggaccaggggccgagcatgtgacagaggccctctgccatctgtctgtcctcctcctctcccttccgcccctttttttgcttcctctcactccttcatccagcaggtatttgccgagtgcaggaacaggtctagccttttatgaactcaatccaagggatgctccgccctccccaccccctaggaaggcacctccaatgtccaccctgcagcctggggtggaggccaggccacctcagccgctctccacactctagatggtcagcccaggtgctgcctcctgtgggtgtagaatgaacacccgtgtactggtgtacggggctgtcacacacacatctaggaccagcgtggagcacacaggatgtccccttccctcctgggcctcagtttcctcgtctgagaaatgattggaggacaggacctaagagcctgtcctattctaaaatgaagacacactgtggtcacccagtgccctgggggccaccagtgccaggggacagggctatggttctgcctgtgtgggcttgggcactggtgaggctgtggccatgggccaggctgcacagagccctgtgagccccagaaagcccaggggacaggtgtgtgaggacacagggaaggactaggctgggggagcccctccaccctggcctgtgaggacctggggagtgaccatcattgtccctgtgtgaaatgctctcatagccctcttcctcctgacctgatgggaccctgagtctaggaggagtggtgtgtagacccctggccaagcctccctcacccagctgccccaggagtagcaggagagcaggaggtcttagcaatgacccagctgtagctcgggaaggggccccgcccctcttccctgcccctggccccacatagccccctagctcacccggacccctgcagctcctctaattacacagccataaagcacaaatctctaacgatccaattagtaacgctgttactgctctgtccaggactaaaatcaccaattaaactgctgtcgatttttcatcacttagactcggcacagatggggcactgcaggcctcaaggcccatcctcggacccttgggtggggggccagccaggggtgtgggcctagcttagccctggaggaagtccctccatccaccggggccctcgtaccccactccagcccagtccccaacatcagggactccacagaattagagcccagttccctgtagatctgctggtggcagggggcgcaggggctccccaagcccagcctctccctggcaatgcctccagtctgggcctccctcatgttccctggggacaaaactcatctattccatgttctagactttcagtgtcgggctactctcagcagctgagccctgggacaagggacgggggtggtcatctgaaggtctggcccccacttcccctgctctccttcccctgctcctctcgctgccacaggctcagggtgccaacctcacagggtgtcccccactgtggagagaggttccactctgatgcggtatcacaggttagtattgtccctctcccagttgatgagcaggtgcccctgtaggggcccccagtgttttgtctcaaaacaggaaagatatttgagcacaaagcctgagcccagggacttgatgaatactagccatttccttcagaggggtgagctccctgtctctggaggtgtgcagaggctgcacccaggccacatgtggcaggcaaagacagcaggtcacgcatagggaaggggcagggttgggctggataactgaagccagatcaatcatttggtcctcttgggaaagaattccagacgttcagtctcctgctctccatctctgccctagaagtgcttccacaaagagagagggacaggggcagggcagggcagggcagggcagcaggaagggttcagtcagctggagatggggaggcggccatagcgtgaacgctcagccccaggcaggtgtgctaaaggctcctggtccatgacatcgccagccgacgccggaatatttgtgctgtcctgggccctgggctcagcgtctctcgtctcttaatcatcctgagaaacaggtgcccttattcccaggtgaggcaccaaaactcagaggtccagtgatattcccaggggtttgatgaaccccttaatgaagccatgcttgtgccccctggggggcagggtgtgccgggcaaggccacaaagctgacctggcagcacctggatattttaatgaccccattgtccagaggaggaaatcaaagtggagacggtgtaagcaccaagttcaaggtcatcctgggactgttgatcacagccctacctgagccgcgggtcctgctgggagagaaggaggaggggaggtacctgtggtgggaagtgggtattcagggagggcagaatctatggcctctgctccttgctgaggaacaatattgtcccaagaacctgctggggacagtgtctggaggtgaaataaatattcatttacccacaaactcctaaagtctgtctatttcaacacctgcgcagctcctggttgaagtggaagcttatgcacaagccctttatgtgacacagagagatgcagagaggagggggacaggccctgggggactgcagggtcccagcctcgccctgctccaggacctggcaaggagaggtgactttcctccacctatcaccctaggctaatgcccgggcagatgggagctgggcctcttctcagggagcagccgcctcaggcaagttggttgagcgtctcatcagaggcaacagactgaggcagggatctgggagcccagagcaattaggagctgcctcgcgcctcgtctcccgccagctgccgcagctgtcactcaggaagtggtctgggagcaagggctaggcctgcagtacccatggtccccctcccatctgtgaaggttctgatccctggggcagcctcccagccagcagccccgccaggccccgggcataggtggaggcccagaggacgccagggacaggatctctgtgatttcctaacggggacatccccaggctcctcttacccctatccagactcagtttccctctggaacattggttctaaccctggctgcaccctggaagcacgtagaggagctttagaagaatacctgccccaccccccaagtttctgctcccagcccagaccaacgggagcagaacctttcggggggatacagggcagtgcacttgaatgtgtggcagggtgagccaggattttgcagttattgacatcatccctgccctgagggctggcagcttctttcctctggggaccatgtctcccctcccttccagctggacccagtgcagccgggggatactgtcctggcatgaccttgaacttgatgcttacaccctctccacttttatttccttgtctggacaatgggttcattgatagccttggccagctctcctaggtccctccatagcttcaccctccgcagctgggccctgagcctgagagggaggctcagaaggtccagcctcggacagcagcaccaagcactgtcacctcagcagatccctgcagcaagctgtgtggtggcagcataaactccattttacagggacgaaaactgagaccagggcaggggctacactcaagtcatagagctggtagcaggggtcagacttcatcccagctgcactggactccgagtccagtgctcttttcccatcaccaagttccttcccccaatagcaacaaattcaagggcctgtccccttcactctgtttccctcacatggactctgttccctgttgtcctttccgctcctgtcaccttcaagagctgggcatgtgggcgttcagaggggggtagccagagaagagcagggatctgagcagttggggcctctgggttctggcctgcaccccctctcagcccggtgtgcatctttgagtctataaattccattattcattagttgacttcgggagtttgcccggacaatgaatattttattcacctccagacactgtccccagtgcgttcttggaacaatattgttcctcagcctaggagcagaggccatagcctctgccctccctggacatcccctccctaccaccactacctcccctcctccagtaccttctcccccagcaggagccctggcttgggtagggctgcaattattggtcccagcatgatcttgaacttgaagcttacaccctcttcactttgatttcctcgtttggacaatgggttcattgatagccttggccggctcttgtgggtccctccacagcttcactctacacagctgggccctgagctctgctgggagctctccctggtgctgaatgtggcaagaggatgctggcctcggacaagaggtctctggccagggagggcagggactgtgctgctcttgaaaggagtgggctccagtctcagggagggaagagtctggcctctgaacatggcagttcccacctctctccccttgtctccttcccacttggggaacccccctggaatcacaggtttcagcgtgtcacctctcccagtgtctctagcctcctgacccaatgattagttagcaaggcctgtggagaacccctcttgggaggacctgaggctcaggcatctcccggtgggcaccccagagagtgcagtgtgatggcagcagcaccttccccagatgggggagcgacagacataattcacaccctgtgatcatgccatctgctcccccgtgacgcacagaggagaggacggggctgcaatgccgaagggcggggggcggtggtgagcgggcagtcgttcattcactaattctctcgttcattcatttgacagatgttcatccagccccagccaccttagcccattccagtcctgtgccaagcgtaggagatctggagaacccagacccagacctgcccttcagagctaagagaggccctctcacacttctgagcttttgcccaccctcctcttgacccctggaattcccttgacttgaaaaaaaaaaagccaccatgggttgggagtggtgcctcacgcctgtaatcccagcactttagtaggccaaggcgggtagatcacttgaggtcaggagtttgtgaccagcctggccaacatgttctctacgaaaaatacaaaaattagctgggtgtgatggcatgtgcctgtagtcccagctattcgggaggctgaggcatgagaataacttgaacctgggaggcggaggttgcagtgagccgagatcatgccactgcaatccagcctgggcaacagagaaagactccacctaaaaaaataaaaaaaaatacccacctggacagcaagcccaggagcttccccttcacagggcgagtaccaacacgctctgcagcggcctcccagggagtcactgggagctgggtttcctgccagcctctcagcaggctctagcccactctcccttggcccaggggttctgatttagaactgacaggcctgggctggcacagcctggacacttagtaaacgtggaacgactgagctgctgctgcggctcgctctctcaatcaatactcgaagctataattattattaattcctattccttgggggggatgttcatgctaataggaaactcccaagagtttcagggaggtgatgcccggcacctttcctacattatgtcacttcatcctcaccgctgcctgggatgtggcactgccaccttaacaggcagggaaactgaggctatggccggttaagggacctgactgtagttccatggtgaggagatggtggatgcagaagccccagtctgcctggctcttggtgctgggttcttacttcctcaagtctctgctccatcaaaaacactggggaagctcaaggcattcagctctagcggtggaaggtcagaagatgggacaggtgggcaaggagagctttggagtggggtgggagcttttctggggcctctctcacctccaggcccaggtcccagtgggcaaccagctagcccggagaggtctggggagacagacagacagctggtgtccttcctggctcctccgcaggttatagatgtttctaggagctccctccagagcagggcccaggaagtgctgggcccaggctgacccaaccccgcttggctggggctagcatctctcactgagccccttctccccagaccctgagacaaggctgcgattaatcagtaacaaaaacagaaacaagcagaaaagtgtaatcagcttgggaagggcagggcaggaccgggcagggctgtgcaatcagcgttcctgctgggacctttagctgattgggccaaagggggcagggaggtggtcccagtagggggattcagggaagcacccagagatggggccacagccaggccagaaggtcaccccctcccatgcacatctgtgcaccatatgcccacaccactcccagccccagggcctgcacacctcccccgacctgccagcgtacaaccttggcacacacaggtggccacacactcccgacatttgtccatctgcatatggagtcacagacacctgcgcacgtgcccagtggcacatacacaccctcatggatagcagacatatgcacacgcaggctgctccctcaaacacctgcccccaccccagctctggggtgccgacgtgccctggggcctggggaagccctgcacatacattaggtctgagctgcagccatgtgaactggcaggccctcacaccagaccccacaggcaccgggccatgtctctgtcccgaactgccctgggggccatgagacactttggctcctcttctgcaagctgaaaggtaggggcttgggaagggtccgggactggggccccattgtggggagcaaggtcagcggcagggtgtcagtcacaggcagggcaggaagcctaccccagacgtgtacccagctcttacctgctgctcctgccctgtgaccttggtcaacgtccttctctctcagcctcagtttccccaccttggatcctcctggcacggaaacggtgactcttcttgaggacccaggtgcttggggccagtctcacctctctgggtctacagttcttagttccgggctctccgctcctggtgcgtggatgggggaaggtgagccaaggggcaggaaggaggacccccgcaacccaccccctccctggtcctggtggctgcagacttagggtgaggagagccagtgaacagaggggagccctagtgggaaaggggaatcggggccgaaggggagaaggagccccgggcaggtttggggcggccgctcaggggccggcggcgggaaggggcgggctgggggtggggagcgcggagggggcgggcgggcggctggcgggggaggcggggagcgcagccagcgcggcacagaacgagcgagcgagcgagcggagaggcggctacagcctgagcgccgggccggtagcggccgcgccggcgagcggactagcgggcggcgagcagcgcggagcgcgcggggcaccgaggagcgggcgcggcgggcaccgcgcgaggcagccggagctctcggaaaggccagagcggcgccgcccccgctgcccctgcggggccccggctgggagcccgacgagggagcgggcggcatggcccggcggcccggggcgcgggggcgctaggcccccggaggggcgtccccagcctcgccgctgccgccgccgccctccgcagccgcgcgccccgcccgctccagccgcccccggggccgccaccggcccatgagccccggcctcaaagtttgcggcgggcgggcgggcgcggagcctccaagatgccgttccacccggtgacggcggcgttgatgtaccggggcatctacaccgtgcccaacctgctgtcggagcagcgcccggtggacatcccggaggacgagctggagggtgagtgtccgccgggatccccgccccggcggccctcctacctgtgcgcccaggtgaagcgcgggccaggggcgcgggggcggggggcggggggcggtccgcaggtgccggttgccaggtgggcgccccagctagcagctgtgccccgcggcaagacctgtccgcaccccggggcgccgcggtgggggtcgctcaggcggagagcggcccagcccctgcccgcgtggtccccagcgctgcggaaacttgccgggccccgcagcggggtcacggggccgcgcagtcggcggtgacggtgcggcaacgcggcggactggggcgggggtccgcgctgagcccccagcgccggcccggccggagcacccgcatcctgatcccctccgcggcgcccgcccgcggctctctgctcgcattgacattccgctcgtgtcgctttaaaaattcaatctgctcgggcagcagcagaaggggagagggcgactgccctgctcttgcccgctgcggggccgcccccgtccccacctgcggccgtagccccttccctgcagccctgcggggacccccagcccggcgcgccgggaaggcggcccgggaggcggtggcgacaacaagtggccggactgggcggctaagtcgcgatagccaagcctggaagggaaaggcagagaggccaggacccaaacccgcccccaccccgttccccctgcctctcagactcgcagggggatggcaggccgctggctgggcgaggtcagagcagagggcaggggcaggggtccgggacagtgtgtcctgaggagcagtgagacccctggggcccgcccagctccttccctgctgggctgggggaggtgctgaggtttcccctccccccagacctcctggagcccccatatggagtggagtgggggatctgggctgatgggggtcacggcctcctgggatctgcatgtctgctgttgcaaggggctgagctcacccagaggatgggcctctcggggtaccttggatccaggggtctctgagatctggaggctcattagggcctgggagggtgcagccaagaccagcacagtcagggaggatggtgggagcccaggggaagccatggagggaggtcctccctcaacccaggcccagggtgagggcagatcttagaggagtcagaatgggtcgggggaagatccagagagagaaggcagcctctgcctcgctcactgcaccataggcatgagccaccaggctcctcaccaactgcccctgcaaaccctcagaagcggggagagctgtggagacagggtctggggtctgatgcggacaggacagatggatgattggggccccccgacatgacctcaccattcacccctaaaacccagggccagagcctcctccagagcccggggaaaggaggggtacgatggtggggggcgaaaggtcaggagatggagcataggccttctcctccccacctttgtcccctccggccctgggccacctcaaacctcctgcagatttttccctccagaggccctcatccatcccctcctcctgaccatccaagcaggagtcaccatgtctcccagaccccaggcagcttccgcttcactccctccccttgctcccagcacccccaccaggaccccaccaccccaactccagccctttctgggtccctcctctcctgatccccagtcctggagtgcactccctgaggaaggggagaggctgagaggctggctgcaggggcgaggggccgcagggtgggcagtgcaggggcaaggccgcaggctccccaaccaacgacatggcgtgctggcaggagcccagctgcgttagtcaccagccacaacaagtgccctccccgcttctctcctgtccccttctcctgggccctggggagctgaggggccctgactcagggggcatctgaagggcagggccctccctgggatgggcaggtggggtcatggagtagacagatgcctgggtggtcccagctcatctctggcccagtgggcagctacagatgaaggcaagaagttttccatgaccagcccccttcttggctgcaggtgccctaaaagccctctggcggccccaggtccctttcagcagtccttgaatgccagggctggccattcctggcacggatccccctctgccctctccgcctctgcagggcctcatgagtgctcctgccccagggcggtctgggcgagacccaggccctctgccgggaggacgccattcgcggaggagccacatgtgccaggaagagggagctgggcagcccgggatggaatgctgcagacagtacgtgcctgccgcagaaatccagggggcggtcagtctgagcggaaaggaggaccaggcagggaggtgggaagcacagagttaagatgagggcttcccagccaggcggcgctgggtttgagtctctgcaccttcagctcatggagtgaccttgggcaatcgctcacctctctgagccttggtttccccacctataaaaggggggctggtgatggaggatgcagtgaaagtacctacctagcacagggggctcagggacccagatgcaacatgaggggaggccctgcgggggtaagaggctggagcgtgcagggcccaggcccgtgagggtgtgcaggaggctgagccagaagggcaggctggcagggagagctgggtggaaaaggccttgaaggtctggaaaaggtctctggggacctgtggccctggggaggcatggagggcagttggcagggtaggaatgtggctgcacagagctggcctgaggcccacccaggccctgtgagggacaggcacggactctcttagatcccctctgtgtgcccaccatggctgggacatacaccttttccaacatacacacacagcagagtcctccaggaacactgaggctggtcccagcaccatcagctgactcgagcacccaagggtgggaatggggtggctgcaagtcttagccctttctggccgaagagaggaggaaggagtcagacctccaggcagacagtccccagggtagggctctggggctgacacttggcctgcccagtctgtgagtggagccttcattgagagtggccaaatgggggcctttagggcaggggaggctggggagtcccctttcctacctctctgccctgcaaggccaggagccgcctctgcacagccaaaagctcagggaggccagagtggtggggcacggggccagtgccacggagagtagcagccactgcggaggatggacactaccctcttcagtgacctccagccagtgcctgccctctggactctggctgcctgatggagtgcggatgtcccttggagtctgctggggacttgggccctgatgaaactccacaggttgagaaggacattgggggatgttaggctggaggtggcaggtagggggcaggtcagcctggaaacctggtggccctgccagcccattgccagcatcctcatgccaagatggtacccgtcaggctacccttggccttacgggacgggaagggagcaaggctttcggggaaatgcacccagctgtggggtgctgatggcacaacggtggcaggaaatcacgacacctgccccactcagggagcccccggcagaggccgggcttcagtgatggtgccggagtcgctccccatttcacagatgagacacccgaggcttagagagggacgtgacttgcccaggccactgggctgctaagcaggatagccagaatccaagcccaggcctctggtcccagcgaccgccaacaggaaaggtggcctggtgtcccaagctcactcagtcctccctcttcttctggctctgctatctgggacattctgatttatagcatccatctctgagccaggaccagccagacacatgcttgattttattgcttaatcatcccagcagccccattgtacaggtgagcaaatacctgcccaaggtcaccctgccaggatgtaggagagctgggacttgaccttgggtctctgccacttcaggctgcctccctggctgggaaggtggtgcctgaacccggcctctgtgggcgggtgggagtcggctggggcagggctcccagcacaggcaaaggcaccaaggtgagactttgtggtgtgttggatgtgccaaggaggggtgttaaagggactcatgcatggggaggtggcagtgtgtggatttacctagtggcctgggaaggtaagccttgcctgagaaaaggctgctgggcctgcagggctgcctcccagcttatcgcctgcccgtgcatcccaatattcacctgccttcccctggctcccctcggcccagtgcgttttctcagggtctccagcaaagggactcaggggctccagcaaagcagccctgggctctgggagctcccgaagggtaggagggatgacctggagctcagctcacagcaggcaggggagggggtggctcccactgcatcccctactgtgagtccaggactttgccatccctccctgacatctcccaggcaggaccctgcagaggaggaaagggaggaggaggagcggtgcctgaccctggtcctccttccccacaccaccgtctggcccccactcgtcttcagcttgaggcccctcttccacgggtggcccgcaggcaggtggggatggcatccttgggggctggaaaagggatcaagcagcctcctcagcctccctgtctgcttctcggctgcttggggagtggaaatgaacgtgtcccctaaccaggattgttcgtgggctctgagtagcggcttcacagcaagcggtatgtgaactgctgctcagaagagccagagaactgcgtgcttcagatggatgggctccccacatcagtcattcattcatttcatcattcattcagcaaatgtttatgctcgaagaggcaggccccgttccaggcaacagggacacagccacgaacaagaccagcccctccctgctgtcatggcccttgtagtgcacaatccagcgtggcccatgcaaggatggggcaagagcagggcctgtgggggcccagaggagggccagagctggccagtggggaacagggagggcaccagggagatggtgccgttcaagctgagagctggggttgtgtcggggtttgccacggcgagcagaagagcacttcaggcaaaatgggctgcgtgttcaaaggactggagatggagcagtcctggtacccacaggaccgagagggcccctagcctggatggagttcaggacacctggggtgggcagaacatgtggccgggcgaggaggccagcagtgctggccggaaacctaagcgtgtgtgtgcagatgcctccagctctacctagaggctctagggaccggaatcccctcagcagcctccgtggctgacaggcctcagctcacacatcccctgtgacggggagctcaccacctctttggtggcccaggaaagctccaggtgggaattggcctggagttcccagagtccagggtttgcagaatcctgtggccctggcacagacctccccgcccagatgcttccctggccccggggccattggttaggagacgagattcccaggtcctggtgggatgagtgaaggggaagtccagagtcagaaagtctgggggcccaggcaaccccggtgcacatgtgagcctgtctgaccctcaggccttgggtgtggacaccagtgggataagcctgataagggtggggcctccgcccaagccacctcgaagtgtggcctgggacatgtggccatcctctccgggccatggcccctagtctgtggtgagaccaacaggctgggctaggctcccctgtcccccgagactagggaatgactccaaagtgcaaggtcctatgagcagtttcagggttcatggaccccttaaggcaaggcctgggccagcccaagcaacagcagctctgagcccacgctgactctgggccggccgctggggctctctcagcctgtttctggtctgcagcacggagcacctcgcgtgtctctacttttaaacacacagatacacaccctctctcacatgaggagattgattctgcctgctgaaagctaaaagtccacccaggggaacagcttaggcaaaggccaggtggctggcaagcaaacaaggagacccccgggagccggagagagcatcgagccccgccccccactcccaaaggcaaatgctgtttagggccctgctggggctgtgatgattaagggacagcagcccttaaaaacagagaaacagaagagacagcagtacagctaaggtgacaggtgaggaccccctcaactgtgtgccagggagtccccaccatcattctgcccatttcactgtgggtaaaactgaggctggcccaaggtcacaggttgggttgcttgttccccgggctcccagcgcagtgcattgctcaccacctgagtcaccgaggtcatcaggcctcggtcttctgctccgtacagtgtggagggcgaccccccacccagtctggtctggcctggacctggaggggggctccttccccctctgtcttccctgaaccaaaagaggtctgtgccgcctgtcagcccattagtctggagcaagctgcctcacgtggctgccattagcaagtgttggccggtgttaaggatctaaggatccgagcctgggggaggaggcgcagcgggatggagatggtgggggagagggggatgaaaggaatgggggcgggtggggaagccgtcagcagccgcgggggccggggagatccagcatcctcccctgcacgtggtccccaccacacggggtcgttgtgagcacaccaggagaggctgtgagagcctggcgcaatcagatcccaagaggtcactgctggggggccttgagccctgctttactgccctgctcagcctgcccagaggtcccagaatacggcacccttgtgcaccctcgggccatgctctcaccagatctgcaggctctgggttgggctctcaaggccatgctcaggctgcagggtcggtgatcctgggggtctggaaagggggtctgttggggaccggggtgaagtcccagcctactccattctctcctcagagatccgagaggccttcaaggtgtttgaccgtgacggcaatggcttcatctccaagcaggagctgggcacagccatgcgctcactgggttacatgcccaacgaggtggagctggaggtcatcatccagcggctggacatggatggtgagcacccccccgcctcggtttccccacctggcatctgggccctgggggtggggcaggggctggggcctgagctgctgaggctgcatccaaattgggtctctcgctcccctgactcccaccctcaaagtccgtggcaggttgcagcccggtctggccccatttctcagcctggagaattgaggccagagaggtagtgacagtcccagccacatgcagggctcagagatggctcctttcactctgtgttgagaagttttaaagtacagagaagtaaaaggatgcaataaatactccagttcccaccacctgagataaaatgactacttgagttgtgtttgccacctggcattttattaaggaaaagttcataaggaatagtgatgccaagccccctctttatcccacccgggcccttcttctcctcttctccatccagaggccaggtgacagccttggcaggttgccccactctgagcttcagttcctgtctatatggtggaggatggcccaccccaggatggccgcagggtgctgggagcaacggagggttctgggtgaaataggagggtcacggcccacctgctgtctacctccacctccccttgtaaggcctcatcacactgggtggcttcagcgtcagcccagagcctggcacttggtagatgcccctgacactgactcaaggctcagagaaggcgggcacctgcctaaggccacccggtaggcccaaggtgtatcaagactccatcccaggacctctgggccctgggctgcaggcctgggccctacccactgattgattggacctgtgcctccaccaggtgatggtcaagtggactttgaggagtttgtgacccttctgggacccaaactctccacctcagggatcccagagaagttccatggcaccgactttgatactgtcttctggaaggtatcccctggctagttgggacccagggctgtgcacactgtggagttctgttctggagccagtgaatggctgggcccacactgtaaaggggggatgaccacttcaggcttgtgtccactggacatttcacctctcagagggccatgggctccctggggaggccggtgttggtcaaggactctctgggggaatggagcaagtgttttccagccccccagaatctagaggcctgtcaccgggtctgtatggccgtggggtgctgggtgggggctgcggtggctctcagagcaccgtgttgtccccctccgcaagtgcgacatgcagaagctgacggtggatgagctgaagcggctgctctacgacaccttctgcgagcacctgtccatgaaggacatagagaacatcatcatgacggaggaggagagccacctgggcacagccgaggagtgtcccgtggatgtggagagtgagtggctggccctggaaccccacgggtgggcccagtgacttggccagggggacgcacggggtggggagagtctgcagaggggggctgggggcctccttgcctgtcctaagcctctgtcccattggggcaccccatgggatgagcccatgtgccgaagggcaggcggctcctgactccatcgctttgatgtccccttctgtctccccggtgctcccggcgggcggccacagcctgctccaaccagcagatccgccagacttgcgtgcgcaagagtctcatctgcgccttcgccatcgccttcatcatcagtgtcatgctcattgcggccaaccaggtgctgcgcagtggcatgaagtagacgccacctggatgccccatccaccgcatgcggtgcccgtggcccgccccacaccaccgccgcctgcagacctctcccttggccggctccctgggccgccatctgcgtgtacttcagggcctgggtatccagcgagccctccccacccacccacggtcctcacctggagctgtggcctggctgtggagggccgggtggtggctctgaggatggtccccagccccaccctgtccccaccctggcctgtaaggagcactcactcttcctaccatccaggggctcctgggaaattaaggagggatttgcacaggaacccccaggacccagtcgctgctgtggtcccttgggcaggagcgggcaccctgtgccttgagacagcagcctatctggggccacacagccaacccagccctggtccctgaggtctgcccagggcacagggcacaggcagggacagaaagccttctcctgggggagggtgggaagccagggtgtcctgggccttgctgcctggcatagcctgaggaggcccctggtcttctccttgggccccttcctctgaccctcgttggaccccaacccagacccccttttctccatgtacctgctgggccagcccatttcacaggtgaggaacccgaggctcagggccccgagacttggcctcagttcttccttccacagggattttcaggaaaggcagaagctcgtggaggatgggcatctgaggtggccctgcagccccccaccttctggccctcccaccagaggcccagctaccaaggccacattgtccaccaccccagcctagagcctagaactgtagtccagctgaggaaggaggcagagctggggcctgaaggctctgagcagcctccagccagggggctcctccagggctgaactttgggagggcccctgtactacctcctgggccaagaaactggcacagccccacactgtcagtgccaagaggctgcgccaggccactctctcagcccagggcctgccctcctgtcctcccacttctctacgccctcaaggttggagaccccgctcccatgccccagctgtgccatcccaaatacttgggcagcagctcagcatgggcagacatgggggctgtggattcttccagggcggggatggcagatggagcccttgggctccttgggcctagagccacttcttaccaggcaacgggcacagccaccctggcacaccctctgcctggccgtgctgaacctctgctggtcccaagggagaagggagtgagcgtgggtcacctggggaaaatctcatctgattccctccttgcccgacctctgctaggggctggagaacagagctcagagcacccagtgtagggaaacacagccagaccactgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtagcaggaaccgggcttggcttcctattgtgactgatgagaaaagtgaccacgtgggggtcagtcgggggcaaggggctcagccccactggactctgggctgcagaggccaccccccaggtgggggtgcccgcagggatggaggcagctcctgaactggtggccagcccacggggtactggaagacagtggttctgatgggttcagccctagagagagagagagaagcggggagaataagagtgcactacagcccaggcttatgccacccccagcccacctgcctcaccaccctggctgtggggagggtcagctgcctgcatgacttttctggaaggcagagcctcgaaaataggcagaccgtttgagccagcgacctcacctctaggaactgagcccaaggaaatagcggggttgcaggcagacattgagctgcgagacaatgggaataaccttcgtgtccacctgtgggggactgattcaatacatatgcacgtccacagcagagaatgccatgcggcctgtgtaagaattaaggcagatttatatgcactgatgaggaaagacatactgtgtgatagggagaaaaagcagcttataaaataatgtatatagcatgatactatttttgtttaaaaatatataaaatatataaatgcataaaaaaatcctggaagacacagcaaaatgttaacagtggtcctatctgagtggtgccattatgggtgacttttttactcctttatatttctcaaaagttttacgagcacacaagcctttgaaatcagaaaaaaacattgtctaaatttttttttaaagcctaatttctcatgctactcactgtcctcctcctcaacgtccaccccgagccacctcccctggaacttggggtccatgtaagtacttgccctaggagaggcatcctccgtgcccagcccggggcaccctgccaaggcccagcgatggccccccaaccattcttccacctgtcccatactcagatccttctggccttgggccccacgcatgctgcttctccagggccgcatggcccttctcaggcttcgaagtactttgaacctttgagcactttgaactcccatcaccccagctgcctatacaagacctttctggaaggcagagcctcaaaaacatgcagaccctttgaaccagcaacctcacctctaggaactgagcccaaggaaatagcagggttgtgggcagccattgagttacagcaatagccgtgagacaatggaagtagccttcatgtccagctgtgggggactgattaagtacacgtgcacattggccgggcgcagtgactcacgcctgtaatcccagcgctttgggaggccaaggcgggtggatcacgagatcaggagatcgagaccatcctggctaacatggtgaaaccccgtctctactaaaagtacaaaaaaaaattagccgggtgtggtggggggcacctgtagtcccagctacttgggaggctgaggcaggagaatgacgtggactaaggaggtggagcttgcagtgagccgagatcgcgccactgcactccagcctgggcgacagagcgagactccttctcaaaaaaaaaaaaaaaaaaaaaaagtacacatgcacatccacatccacagcagagagtgccatgcagccgccgccaaaattcaggcaggagctcatctgtcttccacttaggactggagtccccagaggatgtagaccaggggataggggtaaggtgtatttgtaccccaaggcgcagggccaggcctggtgccaggaggccacccagtgattgtggaacaaacagcaatgctgaaagatcttactgaccaggtgctattctgggccacacaccatgacctagagaaaccttaagaatcctcaggcgaaccccattttatagatgaggaaactgaggtgcaaggagtcagtcacgtgaccaagtgacaccctcgggatgaggcctgagggcctggaataccagccccacatcggctgcagacacggccttcccacttcagctccctctgctctggcacactcccacaccccaacatccagccttcaggcaaggtgaggccctggcagctcctggcaggctcaggggcccagtggccagccctctgcagagagagaagggcttgggcctgcggagaggggtttggagaggcctctgacctccgagggggaggtggagagccggggtcaggagccctgggagtttcccctgctgcacccacccaacctgcccctctctggaccagacctgccatgcagagtcaaggactccggggagctctgggtgcagcctccaggacccccaggtgtgagaggacagggacatcccctgcttcatggctcactgcctgctagaaagtgcagaaggcagctcttgacatgatttatggcactggggagatttcataaactccaccagccgcagagaaggcggggaggctccgcagttgctggaagggagtgccctagctgccagccaagcctgggctccctgcagggccacagggacagtggggatccccagggagggtgtgatcctggggagccccttcccctgagcctcaggcccttcctctagaaaatggggcagattcctgggaacctgggacctcctgggtccaagtctcagccccgtgcccctgcctgccctgaggtcccgccagtagacaggcatacccagtgcctgctcacacacactggcacactgccagggccccagacacgtgagccaaagccttggggacattgaggtgcgtgtctggcacaactctgctcgtagcttctctggtgacctgtttgtcctgtgcgtgaggacaggagccactctcttgcattttcccagccgcggtcctaatcagaggaaacagagtcgaggaggaggatgggccaggatggcagcgcccgcccagagaggggtgcaaaggagagattaagagggatagagtcgcaaactgaagagccaacaatgggcagcagggccaggcctggccttgccgagggattagtctgtgtgtctgaggccgccgctgctcttgacagatccctcagggtcagtctgcggagggggataagagctatgccaccaggctggggcttcatggacccccacttccccatgtttacaaggagggctggcctggctcactggagaggctcagctcagccagcggaggttggagcccgcaggtctcggttccccgaggtggggtgggcagctctctgtgccttgtactctgggggaggaagcagataccctgagaggaagagggggtcccccaggcttccagaccaggccccacaaaaggctcgcagcactaacacctggggaacgcccgaacagcagcctaaatgctcattcatgcagtaaacctgtcctgggcacccccaagtctgcccaggccatgcaggagaagcgggggctgggaggggtgatgtctcagctagagcttccaggacaagtctgactctgccaggcagagaggtgggaggcagtttcaggcaagaaaatagcatgcgcaaggtgctccaaaatcacaaatgatgcctcatctaagctgctgccgagtgtccagtgggaccaccagtcaggccagaggcaagaggtgagaaggtgagatccgactggctgcggaggcatcagggagggtcccccgccccagccccagccccagccctgcaaatggggctgtgcggccagaggtggaggatgtggggaagcgccagggccagggtgcatcagggctgctgtgtggaggatcccccgcgggagcagagggaaggtgggagaccagggaggggccgctggggtgcccaggagagccagggtggaggaagaacattgttgctgcagcactgcctccaggctggagagggagccaggaagaaagtgaggtagccttgcgggggctggggctggaatccaccccctcccattaagcagggtagggggtgtggatgcaggggaggggctcaaagcccaggacggagggaaaggctgctaggcttcaggagaccagcctgcccggagacagttatggacgcccaaggcagcaatggcaaaagcaggaataaacggtcacctcccttcccacagcccctttttctcaaggctggacaggcctgctctgcctagagaacaattcattttggccccaagccctcaggaggcaggaggaaggcaggtggcagatcccctggaaggggccaggctgggtggccagagggacaatggcccagagcacagggctcagaccccctacagccaaggtgggctccagttgcagaacaatcattcccaaaacagtcactgccatcagggcagcctgctgctgccactgccactacccacagccacacagagccttgggccagccctgaacttggtgtcagaggcagcctggggtctagacacagagcagggacctagctctctctcaagtgagggctaagggcagcagggcacgtgtgatcaggatggccccacctcctggagaggttaagattcctcagatgcaaaatgggggtgccaatctccctgaatgcccccaaacactgggaacactgtaagcaccaaactcaattctcatatggtcaccacttcaacctgtgactaggagccagtcattcagcctcagtttccccatctggtaccctagtcccccaagtctcaaattcatagcgccttgtttcagcacagggatgcatctgtctggaacccaggcaaggactctggggcaccccatctctaccccacccattggtgctcactccagttcagccacagggactccatgaaaccttgtcacagccccaagagacagccgggcctctgtgactcgctcccagcggaggacaccatggacccagagcagggaggcgagtggctggtgcaactcggttagcaggtggcagagtgaggatgggactcataggagatcctgtccaagtagcggtgcaggggccagagctttctgggcagcctccaaccagctcaagccttttgcacacgggctgaaggagtctggggtgtaggacgtggatccctggacagcaaccagtcccaaaggaggtgctcacatgcacaaagacaggatagaacccctttagacgggacccttcagacaggaccaggaggagagaatgtcacactccaacgtttgagtcatgtctgtaccacatatacttttaaggtggggagacaaaaactgaacacggatttaaaataaaggtaaaagacaaagttagttttaaaacacctttactggctgggtgcggtggctcatgcctgtaatcccagcactctgggaggctgaggcaggtgaatcacctgaggtcaggagttcgagaccagcctggccagcacagcgaaactctgtctctactaaaaatacaaaaattagccgggcatggtggtgcatgcctgtaatcccagctacttgggaggctgcagcatgagaaatgtttgaacccaggaggcggaggttgcagtgagccgagatcgtgccactgcacttcagcctgggtgacagagcgagactccatctcaaaaaaaaaaaaaaaaaaaaaaaggctgggcgcggtggctgacacctgtaatcccagcactttgggaggctgaggcgggtggatcaggagggcaggagattgagaccatcctgggtaacatggtgaaaccccgtctccactaaaaacacacaaaaaaattagccgggcgtggtggcgggtgcctgtagtcccagctactcaggaggctgaggcaggagaatggcgtgaaccccaagaggtggagtttgcaatgagacaattgcaccactgtactccagcctgggcggtagagcaagaatccgtctcaaaaaaaaaaaaaaaagccgagtgtggtggctcatgcctgtaatcccaacacgttgcactttgggaggccgaggcaggcggatcacctgaagtcgggagttcaagaccaggctggccaacatggtaaaaccccatctctacaaaaatacaaaaatcagccaggtatgatggtgggtgcctgtaatcccagctacttgggaagctgaggcagaagaatcgcttgaacccagaggcagaggttgcagtgagctgagatcacaccactgcactccagcctgggcaatacagcaagactccatcacaaaaaaagaaagaaagaaagaaaaaaaacaccctcatagtctctttcactggagcacagagaaggcaagaagtttggccttcacctcctggcagagctccaagggaaggcctcttcccccagactatctggccaggtccccttggcccaggccaggccaccattttgtgaagccacaccacagaggtagtcaggtctgaagcccgttgcaagatggggaaagcaaggtagtcgggatgggaaaacgtgttcaaagtcgcatgcggctcctgggcgcagctttatccccttttcctcccctccctccttcaactgctggaggaagagcccaggagctcaggcttcggttttggccgccagcctttgtctgcccctgcctgccctgtgccccgttctgatgtgaatatcacccgaggcccttccctcaaagaggaggaccagggacatcacgaagcacacaccccaaggaccccgatccagcagctccccttctacttgtgagcgtcccgagggctggggccatctccagacccccttccttagaaaggcagtgggaccaggacctcgtcatcacgcctgtgcaatcccggctctacattttcccgtctgtgtgccctcgggcaagtcgcaccctccctgttttcccttctgcaaggccctagaggcaacagtgggcagcagtgcatggtgaccacagcccaggcccctccctctggcaacggacttgtgacttgcagccaaatcagctctgccgcctgcctcccctccagccagcacagactccaacaggggcccagctttgggagaggctctttcaaacacccctcagcctctggccagggcctggggccccaagggctcctcggggagctatgtgtaggcaactttattcggcccctgggcctgggcagttcatggagattcctgagcctcaggaaggggaaggcgggctggggttttgcccccagggggcacagcgggagggaaccctggggacctgtacctgctacttggggctgagctcagccgcttggctctcttctccagccagtcctccagatggccctcggggagctcaggagcatctagtagccactccctggctcgcctctcctctgtggggacagggagacaaaggcaagtgaggggtacactcctgcctgccagaaccctaccctctcacaaagcagaagcaactggtaggccctgagcaagcctgggaagttgcagcaaccttccaggaggatgcacctggactgcttctccaggccatctgtgcacgagggcccagcactcggcctcgctctgttttcccatcaaatagagacaaccccggctgcctccaagctcttggggagctggaaacaggacagtgcttgtagagaacctggccctggccaggcgtggtggctcacgtctgtaatcccagcactttgggatgccaaggcgggcggatcacctgagtccaggagtttgaaaccagcctggccaacatggagaaaccctgcctctactaaaaataaaaataaaaaaaattagccatgtgtggtggtgggtgcctgtaatcccagctacttgggagactgaggcaggagaatcgcttgaacctaggaggtggaggctgcagtgagctaagatcgcaccactgcactccaacctgggcggcaagagtgaaactccatctcaaaaaaaaaaaaagagagagagagcctggccctaaggaggggtctgaatctgaggtgcagggaggcagtgagggcagtcgaatggggtcacatctcagctctgtcacctgccgggtctttgaccctgggcagggtaatgagcctcagcttccctggtttttattctcataagctgtccaacaaaacctgttgctcaacgaattaaaaccaatcaacgaatggaatttatacaagctgggtgtgagcgtttgatggggtcagagtcgccaagtcatctgggatggagtcttgggccagaggaaagtaatcatacacttgactagcactcactcagagccaggccccagtctctggagctcactcggggccaggcctcggtctctggagctcactcggggccgggccctggtctctggagctcacttggggccgggccctgggctgtacaggtgtcatcttgcttcatccttagagacatcacattcgacaggacacagcctccaagaggttaagccacgtaccaaggttacagaggacgtggcagagctgggactgtcagagctgccagctgggactctgttcccagcctccctgggcctctccccattcctgtccccgctcggcatcgtctccagttccaggcccactgccccgtgctcgtcccaccatgggccagccgtcctctgagagcccatagccagggaagagctgcagctgccgctgctgccaggacttgctggccagtcccacaaggccttgcttccaccctggggaaaaatgctcctggaaaccctgtgttggtcccggggctgcagccacagcaccactggctcccagggcagggcacggagcctgcagtgtctaactggtcagaggggagtgaggcccgtagggggatcagggcaaaggccaagctgccccagaccttcactggctaccctgaggcctcctggacagagaagcttaagggggcaggcactgagagacctggagtctgcccccaacctgctggggggctcacgcgaggcctttcagtctgaatgttggccttagtttccccacctgttcagtgagaggctgtggaagaagattgataaacaccatctcagtcagaacttccttgttctctaactagaggagtgaatttcccaaaggcgagatgtcagtttccatggaagctgaacttgcccctccctggaatcaccaggctgtgagactccagagggcagggaaggtgcgttcctaaactccttatccctagactgtcgtaaggggtctgcttggtgccaagtggggactgggtatgctgcctgattgaggaagggatggggtgtacccaccaatgactgctgggctggccacagggtccaggtggggctgaggtgcaccttcagggctcccaggcaggaagccacacaggctccactgtaaggggacacaggcctgccttctccactcatgctgaagctgttcctaacacctggcccaaaccgggggctcagggctccgcatcaccctgggtggcccttggttgccaatgatggggagatagggaggcataggccagcttccccggtctcagagcccacatgccccagcaccccactcccgcttagcccagggcatcccgagacgtaccctccacctggatgctcagctcctgcaggtctcgctctgacatgtgggaaaatctgcagttggagccaaagtcgcactggcctgcagcaggaagacagagttactcgctgctcgggaggggctccccacaggggctgaggggtgcccagatgagggatcccagaatcttaggggcaggacttcagggcctaaagaatagcaaccctgatccgggacagaaaatggaatctctccggccctgcccattcagcagccagagcgacttctcacctatcatgccacatgctcacgacccttctccagctgccccccatgctggggatcacttccaactgaagcctgtcatgactgggcctcgcaagcctctgcaggctgtctctgtcaccagccctcccagccctgcctcgatgaactacatatgggttcctgaaagggcaatgcttcctttctccactccaagccgcagcacgtgctatgcccagcctagtattctgcctgcctacctggctcacgggagcaattggactgctccttagaaaggcttcagtggcagctttgccaaagaggcaccaaaatctggggtggcttcccctctttcaaccaaggagaccaaaatgtatgtcgagatactgggaggctggaggtgtctcaagccaggataacctaccagtgacatattcacatcaaggcaaagtctgtagggaagcccctgatctgcaggcttggtgcccatcctaggggagcttggacattcacccagtttccctagttcagctgcagcacctctccccagtgctaagctcccttacaaaccatgtgaatcatcatagttttcctctttgccatggctgccaggaagctcagagccaaacccttagagaatacataggacctcaagggcaagcatggaggagactattctcttggttttatcttatttttcctactcttatttgtatctgtctttggttccttcacttactgaggttttacctcttgctctgtctttttttaaaagagacagggtcctcactctgttgcccaggtgggagtgcagtggtgcaatcatagctcactgcagccttgaactcctgggctcaagtgatcctcctgcctcaacctccctagtagctgggactaccagtgtgtgctaccatgcccagctaattaaaaaaaatttttttggtagagatggggtctcgctatgttgcccaggctggtctcaaactcctggcctcaagcattccttccacctcagcctcccaaagtactgggattacaagagtgaggcaccatgctcggccctttatctctctgacctatatgcatctctagtagctgagtactgagcagtcaaatctacacctagcatccttggttctgatcctgaacttcctcagatcatcaaccctgttactctctgaagttctgcctgctgggaaggaggccaggttcccaggctaacttaatcaacaagtctattccacccataagtgtctcttggatttacatgtaatctcccacgccttgcttgttctaggtgagctgatataatcacattctagatctgaagagctgaggaccagactctaggaggtcctgagacacacttgggaaggccctgactggccagtcagctggagccactgctgcaaagtgggcttgggatggtggcccgggtcggggaagacactctgcagaggtccaagtggggcaggctggatatcgcaggtccccgcagggacctgagctgtgcagaggactttacctgtcagtagaaacttcctgcagggccgcttgttctgctcatccagcaagatggcagctgcatctgcgagagaagagagggacgggattcggatggttcaggctccaccaaaggaggcaggaagtggaagccacaggggcatatggaccctttatctcgacacagctgtgcagaaagaagagtttcctgttccacggaggagtggaagcaggagatgaccacaggtgggagtcctgggcagatggatccgagctgcaggtgacctcaatccatcccaccccacgcaggacgggccaaagacaaggaccaagtttcatgccagcagttctcaacttggcacgagggagtcagctggagagtctggggactttgggtttttttgttttttagagacagggtctcgctctgtcacccaggctggagtgcagtggtgcaatcatggctcactgcagccactacctcctgggctcaagtgatccttctccagtctcagcctcccaactaggtgtgactacagctgtgcaccaccatgcccagctaatattttttatctttttgtagagctggtgtctcattatgttgcccaggctggtcttgaactcctgggctcacacgatcctcccattttggcctccaaaagtgctaggaatacaggtgtgagccactgggcccagcctggaggtataatactttaaaaaaatcctggcactatggaacttctcattattatctttgcaacttgctgtgaatctataattatttcaaaataaaatgctaaaaatttttaagtaaatcctagtgcccaggaagcccaccagccaatcccaggatccaggcactgctccacaggcaagactgcaatccctggcctctgtctcccctccttccaccagctgtagggcactcagggccagaccagccaccgccgcggacaggacttccgacaatcactctgtagcatcggcaatcactctgatcctaatcttaaccctagtttcctctgatttttcctatttttcttttctttctttgagacaagttctcactctgtcacccaggctggagtgcagcggcatgatctcagctccctgcagcctccaccttctgcactcaggtgatccttccccctcagcctcccgagtagctgggactacaggcgtccgccaccatgcccggctaattttttaatttttttgtagagatggggtttcgccatgttacccaggctggtctcgaactcctgggctcaagcgatcctccccacttggcctcccaaagtgctgggattacaggcgtgagccactgtgcccagcctatctttactttcatcatataggtatggttttaaatttgcttcttgataggcaagctattaatcagtcaaaatctgtaaggaagtagggtacctgaggatggtatcctgactcaggaacccttatatccaccccaggggaggggagaggcaaggcctgggctggacattcacccaccaccttttctagaggccaaggaaagaccacaggctccagagtccaagaaacctgagctcaaatcctaacaacatatgaccacgtgcaagctgcataaactccaagtctcagtttccccatatgtcaaatgggaggatagttcccacctggcagggctgctgtgaaaatgtcatcagataatgaatggagagtgctttgcagaggaggcccgtggctcccaactctggtggtacatgagaatcactaggaaagtgaccaggtttgcctctggggccagcagtggccttagcaccatgttctccaggtatacggccaagactgggtgggtacacagcaaatggtagcaattcttcattttttcctcacaaaccctctgaacagcgcaaacatccccactttgcagaggggaaaacagaggttcagacaagggaagtgatttgccaagggcaactggtggcttgtgggaggcgggggcgggcggggggtgtggtctgctgggataaggagttggttgtcagagaactcatgccagggggaccagcagggtggggagggtctatctgttagcgccgggcttgtcagactcattgtacccagctggtgctacagacaccactgcctgcctttccctgaggtgggggggtactaggggagggcatgtggacattgccctggacccccaaggctgggatgactgaggcaggcggcgggactgagcctgggtcctatacaaggggctgtgccaggtggcttggggtgggagaagaattccaggctgcccacgtccgcttagtggttcctgaccccagccacacatcagaatcaccaggcagtttttaaagtacatggacacccggccccagccctctcaggttctcttttaattcattggaagggagggcatcagaattgtttaaagctcctcggtgactctgaagtgtactcagggttgagaacccctggcccaggccctgcacgaggaagcccatgctcttgcagtgggtattcaaggcccctcatgatctgatcctattggtccttcttgcttcatctcccagatgaacagctgcccctggtgcctcatgtttctttgctcaatcacttagacattcatctgccaaacattcactgagcatgtcctgtgtgccaggcaccacgccaggctgaggatttaagtggagaacaagtcggagctggtccttccttctggtccaacagtcacactaatccctatggatgtaagcggggtaaacatctagcgtgtagccaaacgacctgacccgttctaggggtcggggaggacgtccctgaggatttgctgcctgacttgagttctgaggtggtgggggggcctggcttggggcagggaggacagcaggaagggcatgtctacagaggggacagcttatgcccagcagatgcagtggccagggtggctgcagctggaagggagaggccggcaggtcatggaggcctgggcaggacaggggctttgcccagaacacaccattctaattgggcgcaagctcgctaggcagaggggccctattttatccacctttgaatctttagagcctgcctgggagccgcggacatgctgaatgaatgagcccatgagatgaaggctggagggaatccttctgaggacccacaggcaccatgcctacttagtaagctcttatgtgccatgcagtcatcatgaggttactgagcccctgtcatagccctggaaggtggggactgttgtagctgttttatacatgacaaaatgagggccacagtgttagtgagtgacacctggggactggtgccctgcacctgaccatggcggatggatcatcagcccctctgagggctaaggggacgtggcccaggccaagaagctgggagcaaagctgaagtcgagttcattcacacggtatatccgcaagtccctgcggttgctcagagtgagcagaagccctggggcagcctcctgaggaagtggaaagaggtcatgtgccagcttggtcctcggtagctggggacccaaggtgagggaacccactgccctggattttatttcatttatttatttttttttgagacagggtcccgctctgttgccgaggctggagtgcagtggtgcaatctcggctcactgcagcctccacctcttggggtcaagtgatcctcctacctcagcctcctgagcagctggaaccacaggaatgggccaccatgcctggctaatttttttatttttgtttttatttttttgagatggagtcttgctctcttgcccaggctggagtacagtggtgtgatctcagttcactgcaagctccacctcccaggttcaagcaattctcctgcgttagcctccaaagtagctgggattacaggaacccaccaccacgcccagctaatgtttgtatttttagtagaggcagggtttcaccaggttgaccaggctggtcctgaactcctgacctcaggtgatccacccacctcaaacctcccaaagtgctgggattacaggcatgagccacggagtctggccaaatttttttatttttagtagagatggggtttcactatgttgcccaggctggtcttgaactcctggactcaagcgatcctcccacctcagcctcccaaagtgctgggattacaggtgtgagccaccatgccctgcctgctctggattttgaagtcaccacctgtaactgggaatgcctggcttggcctgcccagcctcttacagaactgttctaaggactgaatgtgttggggatgtgaggacactgagaacacaggagccctggggcactcctgtcacctgctgcttcatcttttctataagtgacacagggacctctgccaatcagccctggatcccagcatccagctgttgacagctgagaatctgggactaggtgatctcggcccagctccctctagatcacagcccacactggatttgcacagcagggagccttagcgtaacaccagggttagagtctcctagggagctaggagaccccactgcccatgaattttcctgtggccttgcaaccacagccacgcctggcctgctgagcagcctggccaccccctcacttgaacctctgagcctcagctccctcaagtgaaatgcggagtctgggaagcctttagaaacaccatgcctagtccccaaacctgcctctggggaggggatggggttggggaatcagtggttttagcctaaaggtctccaggtgatcctaacctgcagccggagttgagaatcactgccctagagagttgtcgagaaaagcaaatgacgaactatgaaaagcaccagcatgtagcaggcatgcgatccatgctcattccttgtttgtgaactctcagtttcaggccttttttgaggcggggtctcacaatgctgcccaggctgctcttgaacttctgggctcaaacaatcttcccacctcagtgtcccaaagtgctaggattacaggggaaagccaccacacctagccccaaccagggaactctctctccacctctcctcccttcttggctgctggatttggttccttcttcggaggccctgtcccagaatcctgctcaccaacctacagggcatcggccccactctggctcattccaggagctcctggcccaccctcgccccaccgccaagtgcccatatctctcaacctggctcctgccagtcaccctctggaacctccctggctgttcctcagtgtgaatgtccagtgacagccgtgcaacagcacaactcccctctctgggcacctcccgggaaacaggccctgtgctaggcacttccgaccttagctcattcaccccaattgttcttgctctgagaggcctttcccagaagagcctgccttccttctgcaactgggttattcacccgtgcctgcagccagtcattcaactgccactgaccgcacccaactgctccccacgaagcagtctgcgctgtcaaggcaggtctggccacggcagctaaagcccttcaaaggctgctctctgcccttggaacagggacccccccacctccgccccctgcttatgatggcctccacaggcttggaagatccctgccccagagccagcttgagccctaccattctcccctggcctgctccgcccagccacaccctctccctcctgctccgagagccctggtgctggactcagggctgcctgcttctcttcacaccctccacccagaactgcatggctagctttcccctattttagctgttggctcaaacatcacctccttctagggccttcctcctgtccacagagccttcagtcagcgttgttggggaaagagctcacctaccagcctgctcctctgagggcccagtggctcaggcctccctctcttttgatcctcaaagagcccagacctagactgtcactgacccacaggagtctttgatgataagaaagatcagagagcagggctccaggagcctggcccccagccagcggcacccacctcggaacatgtcgtaccagaccttcttggccttgaggtgctgcagcccgttcaggtgcttcttgcggttgtggaggttgtcctggaaggagcggtcgcagtagtcacagaagtatcgcttccccatggccactcagagcaggtgctttgctgcctgggaagccacaaagagctcagattagaccattggagaaaacacatccctcaccagcccactgaatgcttcctgagggccaggcctgagcccaggctttactcatatgcaccccgccccattaggagtgtcaagctgatgagtatggcctaagaggcctcattccagagggatctgttaaccattctgatgcccagcctgcaacttaggccagttaaagtagaacctcagtgggtgaggcctgggcactgttttttcttgagagggtgttgctctgtcacccaggctggagtgcagtgttgcaaacacagctcactgcagcccccacctcctgggttcaagcaatcttcctgtctcagcctctcaaagtgctgggattacaggcatgagccactgtgcctggctgctgtttggtagtttttaaagtctatcaggtgattctaacatgtaagtaggctgaactgccaccttataccctgtggctggcctcccttgtctcctaccacatagggttttatttttttgagacagagtctcgctctgtcacccagggtggagtgcagtggtgtgatcacggcttactgtagctttaaccttctgggctcaagtgatcctcccacctcagtctcccaagtagctgagactacaggtgcgtgtcatcattcctaacttaaaaaaacaatttttttgtagagatggggtctcgctatgttgcagaggctggtctcctgggctcaagtgtcctcccgccttggccccccaaagtgctgggattacaggtacgagccaccgccccatcccctaccatacctctgacctccacatttgcatcatataggccacaccggcctcccctttgctcctcacacatgccaggcacatggccacctcccggcctttgcacccaaggctccccagggaggggtatgccctcctgcaaactcccgcctcacttcccctcctgaccccttccatctttgctccaatgctactttatccaagatggcagaatcttccacttagcttcctccactccctgctttattttccctcatagcatgtatcaccctttgatatggtgaggctttgtatccccacccaaatctcatctcgaattgtaatccccataatccccaggtgtccagggagagaccaggtgggggtaactgacatgggggtggtttcccccatgctgttctcatgatagtgaagagttctcacaggatctgatggttttataaggggctcttcgtgctttgctcagcacttctctctcctgctgccttgtgaagaaggtgcctgcctcccctttcccttctgccatgattgtaagtttcctgaggccttcccagccatgcagaactgtgagtcacttaaacctctttcctttgtaaattacccagtcttgggtatttccttatagcaatgtgagaacggactaatacacccttcatgcaataagttacttgttatgtttactgtctttctcccacaatgagaatataaacccatgagggcaggtttgtgttttgtttactgctggagccccagcacctaaaatagtgcacagtacagagtaggcattgaagtacttgttaaatgtatcaattctcattttccctttgggacaactgaggttcagagagggagtgtgatttgcccaaggtcacacagctgataagcagaaggcaaacccagtcccctaacgttacattgccaggtgtcctctcttccacagccagttcaaggcttagagaagccagagggcgcaggcagtgaatgctgacagcttcccaaggagatcactaaattatcaggtggcaggtccgaatccagtcacagagggaaatgaaaacattttggggtcttaagacccctcagccatggtgaccacagccaccactcctgacccaggagatctgcagcccaaggtgggtggcaattcagtgactctcatggccagcccttgggtccatgagtatggtgctgcaaaacaggaggacagacaggtccactttgggccaccaagggggatctgccaaggctgagcccagaccaactgctcaccctgtggtcagacccctcacttcacagaaaaggttcctgaggcccagatgaggaagagaaatgatttcccccaggtcacaaggtagctatccgggctagcagccaaagccctggactcccaggacctgatcaccacagtggaccaatgggggaacacagctcaggaggaggagactggggagagacacagagacagtcccaacagccaagcaggttgatggagaaagccattcttgcagcagacagggacagcagccattaagtcaggggctgtaatgggatcaggaacagacagtcattcaaaatgaaaacatataaaacctctcttctcccattactgcagagggaccgtgtcccagacacgcacacttgatatattaaatttggcagctctaatacaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaagactctaataataaccataacaattactgttagtgtcagtaacaataatgacacatcaataaccaataacaaccacgtctcatcatcctgagctgccagtgggccagggtgccatggacccccacatcccctcctgtggagtcttcaccatgacactgtgaagccacgtgcctaaggccccacagccaaggcacaccagagctggcacgcacacttgggtctggctgaccccagagcccactctctctccatcccactgtcctgccgtgaggctgctacagggcaaacatttgcgcttcatcaatattctccattcctttcgttgtgtgtgtctcaggtacagaaagagctggctttggcacaaggcaaaaataagccaacagctcggcctttggccaggggctgggatgtgcactataattatcctggacttgtgctcaccacaggcgaccctgaagctcacctgttattttttctaattatggcacctccagaccccaggtaaacagtaaaccacagccagaggacggctttattgcacgcccactaggagctcggtaatgtcccagtgtcatatatgcctgccatctggagttgatggcatcagaaccaccctgtgggggtggtctgcagactgctggtgcaggaccctgttcggaaggaagcgccaaggaaatccagatgtctttcctgaccgaacccccgtatgctagaggcatccttgagatccttgggtggcagccacacacctttttcatcctgacctcatccctgtgtttgcctcctgccctcccctggggtaaggcacatcatctttttcccacaggtctaaggcagcgaggggcccacccactgcaatttctgactcggcaggtctgggacagggccaggatgtaagaaagtcctgattcagactccacagagaaatgcgagtccaggctgggcacagtggctcacacttgtaatcccagcactttgggaggccaaggtaggaggatcacttgagcccaggagtttgagaccagcctgggcaacatagttagaccccatctccacaaaaaaattttttttaatttgaccaggcatggtggcgcacacctttaatcccagcactttgggaggctgacgcaggtggatcacctgaggtcaagagttcgaggctatcatggtgaaaccccatctctactaaaaatacaaaaattagctgggcatgatggtgcatgcctgtaatcccagctagtcgggaggctgaggcaggagcatcacttgaacctgggaggcggaggttgcagtgagccaagattgcaccactacactccagcctgggcgacagagcgagactatctcaaaaaatatatatattttttaattaaaaaattagctaggtatgataacacacacctgttgtcccagctgcttgggaggctgaggtggaaggatcacttgagcccaggagttcaaggctgcagtgtgacgtgatcacgccagtgcactccagcctggacaacagggtgagaccccaatctcaaaaaaaaaaaaaaaggacttcacagaaaaaaaaaaaaaaacagaaagaaatgctagcctaaggtagcagatgatggacagaacagagagggtgagagcatgctcaaggtcacacagaacaatcctttgaagctgttttcccttaaacacaactactctaatcaccaacccaggtctgaatccagtccctgccactctcaggttgtgtaactctcagcaaactgcttacctctgagcttcatctggaagacgagggtaatgactctatttcataagattactgtgagaattaaatcatgcatgctagctgcttagcacagtgcctggcacgccaatggtgcttcacacacgcttgtgcatgttgcagccagcctccaagcccccagcaatcccacctcctgattttcacaccttgtgtagtcccctccaagctgggtcagggttggtctatgtgaccaagagaacagagcagaggtgagggtatgccatttccaagaacaggttataaaagacactgcagggagggcatggtggctcacacctgtaatcctagcactttgggaggccaaggcgggcagatcacttgaggtcaggagttcgagaccagcctgaccaacatggggaaacctcgtctctactaaaatacaaaaaattagccgggtgtggggcgtgcacctatagtcccagctacttgggaggctgaggcaggagaattgtttgaacctgggagacggaggttgcagtgagccgagatcgccactgcactccagcctgggcaagagaatgagactccatctccaaaaaaaaaaaagacactgctgcttccatctcagtgtcttctttctctgatcacttggtctgggggaagccagctgccacactgtgagcagccctgcagggtggcccacgtggcaaggaactgagaccccctgctaacagccacgtgaatacatttggaagcaaaccctctggccgcagttaagccttcagaagactccaccctggctggtatcttgactgcaacctcccaagagactcagccagaaccactcagctaagcagcgcccagattcctgaccctagaaacagtatgagaaaataaaagtttgttgctttaggttggacgcagtggttcattcctgtaatcccagcaccttgggaggccaagaaaggaggattgcttaagtccaggagtttgagaccagcctgagcaacatagtaagaccctatctctacaaacagtttgttttttttaaattagctgggtgtggtgatgcatgcctatagttccagctacttggggggctgaggtgggaggatcgcttgagcccaggagatgaaggttgcagtgagccgagatcatgccactgcactccagcctgggtggcagagcaagacctcattcaaaaaagaaaagaaaacttaataggattatgtccagatttttttcatttggtatctattttttaaagtttctatatttggcatgtattgttttaaaatttacacacacacaaaaagtcccttcaaaaaaagtggggggctagtccaagtgcagcagtgttggtgactaactgatcacaaccagatacagatttctttgttccttctgcactcccactgcctcgcttgactagcctctaaaaaagagaaaaagaacaagagggaaatttgtaaggcggggataaatcctattccttctccctctggaggctgccatggagggttccagagacctggttcactcggatgaaccagccaggggtggtaagtgaaagaaatagagcagacattcccctcaccccctggatgaagactgacaaggcaaaccctgattccaaccagacttggcctagcacaccccaaggcctggtgaaggtcggctgagcctgaatctgggctccaggaactgcgggctggagacaagtttctcatcagatagttacaggtcccaagaggccagagtttccaaataggaaaggtaaaaatagtctgaatgaggctcctgaaccagatacttggactcagaactgtctctgcctcccgcttcttctctcccgagtctgggcaccaaatatcatctgatcctctatctccactgtcactactgcccaagaaagaactcagctcctcacctctggactcctcacatctggacagccccctccattcactgtatcataagcagcatcagatcaactctccttaaatcatccctgctcaaaattttccatggcttccaagtgagaaacttattaaaaatgaatctcagctaaatgcagtgactcacacctgtaaccccagcactttggcaggccaaggcagatcagttgaggtcacgagttcaataccagcctgggcaacatagtgagaccccgtctctaaaaaaaaattttttttttaattagccagttggggtgtcatgtgtctgtagtccttgctactcaagatgctaagatgggaggatcactggagcccaggagtctgaagttacagtgaactctgatcatgccactgtactccagcttgggcaacagagtgagaccctgtctcaaaaaaataaaagggggccgggcatggtggctcatgtctgtaatcctagcactttgggaggctaggcgggcagattacctgaggtcaggagttgaagaccagcctggccaacatggtgaaaccctgtctctactaaaaatacaaaattaggccgggcacggtggctcatgcctgtaatcctggcactttgggaggccaaggtgggtggattgcctgagctcaggagtttgagaccaccctgggcaacatggtgaaaccccatctctactaaaatacaaaaaattagctgggaatggcggcacgagcctgtagtccctgctactcgaaaggctgaggcaggagaatttcttgaacccgggaggcggaggttgcagcgagccgagattgcaccactgcactccagcctgggcaacagagcgagattccgtctcaaaaaataaaaaaataaaaaaaattagctgggcatggtggcaggcgcctgtaatcccagctactcaggaggctgaggcaggagaatcgcttgaacctgagaggcggagcttgcagtaaaccgagattgtgccactgcactccagcctgagtgacagagacagactcctctgtctcaaaaaaaaaaaaaaaaaaattagctcagcgtggtggtgcacacctgtaatcccagttacttgggaagctgaggcacgagattgaacccaggaggtgaaggttgcagtgagcccagattgtgccactgtattccagcctgggtgacagagcaagactctgtctcaaaaacaaaaaaatagtctcctgggtcaggtccccagaaatcctgatttagcagatctggagggggacctagaaatctgcattttaactagcaagtctaataccccttaagaagcaaaagcctggaggaatgaactttcccttgagttccaaatgcagcctctgctggggacagttattctgggtagacacagccccctggactcatgtcccagctagaaatcagtccaattatgaataacctcaggtcactgaagtggtaatccaacttgatgctaagcacaattagttaaagtggataaagctgttttcttactagataagtgtcttgtcacactcctggaaagtttagaattaaaaatagaagcataagagcaaatcaaattcactgtattaatgttcctatcctaaatttagtaataatctgtatattttggaattaaaaagtagctgttggccaggcacggtggctcacgcctgtaatcccagcactttgggaggctgaggcaggcggatgacaaggtcaagagatcgagaccatcctggccaacgtggtgaaaccctgtctctactaaaaatataaaaattagctgggcgtggtggtgcgcacccatagtcccagctactcaggagcctgaggcaggaggattgcttgaacctgggaggcggaggttgcagtgagccgagattgtgccactgcactctagcctggtgagagtgaaactccgtctcaaaaaaaaaaaaaaaaaaaaaaatagctgtagacagggcatggtggctcacacctgtaatcccagcactttgggaggcaggaggatcacttgagcccaggagttcaaaaccagcctgggcaacataggggaaccttgtctctacaaataatttttaaaaaattagccagacatggtggtgcgggctcgggcctgtggtcccagctactactgctcaagaggttgaggtaggaggatcgcttgagcccagggagatggaggctgcagtgagccaagattgcaccactgcactccagcctgggtgagagagtgagacactgtctcagaacaatcctactgggaactgtgcatgcgagggatctaggttatgtgctccttatgagaatctaatgcctaaaacaaaaaaagtatctgtaatattgaaaaaaaaatgtgatatgttgagtgtctaacagataagcattgtgattcctatttaaaatacaaaagttaaaatatagagttagtgacaaaatatatgtcagtaattgatattagagttgtgattttagattgagaggttagcaatgattggaaatatggactgtataacagaattacctggggtgctgtaaaggttactaaggggccccccatatattcctatttcatgtcagaaatacagcctgtttttttgtttttgttctttttagctccctaaactaagagccactgacatagagaattttactaagtctgtaaaaataattatttataagaacttgaaattcattataagtttaattgattagattttgtagtaactctttactctggggaaaactgtgcttgttatgttattcatataaagtacttaaaaagaaaatcaaatatattaaatttacaaatagatttaaaatgttggcaggaatgaaattaagctgtaaatagggatgagtgtcttgagaaattcagaatcttcaacttgagttcaaatattaataaaaaaattaaggtcatttttcttatttgccgatatttatgtattgaataataatttctaagttgaaatacatggcttaaagcaggggaccccaacccccaggccccggaacggtacgggtccatggcctgtcaggagctgggccgcacagcaggaggtgagtggcaggtgagtaagcgaagcttcatctgtatttacagccactccccattgctcgcattaccgcctgagcttcgtctcctgtcagatcatcggcagcattagattctcataggagcacgaatcctattgtgaactgcgcatgcgagggatctaggttgcacgctccttatgagaatctatgcctgttgatctgtcactgtctcccatcacccccagatgggaccgtctagttgcaggacaacaagctcaggcctcccactgattctacattatggtgagctgtataattatttcattatatattacaatgtaataacagaaataaagtgcacaataaatataatccacttgaatcatcctgaaaccatccccctcctgtatcccgtccatagaaaaactgtcttccacaaaactggtctctggtgccaaaaaggttggggactgctagtttaagggaaattacgttttttaaatgattacctccgaatgagaatttaaaagataaaatataaaaccaaaatccagtactttgagaggccaaggtgggagcatcccttgtggccaggagttagagaccagcctgggcaatgtggcaagaccctctctctacaaaaaaatttttttaaattaggctgggtgggaggccgagacggacagatcacctgaggtcaggagttctagaccagcctggccaagatggtgaaaacccatctgtactaaaaatacaaaaattatccgggcgtggtggcaggtgcctgtaatcccagttactcgggaggctgagagaacagaatcacttgaacccaggaggcagaggttgcagtgagctgagattgcaccactgcactccagcctgggcaacacagcgagactctgcctcaataaataaataaataaataaataaataaggccaggtgcggtggctcacacctgtaatcccaggattttgggaggccgaggtgggtggatcacgaggtcagagattcaagaccagcctgaccaacatggtgaaaccccttctctactaaaaatacaaaaattagctgggtgtggtggcgggcgcctgtaatcccagctactcaggaggctgaggcaggagaattacttgaacccaggaggcggaggttgcagtgagccgagatggtgccactgcactccagcctgggcaacagaacgagactccgtctcaaacaaaataataataataataataaataaataaaaattaggctggggagatggctcatgtctgtaatcccagcactttggaaggccaaggtgggtggatcagttgagctcagtaatttgagaccagcctggccaacatggtgacacccctaaatttttttagtctttacaaaaaatctataagaaaaccagaaaacgaaattagtggggcatagtggcatgcacctgtagtcccagctacttggaaggctgaggtgggagtaccacttgagcccaggagttcgaggctgcagtgaactatgatcgtgccactacactccagcctgggcaacagagtaagaccctttctcaaaataataatagtaataataataacccagcatggtggtgcacacctgtaatcccagctatttgggaggttgaagcaggtgaattgcttgagcccaggagttccaggctgcaaggaactatgattattacaaccaggaattatgtgccactgtactccagcctgggcaatggagggagaccctgtctctacaaaaataaaacataataaaaccaaatgaaacaagccacacctttaactccctgtggtcttccctactcatttctccctcctctgaacttcccatcagccagattggttggaaatgattagcaagacctaagtagtcttcccctggagcctcacaacttcctgctctgaggggctcccaggatgctttgcaaatagtataaaaccacagtaaggataactcatggatgtaaagcatttcacattttaccttctgatcccctaacctggtattactgttgctctttacagatgaattaaaagagagttaaagcctgatcaatgtcagagtcagaggcagagccaggcctgcaatccaatccctagtttttgtttgttttgttttcatttgagctccatcacccaggctggagtgcagtgacgcgatctcagttagtggcagcctccgcctcccaggttcaagcgattctcctgcctcagcctcccgagttgctgggattacaagcgggtaccaccacacctggctaatttttttgtatttttagtagagacagggtttcaccatgttggccaggctagtcttgaactcctgacctcaagtgatccacccaccttagcctcccaaagtgtggggattacaggtgtgagccaccgcgcctggcccctagtttgtttttcatggagacggtctcactatacggcccaggctggtcttcaactcttggcctcaagtgttcctcctgccttggattcccaaaacactgggattataggtgtgaggcaccatccccagcccagtccctggttttgaatgccacccctatccggatgactcttctcaggctcatacctctcctctaaactacagatccatgtcctcatttgcctctagacacctccacttgatgtctgttggctagctcaaactgatgtggccaaaacagaacttaagatcattctgttgattttaaattgttgaggtcaaaacttagatgtcagctggacgcggtggctcacacctgtaatcccggcactttgggagaccgtggcaggcggatcacttgaggccaggagttcaagaccagcctggccaacatggtgaaaccttgtctctactaaaaatacaaaaatgagctgggcgtgttggcatccgcttgtaatcccagctattcagtaggctgaggcatgagaattgcttgaacatgggtggcagaggttgcagtgagccaagattgtgccactgcactccagccgcacagagtgagactctgtctcaaaaaaaaacaaaaaacaaaaaacaaaaaaaacttagatatcctcctcaattcctctttcctgtgcaccctacacacatctgctagcttgctctgtctgccctccctcccaaattacatcccaaatctgatcactgccctgctccacaccctaacctaaattaccacccatcaggccgggcatggtggctcacgcctgtaatcccagcactttgggaggccaagatgggaggatcacctgaagtcaggagtttgagactagcctggccaacatggtgaaaccctgtctctactaaaaaaaaaaattagccaggcatggtggcaggcgcctgtaatcccagccactcgggaggctgaagcaggagaatcacttgaacccgggaggcggaggttgcagtaagccgagatagcaccactacactccagtctggacgacagaccgagactccatctcaaataaataaccacccatcttccctcaaatgatctactacaataacttcccccttgcggtccactctccatagaccagccaggatgatgacattaaagtgcacattaaatcttgtcgcatttctcctgaaaacccttcaatggcctcctagtgcaactagaaaaagacaagactccttggccagacgcggtggctcacgcaccttggggggcgaggcaggaagattgcttgagcccaggagttggagaccagcctgggcaacacagtgagaccctgtctctaaaaacaaaaaccaaagaaaacaagactccgtaaggtgggttccaaggccagacatgagctgaccggagtcaacctcttcacagtccactctacttctttccctcaaacatcccaggactgtagctgcctcaaggcctttgcaccaacgttttcctgttcaactctactattcattcaggtctctagtcaagtgtcaccccccagagcagctacccagggtgcaatgtcaccaccactgcctctccagtcaaccaaagcactatctgtttgctgtactgcatctccccacccgcccactccgtagattgagcgctctgtgagagcaaggactttgttcactgctgggtccccagagcagggaccagaacaggcgctgggaaaacatctgttgaatgccccaggtactccaaagcccttgctcttttcaatcccaagcaggttccaagtctccagccttccaaaccagggttgcccggtgcgaagcccaggggtgagaggaacaggaagcagggcagatccgtccctgcccttaatccagggtgaagggtttaacctccaggacaagacttttgccgcaggctccagctcctggcctagacttggggctggtgcaggggacaaggcgaagagttgagccagggtctcgggaacccagctgccctcgcccctctatccacaccctatcccaagaaatggtgcgtcccgccgcagggcgtacgcacagagaaggaagtgttcaagtcttccagtgcggagaaaagagactaggactcgcccctcgacgtctcgcggaaggtacctggctccccggtggctgcagctccgggctcctcctcctgcgtcctcgcgtcgcgtactgcttgctgggattcgtagtctcgccttggccatcagttcgcccttcccagagagctttgggaatctaagccgggactgggcggagggcggggagaaggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggggaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagaggtgggatgggactcagtatacttttaccaggaagggggtaaggggtaaaccgtcggcgtcttctgtctcgagtccgccgtctgtccccttggcttgatgtgaattctaaaacgttaagcgaggttaatatatttcattttgcaggggttgtaagtattgctgtgtgccaccctacatacccacttgcccattatcagaagcaaaaactaaaggctagtgagagcaaaggacttactagctgcacaggaagccaggggcaagtcagggccagaaacgggacccctgtctctcagagtttcaagggcagatttgagcaggcgacggtcgtgaaaaggacgttagacaccttagacgccgtggctgaagtttcagacggcgcttctggtccccaaggcttcccacgtagacagttggtattaatggttgagagtgggggctatgaaatcagaaagccttggataggaacactggtccttgtcacttaactgtggcattaagttgagcaagtttcttctctgaactccgttttaactgtgagatggagatattaatagtaacctgagcacgattgtgaggattacatgagatgcaggcagggtgccacatgcctggtaggtggtaccactgaaaaataatcattgcttacattcctcaggagaaagtggaagcatgaggtaggaatcgcaacacatttttgacttttatgtatcatgcactgtgctaggtgcagtgcatgctttatatcgctaaattatgactgtgctggagtaggccttatacatatagccctgttccaccactcacttgtgtttttaatttgagactgtctgactctgcagcccgggaaggcactgtccactagtgctatgctgcctgtgaccagtgcaacttcctgccccatatgaaagcattgctactgtcccatctcttgcaagtggttctgttaaccactcccattgatctggagagacatccaagtatgttgttataactcacccattttccttgtgcttttttttgttttgttttgtttttttgagacaggatctcactctgtcgcccaggttggagtgcagtggcatgatcacagctcactgcagccttgacctcctgggttcaagtgatcttcccacctcagcctcctgagtagctgggaccacaggcatgcgccaccacgcccagctaatttttgtattttttgtagagatggggtttcaccatgttgcccaggctggtcttgaattcctgagctcaggcagtcctcctgccttagccttctaaagtactgggattacaggcgtgagccactgtgctcaacctcttgtgcttctgggaatgagaatttcagccaatttaggtcccaggaaatgtcttaaatggctcatggtgaaatattttgggactacgcacttataatctcttcagtaatacctgggagttgaagaactgagacatcttccaggctgttttccttaataattgtgtgttttggggcacttccctcaatctcaaactgaatttcctgtgaaattaagatcacccctttccacttacttcacctggtgattgaaagcatcatagtattttataaatgccaagaattatgcatgaaggctcggcgcggtggctcacacctgtcatcccagcgctttgggaggccaaggcaggcagatcacttgaggtcaggagtttgagaccagcttggccaacatggcgaaaccccatctctactaaaaatacaaaaattagccgggtagcgcatacctgtattcccagctgctcttgaagctgaggcaggagaatcgctcgaacccaagaggctgaggttgcagtgagccgagattgcgccactacactccagcctgggcgatagagcgagtctccgtctcaaaaaaaaaatgtgcatcaagcataggattgcttcgagtttgcccaccacaagtgtatctttttaatcaggacatggcatgtgtttcccccaagctcattttagagaccagggcagtgggagtagttgtaaaatgtgagaggcaaaggtcaaagtttgtggctcttgtctttaaaatgcagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgcaaacaccccaaaggcagaatctgctattttgagttttccattaacttccaaagaattctggttttcaaaacaggagccagagttggagatattacagtcaactttggcttctaagccagtaattccattcttaaatacctcactgtcttggccatggggaagcactatggcctcagctgggggaaagaccctggcctaggggtcttagccactccccaccctagggtatagttcaggggtatccaatcctttggcttccctgggccatgttggaagaattgtcttgggccacacataaaatacagtaaccatagctgatgagctaaaacaaaaaacaatggtttgtgcaaaaatctcataatgttttaataaagttgaagaatttgtgtttgggcctcattcaaagccatcctgggctgcgtgcagcctgcaggccacgggttggacaagcttggtgtattctgcctattactgagtatcttttggtaagcagtcatacctctctgggtcacagcctcctgccacagttccactctgatgagttcagttcataaaagtgcttagttggtgggtttgaatccttactccactgattctagctatgggaaccaaggtgatatggtttggctgtgtccccacccaaatctcgttttgaattgtagctcccatagtgcccatgtgttgtgggagggactcggtgggagataattgaatcatgggagcggttcccccacactgttctcgtgatagtgaataagtctcacgagatctgatgattttataaggggtttccccttttgcttggctctgattctcttgcctgctgccatgtaagacgggcctttcgccttccaccatgattgtgaggcctcctcagccatgtggaaatgcgaatgcattaaacctctttttataaattacccagtctcgggtatgtctttatcagcagcgtgaaaatggactaatacacaagggcaaggcacttgaacttgctgaactccggtttccttatctgtaaaatggggtagtagaacatactgtgtgggatttttgggagtattaaaggagttgcaggcctgtaatcccagcactttaggaggctgaggtgggaggattgcttgaggccaacagtttaagaccagtctaagcaacatagtgagataccctgcctctacaaaaaaatttaaaattacctgagcatggtggcaccagcctataatcccagctacttgggaggctgaggtgggaggattacttgagccaagaagttaaggttacagtgagttatgattgtgccactgcactcctgcctgggggagagtgagaccctgtctctaaaaatttttggctgggcatagtgtctcacacctgtaatcccagcactttgggaggccaaggcaggcggatcacttaaggtcaggagctcaagaccagcctggccaacatggtgaaaccccatctctactaaaaatacaaaaattagccgagtgtggtggcatatgcttgtaatcccagctactcgggaggctgaggcaggagaattgcttgaactcgggaagtggaggttacagtgagccgagattgcgccactacactccagcctgggagacagcaagactgtcttgctctgtcatccagaatggaatgctatggcctgatctcagctcaatgcagcctcgacctgggtgcaaacaatcctcccacctcagcctcccaggtagctgggactacaggtgtgcgccaccactccccactagtttttttgtattttttgtagaggtagggttttgccatgttgcccaggctggtctcgaactcctggactcaagacatcctcctgccttggcttcccaaagtgttgggattacaggcgtgagccaccatgcccagccaaaaatgtttttaaattaaatttttaaaaatagaggagctgtaggccgggcgtggtggctcacgcctgtaatcccagcactttgtgaggccgaggtgggtggatcacgaggtcaggagattgagaccatcctggctaacacggtgaaaccccatttctactaaaaatacaaaaacattagccgggcgtggtggcgggcgcctgtagtcccagctactcgggaggctgaggcaggagaacggcgtgaacccgggaggcggaggttgcaatgagcagagatcgcatcactgcactccagcctgggcaacagagcaagactccatctcaaaaaaaaaaaaaaaaatagacgagctgtaatgcagttagcacagtcacagatgctggcacatggaagaaactgttggcagagagacatggaggctaaggactcagaaaaccagacgattctgctggaaggctggagcagtaggaatgtgaagaggaggagttggagaaacgtctggtcattcattcagcaagtgtttggctggccactgtgaggcactgtgctagcaggacatatgatggtaatatagcatgtggggcttaaactcctatggggaagacactaaaagccatcctgtattattacagactgagccaaaggctctgggaagcagtgcaaggagagggagggattaaccagggtgacagctggtctagggaagcctcagaagagctgagaccgataggtgataaagatgagccacttacgttgggcgttagaggcaaagcaggggaagtagcaggttttagggcccatatggggaaagcacttgctgtgttgcaggagctcacaggccaggtagatgaggttgaaggtggagaatacacgagaccagatcattcaggacctggtaagtcatagtgaagaatctgggccgggcacagtggttcatgcctgcaatcccagcactttgggaggccgaggtgggtggatcacttgaggtcaggagttcaagaccagcctggccaacatggtgaaacccctgtctctactaaaaatacaaaaattagcgggggcgtggtggcgtgcacctataaccccagctacttgggagggtgaggcaggagaatcgtttgaacctgggaggcagaggttgtagtgagctgaggtctcaccactgcactctagcctgggcgatagagtgagactccatctcaaaaaaaaaaaaaaaaaaaaaaaagaatctggattttaccaaaattagaatgagtagctactactgaaaatgtcttaagcaagggagcaacaagctctgtcatataaaaacctcactctgggaactgtggggcaattagattggaagtgggtgggaataaaagcagagagcctagctaggaggctgatgcctggctcctggttagagctgatggctgttagagaccttgcagcctggctggaaaccgtgcctcctggctgggagtgccagaggagaacactgggaagccctgagcaggcatagagcagttgttttgtagctggggtggctgcctggcctagtaaggtaaatgactcacccgtctgccatctttcacctacagcctgatgtgattcagccagagctggattatccagaatcttctctgatggaggaagattcaggtcaggaaacccatggagaggtaggagagaccctagaaattgtccagtttttcctacctgaggtgtatctttgtgaagacgaagttgaagcctagaaaaatcatgacctgctgaagatagtatagctctgggggtcaaatcaagacctaaaccaggccaggcgcggtcagacgtggtggctcacgcctgtaatcccaacactttgagaggccaaggcaggtgaatcacttgaggtcaggagttcgagaccagcctgggcaacatggcaaaaccctgtctctactaaaaatacaaaaattagccgggtgtgatggctcatgcctgtaatcccagctactcgggaggctgaggcaggagaatcgctttaacctgggagtcagaggttgcagtgagctgagattgtgccactgcactccagcctgggcaacagagcgagaccccatctcaaaaacaaacaaacaaaaaacgcataaaaaattaaagttagttttattcagaagtttttttgttttttctgtgtgtgtgcttttttttttttttttgagaaaaaaaaaaaaaaaaaaaaaggagccctgaaccaaagcggaggctattctaagacttttgtttttgagacgccataatagctcactgcagctttgaactcctgggctcctcctgcctcggcctcctgagttgctgggagtacaggtgtgtgccattgtgcccagctaattttttgcagagacgtggtcttgccattacccagaaggctcttaaactcccggcctccagtgatcctccctccttggcctcccaaaacactaggaaaataggcgtgaggcactatccctggtctcagatgtttatgaatgatttcagcatcacatagagaatgactctgggggttgaagattgcaacttatattaaattgttcccaattatttgagggcaacattctggtaaacaataaagcaggggccaggcacagtggctcacgcctgtaatcccagcactttgggaggctgaggcgggtggatcacttgaggtcaggagttcgagaccagcctggccaacatggtgaaaccctgtctctactaaaaatacaaaaattagctgggcgtggtggtgtctgcctgtagtcccagctactcaggaggctgagacaggagaatcgcttaaatctgggaggcagaggttgcagtgagccgagatcgtgccactgcactccagcctgggtgacagagcgagacaccatctgaaaacaaacaaacaaacaaacaaaaatgcataaagaattaaagttagttttattaagaagtcttttttttttttgaggcagggtcttactctattacccaggccaaagtataatggcacaatcatggctcattgcagcctccaactcctgggctcaaaggatctccttgcctcagcctctccagtagctgggactatagttgcctgccaccacacccagctaatttaaaaatttttcttttatagagatggagtctcactatgttgaccaggctggttttgaactcctggcttcaagtgatcctcctgcctcagcctcccaaagtgctgagattacaagagtgagtcattgtgcccagtcttgctctgttacccaggctagagtgcggtggcgtgatctcggctcactgcaacctccacttcccgggttccagcagttctgcctcagcctcccgagtagctgggattacaggcacccaccaccatgcctgactaatttttttattttgtagtagagatcgggtttcaccatgttggccaggctgttctcgaactcctgatctcaggtgatctgcccaccttggcctcccaaagtgctgggattacaggcataagccaccgtgcccatccagcctattttttgtttgtttttaagagatgggggtcttgctatgttgccaaggctggtcttgaactcctggcctcaagtgatgcttctaccttggcctcccaaagtgctaggattacaagcatgagtcactgtatcccaccgttatttttctttgccattgtattttctagatttctaacttttctgcatcaaccgtgtattatttttataaggtggggtacataaattaaaagggggtttcccagatagagagtgaatacagagagctaagaaacgtgagccaccagctctggctccaggcctggaacccctctgctttgtggcccaggactccctcctcagatgccaatgaggacttgtccctcggtggcactgccaaatgagagctgcctccccacccccccgccccagagctccctggatgggactgccatgcaggtgggaagaggtaggattaacaccctcctccaattggcaccaagaagctgtttataactagaaaacagttctcctccctcccaagcttagcctgaggcatttcctggaggcaaaagctgggacagtctttaaagtcagaaagcctcaagggcttcccacttgctccccagcacaggtgttaggaaaagttaaatacttgggtaccttggaaagtgagttccagaaagtctctgatcccacataactctgagcaagcaggaccactctcctaagagtactggagttaatgtcatttccctagcttctctcttgtgctcaaaaatatctcttaagctgggcgcagtggctcatgcctgtaatcccaacactttgggaggccaaggcgggaggatcgcttgagcctaggagtttgagactagcctgggcaacatgagaccctgtctctacaaaaagtaaaaaaaaaaagaatttcagctcaggttagggctatgaagaaaatcaaactgataatttatggagagtgactctggtttgaagagtaacgttacatgcgctttgtttcttttatctttttttttttttttttttttttttgagacagggtctcactcagtctcctaggctggagtgcagtggcaccgtctcggctcactgcaacttctgcctcccgggttcaaatgattcttgtgcctcagcctcccaagtagctgggattacaggtgtgtgctaccatgcccagattattttttgtattttaatagagatggggtttcaccacgttgcccaggcaatccacccaccttagcctcccgaagtgctgagattacctgcatgagccaccgtggccagccaagagcattgattttagaatggacagtcctgggttagacttcaagccccaccactcaccggctgtgcgaactcagacaagttacttaccctctctcagccagttcctttatctgtaaaataaataacccccatgatactgcacaatggcagccataattcttgttgtttctgagggtgttgttatctaggaggggtgtcaagggaagtaaactctgtatagtaaatctccacccagctgactgcttaaataacccagccagagggtaccctagaagcttctggcaccccagggctgcctgccagggcttaaaacattttacctctgtgttgtcatggtggcccaaagaaggaaggcccagctctcagaacattctaggtttgtacaccaagcacacgttgagcttgtcccaggtagacacaaggatgcttcctaaccacaggctgggttccctggggagtggactccactgggggctagtgtagaccaaggaaaagaaacaggaccagcagaagaagtcagactggctgggcgtggtggctcatccctgtaatcccaacactttgggaggccgaggcagatggatcatctgaggtcaggagtttgagaccagcctggccaaatggtgaaaccccgtctctactaaaaatacgaaaaattagctgggcatggtggtgggggggggggcacctgtaatcccagctacttgggaaactgagacaggagaattgcttgaacctgggaggcagaggctgcagtgagctgacatcacaccactgccctcttgcctgggcgacagagtgagactccatttcaaaaaaaaaaaagaagtcagaccaagatgtagatgtgttctttgtgtttttgtttttgttgttgtttttgagacggagtcttgctctgtcacccaggctggagtgcaatggcatgatcttggctcactgtaacctctgcctcctggattcaggtgattttcccaccttagtctcccgagtagctgggactacaggctcccaccaccacgtctggctagttttggtatttttagtagagacagggtttcactatgttggccaggctggtctcaaactcctgatcttgtgatccacccgcctcggcctcccaaagtgctgggattacaggtgtgagccactgcatctggccatagatgcagtttcaacaaaggcttccgctgaccctggttagttctgaagcatggccgttcagagctgtcctgatctgggtgaccagggccatttatagcctctttttctttttgagtttttttttttttcttttggtagagacggggtttcaccatgttacccaggctggtcttgaattcctggactcaagtgatctgcctgccttgttctcccaaagtgctgggattacaggcgtgagccaccgcacccagactgtagtctcttttgatcactcgctggaggctgctgcctaggaagtgggcagacagggcagggcagttctcttcagcctggccaatccctgaagaggccaacagcacgtccagcatctgaggtggtaaatctttcgtactgaagggactatgggtacccaccacactcccctccctacctctgcatctttctccggcccattttatacctgcatctgcttcttgaagctctgtaacaacagattggcaaaataaaaatcactagatgtccttttacttattaaattcacaaagttttttttttttaatcattataatatccggcatgagccaagatatgggaaatgatcgtttcaaacactgctggcgggaagacccattcaacaacatcagtcaaaaaacttgacccagcaattctatttctaagaatttatcctgagaagataatcatgattgtgggcaaatatttagccaggagactcttcattgtagcttaacggcaaataattagaaagaacctcaatgtacaaaaacagggaattgcccgactaaagcatggtataatagaagacaagtaagccattcgacatgatgcagatgagaaacagaaagatgttcacaatatctcattacctgaataaatggtgataatagcatgtgtagtacgatcccatatttgtagaaaaccattatgtgtattctttttttctaaaaaaaaaatgctgtaaggataagaactaaaatcttaacagtgattatttccgcatggcaggattatcagtagttttcctttgcttatttgtgtgaaccacaccgagcatgttactgcttttgtactaaggggggaagcaatgtaagttattaaaaagaaatagattccatccccatgactcagtcagcccttccaaacacaaggaacaaggaccgtcctacaaatgagtttgaagtcctctggggaaaggacagaaatcaatgaatttacaatgcctgagcaatgtgcaaagttggagagaatacaaattccttgcacaagacggaggttgtggcagctgcttgagtgacagcaaaggacgaacactctgtactgtgtggggcaggcaaccagcacacacagaagatcacacacacaaaaatagtgccttctctgggcactcactcgggggcaggcctgggccaggtgccgcacatgcaccctgtgtcactggattgtcattccaagtggaaaatgaggctcagagaggttaagtgtcttgcccagggtaacgcagctagtgagagtagagcagagatccaaatgcaggaccattggctatgctcatatttattactatgtgccatgtaaaaaaaaaatcatttttctcttttctttggggccttggcctgatatgcttgaatttatatatagaccgaatgccaagggcagactccagcaggcatcaaggacagagcaatgatggagtgtagcgaaagtgttggctggcagctgcttggtgctgactgccttcttgctgctcctggcctatccccattttgaaacttctgcctagactgggcacagtggctcacacctgtaatcccagcactttgggaggctgaggcaggcagatcgcttgagctcaggagtttgagaccagcctgggaaacatgggggaaccccatctctacaaaaaatacaaaaattagctgggtgtggtggtgcacacctgcagtcccagctactcaggaagctgaggtgggaggatcactcgagcttgggaggtggaggttgcagtgaaccaaggtcacaacactgccctccagcctgggtggcagagtgacaccctgtctcaaaaagcaaaacaaaacaaaacacttttatccagaaccttccctgattgcgctggaacccttcttctccattgcacttttttttttttttttttttttttgagatggagtttcactcttgttgcccaggctggagtgcaacggcgcgatcttagctcactgcaaactctgcctcctgggttcaagcaattctcctgcctcagcctcccaagtacctgggattacaggcatgcaccaccacacccagctaattttgtatttttggtagcgatggggtttcaccatgttggtcaggctggtctcgaactcctgacctcaggtgatccacccacctcggcctcccaaagtgctgggattacaggcgtaagccaccgcacccagcctccattgcactcttgtaaggccagactgatgcccctgcttaaacaccttcaatggctccccactgcccacaacaagatcaagttcatattccctagcctgacatgtaagacccaggctacctcaaatctcacttcacaaacctaccaaatagggtccttgctgggctttcctttgctccatcaccttatgcctgggcatggattagggagacaggacatgcctgagtttgaatcctagccctgctgctctttggctgggggtccttgggcaggttgtttcccctctctgaccctcagtttcctcatctgaaaaatggaataatgatgctgacatgtcacagggtggttgggaaaatatatgagagtgcttgtgatgtgcttagcacaggtctaggaggggtcatttgttatgttgctacagagggtaaatgaatgggtctccccacacagtcttcagggacctgtgcctaattagcatatttgatccacaaaaatgcaggctgagcgctttggggctgactgtacagctgaatcagccaagtgcctccccctcattgtcccagctgctttaaaatcgtgttctcggcatcccttccctccctctgaggcctgatcgctttcctgtgttctcctttttgtcccttggcaatctcattttccatgcctccaacactattttaagccccagtaaccgtgtatcttcctcgggcatcccttatctctccccagcacctttcactgagaacagagtcctctcagttccctccatccttgctgtctcagcaggcttctgtctccctccagtgcaggccccaaacagggagggccacctcttgccctggggctgcaactccatgcgatgcctgatctccttagctcaccaagctttcctaatggaaacatctccttccattgggccctctgcagggaatcctttccctccactggcagtcaggagaggctacagcagagcagagattggggaaatatgtcctgcccagcttcctactctcttccctttcccctgcccagctttctactctcttccctttcccctgcccctctgccaatagaatgacttgaattacaggctatatcagcaaaagcaaggtatttagaacaaaggaggtgataggccctctttttcgtgctgagctaaccacatgtggagtattgtagcttccagttcaagtgcctagctataggggaggaaagcctataggggctgagagaatggactttggaagctgcaaatctgggtttgaattctgactcagccactttgcagccaaaagcaagtgactgaacttcctttttatttttatttttatttttgagacagagtctcattctgttgcccaggctggagtgcagtggtgcgatctcggctcactgtaacctccacctcccgggttcaagcaattctcttgcttcaacctccctagtagctgggactataggcacatgccaccatgcccggctaattttttacttttagtagagacagggtttcactatgttggccaggcttgtctcgaactcctgacctcaggtgatccacccgccttggcctcccaaaatgctgggattacaggcgtgagccactgtgcccggcctgaacttccaaacaagacttttaatcaaccattttcctggctttgtttcaaggattcactgagggtaatttccagtcctacaaagctgtgtggggcacctcctctgggctcccaggacaccgactgcacacttaccaggcctgtcttctgtgtccagcttgtgtatccaggccatccagagcccatgggagatggcccaggaggaattagggcagctctgccaagagagtggggtgtggggtgcacagaaagccagctggagcattggctggaagtacctgccactcctctcccagcccggtccctgtgggcaagtccctgtgagctcactagcttgtctcacggcagaccgggactgtacacaccttatcccagccaccctgccaacatctccagtttattgataggacaactgtggcttcggaaggtgaggccaccttgctcaaagtcagagagccagggagtggctgagcccagctcagttctgaccccagagcctagcccctgctctgaatggcaaaagcaaaataggccaccagccatttaggggaccctggtcccccagggaaaaggtctgacctggccatcacgtcttactctgaattaacaccctggggagcgttaaatgcctttttgtgtaggcctctctcaagcaggggagtgtggttttccaggtgtgacaggccacctcctgtttgacaggtcatcaagctggtcctcatctgtcactgtcactgtcctgtggcaaggcctctgaccctgaaggctgggctgtggacattggctctgtcatggggcacctggggagcccatcagagtgaaggggccagtagcttcactttcttctaaacaaactcccatccaaagggctcaaatatggagtttccaaccttccctagagacaagggcctggggagaggctgtttcacgacagaagtcacccatggaggcaaaagccttggagttcaagccacccccgattctgtcccaccagggagaactaccagccaaaacccagagtgacgggccgctctataactgttcatggccctaggaccccagaattccatgcttcgaactgtgccccccggaaatagcaggtgatgtgtgcaaaggggtttctggcagggtggttaaaagaagggagatggctgggcgcaatggctcacacctgtaatcccagcactttgggaggtcaaggcgggaggatcacttgagcccaggagttcaaaaccagcctgggcaacatggtgaaaccctgtctgtattattaaaaataataataaaataaaataagaaagacaaattcctaactttataggaatcattggtgcttttctcactgggggccccttttccacctggctcttctgcgtaaaatcattttaaggaggagaaaaccataattacaatctccttaggatggcagagcacttaagggacatgtcagagtgctgagagtggactcctgttgctagaaaaggcagcgtcaccgtcatcatttcatattcagaaaactagaattaagtacctgtcatttttgtaattcagaccacagtaagtaaagctggaggaaacctccatggctggaagagagccacagaagctcagcaaagtcttttttttgagacagagtcttgctctgttgcccacgctggagtgcagtggcatgatcttggctcactgcaacctccacctcccgggttcaagtgattcttgtgcctcggcctcccaagtagctggagactacagatgtgtgccaccatgcccagctaatttttgtatttttagtagagacgggatttcaccatgttggccaggctggtctccaactcctgacctcaggtgatccgcccacctcggcctcccaaagtattggaattacaggtgtgagccaccacacccggccccagcagagtcttaagcaggacaaagctccccacccccaggggaggggggatgtctggaattccaaagcctaagattggggctggttgggggttgaaacaggttgagaaaatctggactaaatgccctttaagatgtactgaattccgccagtctgtatgaaatcctcttgctgattatcgatcgttggaagggaattttcagtgtgatgtgaagtgagaatttcatgctcgttttgaggatcctcacccccaccccatacacacatagggtaacctctagaaagaacgatttttttttttgagacagggtcttgctctgttgcccaggttggagtgcagtggcatgctcagggctcactgcagcctccaccccaccaggctcaagtgatcctcccacctcaggctcccgagtagctagggctacaggtgcatgccaccacacctggctaatttttctattttttgtagagacgaggtttcgccatgttgccctagctgttcttgaacccccaggctcaagcaatccacccacctccgtctttcaaagtgctaggattacaggcatgagccactgcacccagccctcagaatgaatttttaaccctagttctgactactgaattgcaacagcctctggccacagtcaaagcccctgccttgctgccccacgctcaagagatttagagaaggccagatgccaagctgctctggggagcctctgctccacccttcctctccctggggactggccttcccccaggtgggtcccctggagcctgggtgcctccccagctctttctaggcatcccataaacatgctctgggtgccaacacccctccccacctctaagtcccctcttcctcgtcaatgccaatttccttccaagaaggatcctcctgttccattcttcctgctggctgcctccccgccacttcctggcagagccccagtgaaccccattgcctctgcctagttaatctctctctctctctgcttctgggaattctctttgctctcagcctctttctgttgattttgcttgtttatttctcttcccactcatttcttcattcatgtattaggatttagcacaattattaatcatttttacaaaatgtcttatataatatccacatgcctcttgtacagtgaattccaagaaggcagagtctgggttcttctcacacatgcctgacacatagtcgatttttggcgaatatgtgagtggatgcccttgtcctcctcttccttttcccttccagccgggctgaccgcccagtccctgatttctgagaacaagctgcaaacactgagagctgcgctttgaaccactgactaggcagtgggctggcctgccttctggccttaactccttccctcctgcctttttttttttgtctttttttttagagacagggccttgctctgtcatccaagcctaagtgcaggggcttgatcatagctcactgcagcctcgaactcctgggcttagcctcaacctcatgaatagtcaggactgggactacagctgagcaccactatgcctggctaatttttatttttttaattaattttaattattattattattttttgagacggagtctcactctgtcacccaggctggagtgcaatggcgcagtctctgctcactgcaacctctgcctcctgggttcaagtgattcccctgcctcagcctcccgagtggctgggattacaggtgtgtgccaccacccccggctaatttttgtatttttagtagagacggggtttcgttatgttggccaggctggtctcaaactcctgacttcaggtgatccacttgccccggcctcccaaagtgctgagattataggcgtgagccaccatgcccggcctctattattttcatttatgcacattcccttccagacttgctttgtttgtatgaaaaaaagaattaacattttcaccatcatggtgcatcaatcatgtattctacttttaaaaattcttgaatatttagtttcccatgtcactaccaagtctaccaagtctctgttgatatcattttaaacggctacacaacacccccttgcatttttcttttgtttgctttttttcttctttacagaggtggtcgagttacccccctgcatttcttgggtgttgactttttttgttttgtttccctcccagtatgattttacccaagctcctggtgtggcagggccatgcaagttctcaccaatcctttcttcttccagactgcacctggctctttaagcctaacccatcctcccacccctgtgggggctcgggtcccttttagtaaacaaggaccggctctgccccaccacctcacagaggcacagaagcactgttcaaacacacatgcccatgacattgccacccacagattaggaacaaagacgctggagtcttaagtcctcttggagacgcaaggtcttcaaagcttgctggcaaatgtgatagtcgtgttctttgccagggcctagagaaggcacttagaaaatacctgtgtagaagcagcagtggggatggtgggatgcagtgacccagcaggcatttctagccccacttcgcttctaacacttctgcagctgcaaattttttttttccttttaagagacaaggtctctggctgggtgcggtggctcacgcttataatcccagcactttgggaggctgaggtgggtggatcacgaggtcaggagtttgagactagcctggccaacatggtgaaaccctgtctctactaaaaatacgaaaattagccgggcacggtggtgcacacctgtagtcccagctactcgggaggctgaggcaggagcatcactggaacccgggaggcggaggttgcagtgagccgagatcgtgccagtgcactccagcctgggtgacagagcaagactccgtctcaaaaaaaaaaagagacaaggtctcactcgttgcccaggctggagtgcagtggcatgattatagctcactgcagcctccaactcctgggtgcaccctccaactcccgggctcaagtgatcctccagcctcagcctcctgcgtagctgggactacaggtgtgcaccaccatacccaccttatttattattttctggagggatcgggtcttgctatgttgcacaggctggagcagctgccaatgttaattaaaccttgggatctcctcagaggatttaactggcaccaggtggaaagatttcatctggtccaacaggatcactgtacagatgggaaaactgaggccctgagagatgaggcagtaggcgtaggaacaccattctggatggcccctgagctgttttcaaagcacctctgaaagagtgctttcaagatctgaaatgagaaagtagtagatcctcaagggagatgaagtttgacctggcactacattctgaaaaatttgaaaaactgactccttctcaaatactttaaaccaggattttcacatgaggcctgaacaccagtccaggtgggtgggaggtatagatgactaagagaatgtgagaggggccgtgtgaacaggaacaggtaagaccagtaaatcctgggaactcccaactcaccttgccttgctccagggacaagcactggacctgaggagtttagggaggtccctggcaaatgcctccaggaggaaacagagtcttcctgctgcctgtcaggacggctgaccctgggcctgatctcagctaattcagcagctcagggggaggacaccacccccgtatctgctctgcatctcaaatacaccaagagggctggccaggcagagggattgctattgattttcacttgtgcgggctgacctaacaaaaccaatccatcaagtgcctgtctgcctctgcttcagactctcatcctaagcacgtgcaaataaattgcaccagcatccagggtgatttgtcaaggtccagccaggcatgggccctggcttccactgataggatggggctccaggctaggctgggctagggtcagcccagtcaatgccccgctgttgactcgccattgagtgacaacacgcagtgtggcctggcatctgctgccacgctaggaactggttggccatgcctgggaaggggctttgaggaaacaggcccaagtcccactcactttgacagggcttggcagcgacattctcacttgtttcttaaggtttctgtccgaactctagatttggggggatttattacaatgtagatacaaccatgaggtgctgagtttgggtactgcctctgccactggctgaatgtccttgggccagttgtgagatggagatgacaccacctacaggggtctagaaccctgtaaaggccagggtccaatccctgttctgccacttcctagctgtggccggggcaggtgccttcagccctcggtgcctcattttccttatctgtactaccgggctgaaaatggtacctacctcttacagtggagctgtcataactgaatgagaaaatgcaaaggaccacaggggctcaccccacccagcccttcattccactagcaaggactggaggctcagagaagggggtgatgttctggggtcacacagcaaggcagagcagcatcagaggggttacaggagccacaagcaggagaggatgacggagagagtacagtgaccatcctgccttcctgtcctccagctggcagctgtccctgaagaatgagacacagggaatgtgggtcatggacatacacagatcgtttgaaagggtcaaaaattttattagcaggactttttgtgtttttgaatatacaggtttcctgctgtccagggtaaaggggaagtggtgtcttgtggcccgaggtttggggcgcttgccttgggactccatccccatctctttcccgctagcgcagctgggggaaggtgcctgcttgccggccccacggattcttcggctgtggcataaggcactgtgtgttctgcaggaaggcgctcatggctggctggtagatgagaggcggccttctcaggggctgcaaagctgaggctgttgaggggttgagttgaacttggggcccctagtgaggaggccccaggcgatgggagcacggcctggtgagtctggtgccgctgcctccccactggccctgcaccaggtctcaggatgggatcatgcctttgctcctcttgcggtcggccatggttctccggttgtggttggctcttgtcgccttgttggcttccttcttcctgcgttcctgggttgtctcgcggctctgcccatggcctcgggggctgccggccactgctgttgagctgtcatgccggtacctgagggaggaacaacccaccccacgagaacctgtcagccggaagaggctctggcgggagagcccacagcctgccttggtgttcactgggagaggacacagactgggcctggtcactcatgtcccaacttcagatggaaggagagatggagcccagcaggggcagggccctggggctctgaccagccccgagcctggtgttttctcttctctgggccttgcttccaggtccgcccattgctacgtgtagcggaggaacagctagagagctgacacagcctacaggagacggggagggcttcaggtgggtctcctcctttctccctctggggccacatgctgtagctgagacattactcctgttctctaccctagggctttgcctggcagcctccaaagaccaagtgcactcacagatgtgacctagggccctttcagaccatcttgaccactgggatttgccagagctccgcactcagggggctgggatggatgagaagtcagggttgctctgctccctgctcaacaaccttctgtggctccccactgccttcagaatgaaatccaaatgccttccctgtggccaggcctcctgaacccagcagacagtgctgcatgaagcctagggccgggatgcgggagtgggcttctactcctggcttggccttaggtggaggcagatccttggcccctctcaatgtttcctcactgggaagatgcggggcctggatgaggagtctctgggtactgatctcagctcccctcgaagatccctctcctgaccacgcctgctttcttacttttctgccctcatatgacaaactcctctgagcccttttcacccttaggggcccaactcaagtgcccgtcacttccatacctctatcagccagaaaggatgtgtctgtgtctgtctgagctctctcacatttacactctgcctgatatcagctagccctggacacgctgggtgataaatcccctcctgtgttcaccaagtaatggttatgagtggggaccctggagctgagccatctgggctccatctttgctacatcacctactagctgtgtgacttctggctggttacttaacgtctctgggcctgagttttttcatctgtcaaataaggatagtgataatggtagctacttcactgggttgtcgtgagaactaaatacacgtggagcacttagggtgtacgtgtgggtttcctgggtggctggctaggccctccccagatggtgggaggggtccccccagaagcagccccttgaatgctcaccctttcttggcgagaaaggccatgcgcctggcttctgccttctctctcagcactgcagggtcctgaacaaaatggtcgggctgtggaaaggagaggagaccaaatctggagtcaggagctgccacattttcctaagcggcgatgaggccctgctcaagtgaagcttgtcgatgcctccatgccaggtgtggggggaagctgcagcctggcagagcgacgcccaggaatggagtgggattactgtggtctgaggtttccattaggagccccctgccccacctcttccctgagcgggtggcagctgaagggactgaggcttcctggacaggctggtagagtggatagaccatagttatggcataacaatgacaaatgggagtggtggggaagccaggatggccactgtgagaggctgtgcagggccctgaagactgcgggagccaccgtgggagctaagtggtcccgggagctgcaggcctaggcctcactgtggcaccactagcagcatgtgtgggagtgcccactctcaaggacagccttctctgccaatagtgcaaggaaaaactgggacctagggaccacagacaggctttggtggccagtagctttaaaaaggaaaaaaaaaggccagacactgtagtttacatctgtaatcccagcactttgggaggtcaaggtgggaggatcacttgagtccaggagtttgagaccagcctggacaacactgtgagatcccatctctacaaaaacacataaaaactagccaggcgtggtggtgtgagcccataatcccagctactagggaagctgaggtgggaggattgcttgggcccaggagtttgaggctgtagtaagccatgactgcaccactgcaccccagcctaggcgacaaagcgagactctgtctctaaaaagaagaagaagaagaaggctgggtgtggtggctcatgcctgtaatcccagcactttgggaggccgaggcaggtggatcacctgaggtcaggagttggagaccagcctggccaacatggtgaaaccccgtctttactgaaaatacaaaaaattagccaggcatggtggcgagctcctgtaatcccagctacttgggaggctgaggcaggagaatcacttgaatccgggaggtggaggttgcagtgagccaagattgcaccattgcactccagcctggatgacgagagtgggacgccatctccaaaacaacaacaacaacaacaaaacacacacacacacacaaaactggtaggttttacataaaaatctgggctgaccccttgcctgagaagcagataaatctgtggaaactctgagtctgtgcttgcaccgaggagcccctgaggcagggcacgtgcttcccactgctcagcgcagtccccaccaggccccgctactcattgccgttggtgacctggccccagaaacatctgaatttgtcaccctggtgtggggcatgatcccaggttgctgccctgtcacctgagcagtaccgcgtttatctgttctgtacgttgaggttctagttaagatttcattcaaataaaaagtttagctgctaaaaagtagaattttctaacttaccgatccagatgacctcccagggcccttgggctctaactcctctctgattttaagaattgccatcctgggtatggtgctgctaactgcccttctcctgactcctaggctcctgggcctaataatgaagctggtggctcagaggccctgcctttaatctgtcccctaggtcctcactagtgggcagcagaagttagttctaagccagtagctctccaagcagacatcctgggctcaaagggactcctcctgtccctgccagtgatgctggggctgcctcagggccagacatagggaggggtgaggggcccttctgattcacccctcagaactgcactctccccttcatctgctacctgccagggaggtaccttgggagcctcctcgtcagcatcgtcttcctcatcgtcgtcatcctcctcctgcccttctctaggcactttggttctcagcacctgagggatggtgaatggcctgagggtgtggagagaaatgagatcaaagacgaggttcaaccaggagcaagagccacaaggaggagggaacctggttgggtgagatggggccgccaggagggctcaggaggttgggaaaaaccaaaagcctttcaagccagatttgctccagcccctggattctctgaggttaccagaatttgaggtggggttgagggggagactgaaatggggccgggagagtctccagtcctctcttcagtcgggacagctctgcttggatctgtattggggaatcgctgtaacattccacctgaaaacattttcttcaattaagaagaaaaatggactgagcgcggtggctcacgcctgtaatacccacactttgggaggttgaggtggaaggatcacttgagcccaggaggtgagactagtctgggcaacatagtgagaaccccacctccacaaaaaataaaaaagttagcggggtgtggtggtgcacaccacacctgtagtcccagctactcaggaggctgaggtgggatgatcacttgtagtccaggaggtcaaggctgcagtcagccatgattccatcaccgcactccagcctgggcgacagagtgaaactctgtctcaaaaaagaaaaacgcaaagctactgcatgacaccgaataaatgctgccccattcagggtgggctggggtggaggagcactggattaggagtcaggaggactgggtttgggccctggatctgccacatctgtgtaaacaagtgggtgagggagccccatgggcctgagagctgctctgccctggaacgccacccccactatggcctcacctgcggctgatgagctcgtcatcagagtctgcatcattggcgcccacctggttgccatcgtatgtgtcatcgtactcatcctcgtagtagacactgtggtagggcaggctctcgcctggctgcagtggcacctgcaatggcataagcatgggtctggggggctcaggggctggcctggtttccctggcccagcagagacctggccttggtggcctacctcctccaccaccacgctgtactgctcgtagcgctgccgctgtgccgccactgcacgcttgtcgttcagcaaactccgcgtgttttcctccttcctggtgctgagaaggaacagcagaaagagaggaaggaaaaccatcaggcttggaaggccgcagggtacggagggtccagagaccacaggcttaactgctccagccctcagactgtcacggagacaaatgaaatcaagcattggtgagggcgtgggagggtgggactgtcactgctgctggtgcccataaggatggctccagccactttagagggcatcccaagagccactgtttttttttttttttgagaggaagtcttgctctgtcacccaggctgcagtgcagtggcacgatctcggctcactgcaacctccatctcccaggttcaagcgattcttctgtctcagcctcccgtgtagctgggactacaggcctggttaatttttgtatttttattagagatggagtttcaccatgttggccaggttggcctcaaactcctgaccgcaagtgatccccccacctcagcctcccaaagtgctgggattacaggtgtgagccgctgcgcccggccaagagccactgttaaaaggtaaaatggggctgggcgcagtggctcactcctgtaatcccaacactttgggaggccgaggcgggtggatcacaaggtcaggagttcaagaccagcctgaccaagatggtgaaaccccgtctctactaaaaatacaaaaattagccgggcatagtggcgggtgcctgtaatcccagttacacgggaggctgagccaggagaatcgcttgaagctgggaagtggaggttgcagtgagccgagatcacgccactgcactccagcctgggcgacagtgcaagactccatctcaaaataaataaataaataaaaaaggtaaaatgtgcgtacctttcaaccaggatattccctgtcaaggcatctgccctaaagaaacaccagctctgtgtacagaggtctgattagggattttcttttcagcattgtttgcaacagtgaaaaatggaaagcaactaatgtccatcatgagtgaaagagccaaatgaactgtgccacatctgtattagatcgttgtgtggtagttgtcaagaaagacattgatctatttgtgctgatgcggaaagaattctcacttattcccaaggaaaacaagcaagctacagaaaaatgcgtacagtatgatcccaaaagcaaactacgctaactctgtttctatggccacacgcctatgcatgacaatgcagacagaaggctaggaagccccacgccaaatgacagtggttactgcttggaagcacctggagttgtctaaatcttttttttttttttttgttacaggctagagtgcagtgatatgatcttgcaacctccgcctcctgggctcaagcgattctcgtgcctcaggctcctgagtagctgggagtacaggtgcgtgccactatgcctggctaatttttgtattttgttatagagatggggtatctgccatgttggtcaggctggtctggaactcctggtctcaagtgatctgcttgcctcaacctcccaaagtgctaggattacaggaatgagccaccgtgcccagcctaatttttaaattttttgtagagacagggtctcactatattgcccaggctggtcttgatctcttgggctcaagtgatcctctgcttcagccttccaaaatgctgggattacaggtgtgagctactgtgcccagcctggatctcttaaacaaaattttttttcattttaaaattgttattcgtttattgttttttcaaaaatgacctttccttgccaacaaacaaaaatttaagaagcagtaaggccacatgtggctttctgactgagctcaagggagccatagggatatctggggtataagaaaagggggttcccagtcctcttcctatcacccccacctcactacagcagccttctgtctcttccacagctcaagtttccatgtaaaatttcactggaagaaaatgtttggaagcccaactctggtcacgttacaggtgaggaaactcgggtgcattgggtgggagaaggaacatgtttgggtcacaagtgagctgcagcacagcttcggcagggactgaggcttctcaactcacggctttgcaaacctgtgaaaaaacctggcttgtcagaaacatacccaggcctgtggaatgtagcttctagccctgcaggggaaaatcaatatgagatgccaggcaagaaaatccagcttagctgtgaaatcgggtctctggaatgtatcaagggtaagataataaaaaaaaaaagaaaagacacaaagccaaacagagcttccataaaaatcttctattaactggcttttggtgcagggagaggcaggcgtctgagtccatctcagtctgtcaggctatctgcctggcagccagggcaggtcaggactgcagccttcagcatggcgggctagggtttgcctcccttcacatcttttttttttttgagacggactcttgctctgttgcccaggctggagtgcagtggcgtgatctcagctcactgcaacctccaccagccgggttcaagcgattctcctgccttagcctccccagtagctgggactacacgtgtgtgccaccaagcccagctaattttttgtatttttttttagtagtctttattaaggaccttctctgtgccgggcagggtatgaggctgagttggggagagattcagaaatgaagaagatagagatctgccctcatgaactcagtgtagtggagatgacagaccagtcaacacgaaatgtgctgaacggaagccctggaaacaaagggaatgaacttggttcaggaggtctggctgggcatctgtaggaaggggtaatggaggctccacggtagggggttacttgattggaccaggagccccaaggtatggcaggagggatggtgcacttgatttagaccagggagaaatctcagttcaaagaaatctttcacatccaccagggaaggggcctgtgactgtgaccttggccctgtacctggctttctatgctaagctgaaaaagaggtagagaggaagaaaaaggagcccaagcttgttcaggtggtaggtgccactggtaggagcacacccatgcatttgacacatatttcctaagggcctaataggttccaggacctgtgctgggccaggagactgaggaagaatgagaggcatcaccatcctttctgctacaccttcggcttctggtccatcccatccctggttctgtgcagtggggcagttctttcatgctgtgtggcctctggttatgtggctccctggcagggccaggcagagaagcatggcaagctccacccaccctagctatgccctggaagaagacacaggtagggacagtgaagcccgggcacctgggcagcttgtccagggagatgcaaccttggccccagacctcatttggagccagaaaggaaaaagaaaaatcaggaccaaagccagctgggaaaagatgcatcagaggccagaacttcagtcaagcctggaaacacaggcaatggtggctgcagagaccctctggagcaggtagcttcctcagcctccaagatgggagcaagccctgggaatatgcaggtgcccctgaaacctcgccacctttcccttcctcatctcctcaagcctgtccttcaaggcccaattcaaactggtccttagcagggtgactcctgcctttgaacttctaaagagcctgtggaagcaacagactcctacttttccaggtgaagaatcaggggatccagagaggcagagcaaccctcttaaggtcacacagctactaagagcaaagccagggccagacacaggtctcctgattcaggtctgctttgccacttcctgggctgtgtgaccacaggcaagtcccttaacctcgctaagtctcagttccttctcttggcacccacttcccagggctgatgtgagaaagaaatgacatgtcgaagcagatccagcactttctgggctcaacaaagtgaatcctgtttcttttactacaggacttttcagagccttaatgtgctctgcgactccccaaaaggcagaccaagggcacagacacttaaaataaaattttaattattattattttttgagacagggtttcactcttgttgcccaggatggcgtgcaatggtgtgatcctggctcactgcaacctccacctcccaggttcaaatgattctcctgcctcagcctcccgagtaactgagattacagatgcctgccaccatgcccagctagttttttgtatttttagtagagatggggtttcaccatgttggccaggttggttttgaactcctgacctcaggtgatccacccaccttggcctcccaaagtgcagggattacagccaccacgcccagccggcacagatatttttagaacacatgttgtcttccagggcaccatggaatggtccaaagggattaggggaccctgcctcttgcccactgactccttcactggctatgatatacctgtagcacatgtattgatgtctccacaacagccatgctgcacctcacccattctccaaacagaccctacattttctttaggtctttctacctttccgtttcaccctggagctccaggcctgcaccctgtgagttggttttcctgatgagatatgaggggtattggagacttctgggaaaggtatcctaggctctaggagagacacaggaagacctggtctggactatctcctggcactgtcatgtctggaagccatagtagaaacagctgcagcccctctgcagcctcaaaggaagtagcctgaccacgaagtgaggccccaagagactggaaagatacattctggatgataggtcaaccaagcctagacggccctaccttacaccgccttgtcatgcaagggaacagatttccttactacttaagcactgagtacagcctatctgattcaacaacgaacacattttaactccactaccatctgcagcgtcctacctaatttctcatgggattaggacatgtgtccctgccgaagttcctgtgtaccccaccccagcacctcccactctgtccttacttgtttaatggtctttcttatgatcatttgagggcaaggccgggtatccagctcaccctgtttccctggtgtctagcataggatctggtgctactaaatctcttaataaatatttgctgaatgaataaataatgaacacatgaatggaggctttgcctctttgcaatctgcagcccctgggctacccagcacagtgagtctctctgcgtgccagcccagagggccccaggaacaagggcacagtgttccagaaacctggccacctcaatgccagccactctgctgaccctgacagctgggaccagccccttggcaaatgctcgtaggtgacttatgacctaggtggggtgagatgagactttacaataccatgggccctggacaaaaccacagatcaaggtgaaaggccatatccagagatggctaatctctgtggggaacttaccaatcaggcttcctggattggagcagggggccaggcttctcgccagcctggaggaccccttgtctgccccttgcccaccgctggagctacagagggccatgctggcctggaatagcggccactgatccaggataacatctttggcctgggatctgggggtgttgcaatgtgtatgactaagcagtttgcaagtgcttcctgtccagccagccagacggctttgtagttgccctgcgccagttccccaagccctcagccagccaagcttttagcagtggacagccctagggaggggtaacagcacagggccctaactgaagaagcagctggcatttccgccactggggctcctaccacaggaacaaggctggctggtctcctccctctctgaacctcacggtccccattcacgtgatggtgaaagagcagcctgtacttgtaaagaagtcccctgatttctagattccatgcagaactttgggggactagaatacatcttattttgctgttctctacttggatgttgtactctttaccatgacatccaactctctgtccctctgatgggtcatcattccaacgctgggtgaactctcttatttttttttcttgagacaggttcttactgtgtcacccaggctggagtacagtggcacgatcacagctcattgcagccttgacctcctgggcttaagtgatcttactgcctcagcctccagagtagctggaactataggcgtgtgccagcacacccggctaatttttgtattttttgtatatatggggtttcgctatgttgcccaggctggtctcgaactcctggactcaagtgatccacctgccttggcctcccaaagtgctgggactaggcatgagccgctgcacccagccctgatcttttcaaaacataaaatatgctggctttgtcggttcatgggaccctttgctgtgctcactatggcctcgggaccactgtccctgttgctctgcttgggaagcttctccttccctcctttgcagaagtgacccctcctcaccctttagctctcggtcccatgtcatgttctcagaggagccttcttgactggggtgaagccctaccaaaggctcagaattctgtgcacctccagcttgtagtatttgttatacctgcaatttgatgttgcttgtttgatgagttgattaatgcaaactccacgtgggcaggggccgtgtctgtttcactccccactatatccccagaacctaattaatccagagcctagaatgctgtaagtattagacaaatatttgttgaataaatggataaatcatgaacggaattttcaatgccaaaaaagtaggaaggacataaactaaaaataaatagaaaggccttaaagtggaatatgttcaccttctgaaaagctcattcaaagtccttaattttctcacagcctggggaaaatcaggtcaaagagtggtttctgggaagcactgtccaccagtgatttgatggttaacacattaaaagatgtaagaagaagggaagagggggatagttttggcccttctggccttttgctatcaacaggggggattcactaacagcctccctgcacagagtcagaacctgaagcctgatcagtagagaacctgctcctaaccactgggggtgcacaggtctagggttgtgaagggatccctgtgctgatactccatggccaattctgcgaagatggagcccttggtttccctgtgtcctctctgcacttccagagttggggtatcggaaccccatggcccactgcactcacctcttgcccttgtgcacccggctcaggtctactgagtccctgctgaacacatcaaactcgtcattctggaagacgttgtggcgagacgtcagcaggggtgtagggtctggtttcatttctctgggtgggggacacagagatcaatttaagggggccctgccagctgatgcaatctgcaccccacttccccctgctgtattaaatccatcggatttttcagttcccttcaacaggcactcctaggacacaatctcaaaaccttgaagagggagataagctgctgcctgatctggcctctgcctgggtatgcagccacacctcaaacaaagctccccctcattctctgcatgccattcacacagggtttccttctgtttcttaaaagcgctatcccacatttaatgctcgtaatagtcgcataagatcagtagtcacagatcactcaacctcattgtgcctcagaggctgaggaacttgtccaaaggcacaaagctaatttctcaagttaacaagtgattggtaaacatcacttgctcatggaagaaacaccctttcgggcactggttcctgctgtcccatggggccttcagggcagcagtgggccaaataaatggtaggtgtgatgaaagtgagacgctgtggccatcctctctcacaaatctactgggaaggtcgtaatgacaggggcaggtcaggaatgtaggggatcagaagggctcaacaaccctgtgttacatccctgaagacacatccatggcgctctaatcagccttcccacaaagtgtggcagggatgtgtacactctctgccctgcctggggcaagtgaaaaactcctgcggggcctaaggtttttatgtttccccaaagagggctttagtttaaatggctgggaagagagaacaagctgagtcctgggccatgaatgagggaaggaagagaggaaggggccccaccccgaggcagcctgggcagcgggagcctcctcccacctgtctctcccacctgtctaggttgcggtccagctggctgagggtgggggccagccgctcctccaggatattgttgatcacctgctctgggtcgtagtggtagtactccaggcaggccaggatgaagccctcaccaaggtctggcagcaggtccttcacttgggagatgagagagtccagttccaccccacacatggcagggcccacagccgcggctgctcccatgcactgtagtgagagccagagccaagaaggggaaggctaagtgggccggtgatagggccacaggccccagacagcactggactaggcatcagggatctggttcaagtcctgggattacccctcctgcctgtgggaactttgtcaagtgactcaagtctctctgagcctccatttccttctctgtgaaaaagggggctcgtgattgttatgattattgcatgcctgtatcaaaatatctcatgtaacctataaatatatacacctactacatatccaggaaaataaacaaaaaaaaaaaataaaaaaaatttaaggccgggtacagtggctcatacctataatcccagcactttgggaggctgaggcaagagaattacttgagctcaggagttagaccagcctgagcaacacagcaagaccccatctgttcaaaaaatttaaaaaagtagccaggtggccgggtgtggtggctcatgcctgtaatcctagcactttgggaggccgagacgggtggactgcctgagctcaggagtttgagaccagcctgggcaacacagtgaaaccctgtctctactaaaaaaattagccaggcgtggtggcatgcgcctgtggtcccagctacttaggaggctgaggtgggaggattacttgatcccagaaggtcgaggctgcagtgagcttgatcaagccactgcactccagcctgggtgacagagcaagaccctgtctcaaaaaataaaaaataaaataaaataaattaggccaggcatggtgctcatgcctataatcccagcactttgggaggctgaggcaggtggatcatctgaggtcaggagtttgagaccagcctgaccaacatggtgaaaccccatctctgctaaaaaaaatacaaaaaattagctgggtgtggtggtgggtgtctgcaatcccagttactcaggaggctgacacaggagaatcgcttgatcccaggaggcagaggttgcagtaagcagagatcgcactattgcactccagcctgggcaataagagtaaaactccatctccaaaaaaaaaacaaaaaacaaacaaacaaaaacaaataaataattatattaaattaaattaaattaaaattttgaagggactgtatgacttaccagctgggctactggctgtgtgactttgggcaggatgcttcccctctctgaacctcagtttcctccttataaaatgggcctataccacccacctcatggggttgtttcaaatagttcaaagatggcacaaaacccagtgagcacagtacttggcacagaccaggccctccataaacagccctggtttctaccaattcttcctactaatccaaggtccttttccaacaagtttactgacggtggaggcgaacatcaaccaccagagctggactgtgtggagatgctcccctttaattacaatctcttttttaagtaaggggcatgcattttatatattgctcaatgtgacttaattgtgttagccttttaatttaaggaaatttacagatcacaacaataaaacctccatgactctgctaagaagcgaaatggggaagaaggtgggaaaaggtgaaggaggccattgttctccaaggccctgcaggaatcacagggtctgggctgggaggaaggactgtggcatttgttaatggagcactgaaggccagtcaggctcagggtattccatgtgatagctctgggaatcccaacacctcatggaggtgggcactacatctgtccccaccttatagatgaggaaccaaggttcaacgtgagtgacgtgcctaaggccatacagctgccaagtggcagaaccaggtcacacccctgagctgcctcgcctgagtctgtgtggtcttcatctctcttatcatgctgcctcccaacatgcaggggagagtcctggccttggtggccaatcaagacagccacagattcggccagtcctggaaaagcctggagagaaggcaccagatccgaggtttctacacttgttcagtggaatcctggagccccacggaggggcttccaagaaggccaaaccatgggacttggcactgttcccagttgcaaccaaaggagctccacttttatctatttagaggagagctccgggaagggctcatggaaacgttcatggaaagtttcgtctcttcattttatagaggggaagctaaggcttcgatagttgaagcaacttgctctctcctcacacacagtccagcatgcccccagcttgggaccctctaaaggcagcacagagctgaccagttgcttgaggctgtctattccccaaaaaaactttttccctgagtataaaagcaaagaagggaggtttcctgctgccccagcctctcagatagggccaaggagggacaagcgaagagggaaaagcgccactcagacacatacctcctcttcctccgagttctccggatgtgatgatgcttgactgactgcctctgctgtcaccgtgaccccgttaggctccccattaggctcctcaatcaccgatgggtctttagcatctgtggctttccgtctgtccaccccttcccatgcactctcgactgcctggaggatgtaggcagtccgcgtctcgtccctgtgaggacttgttaaggggtctgtcttaagctcctagctctgaagcagcataatttctcagtccctccccagcatctgaccacatggttcctgccaggggctttctgggctatatctaagtggtatagcccacgggcacctgggctgcatggaaaaatgggccagactacagccactctggcctcacaacctagtgcctttcactcagcagaaagcagctctgagtaaagacagggccagggctgccatcagagtgtcctggggcacaggtatggacgagccagcagctcctcttttgtactgactgccaggaggagggcgtggtagggccactgccactgggcttcctgtccaaccagctgagggcattctgcaaaggctgtgggccatcaggtttccctgaagcaggactgagcaatctactgcaaccaccaaaaatgacccataagctggctgctcctccctgtccttcctccttgttaacaaccctgggcactgtcaagccagaaatctgagagtccccttagactccctcactgcttcttgtccaaaccctcatcatccatgcttggatgccagcaacagcctcctcactggcccgagcctcacggtggtcctgggccagtccattctcttccctgggccagacagagcttttccaaagtatagaactgcccatgtcacttcctgcttcacaaccttccgcgctccccagcgcttgcaggacagagcccaaacttcttagtgatggtcaccccagggctgtgcacgttgctggccttcacctcacctgcaacaccccaattcctcctcttgggagacccctccttaaggactgccccctgtactctatacacgtctgtggctctaaggagcctgttttctctgtcctctgtccactgcgaacattcttgtccttgtccttgctcctggcttggtgctctcccattctttctgctgttcttctgcttggacatcatttccatctgagacccccacccagagctctgctgggtgaggcgccacctctggtttcctgccctctgaaatcttcccacgtgacactctatctaactgcctgtttacttgtccacctcccctcctgctgtgaggaggggctgagtccatcttggtcacataggcccagatactcaggaaacacagacggaaaatagcactgcatctcccctgccccaagcatcagagcagccatctcctctagaaaaggcaaggctgggaccttggcaggccacctcggacagctggctgacccatgcgttctggggctaaacctctttccactcctctgggttccagcagcctgtctcacctctgacctagtcaagctgggccctgtcgtagtgggctatggtagaaggatacaagactgatgaggcctgctgcagcaagctgatgtcttcggccacggggaagagtgcatcatagtcccggaggaacctgcaggcagatgagagcagatgggatggacagagctggggccacaggaatgctgtgctgctgcaggccactccctgtgtttgcagcccgaccttattagagctgtggtgggcctatagcgggggtctatcatgtaaggcctcttggggacctgtgggagggtcatgggcccaggccagctcagccacactcacctcttctcctgcagcaaggagctgaagatctgaaggaactcttcgatgaagccctgaatgttgtcacagctagaacaagacaccagggaagatgagctcatgcaatgcaagatgagctgcagctcctttacacacccgctgcccctctttaaggctggggcccagtggaggaatgaggcatttttcttggtttctcatctctgttcagccaaccccagtgcagtggaggaagccaagatgaaataatggaaacgctcctgaagggcttggggaggagactcttccaccaggaggcaattcgtgagggcttacctgctttctaggatgggaaggaggcagatctggttcaggatgatgtggaaaatctccattagcttcttcctggaatgggagagcctctgccacaggtcaccaagaagcctaggccagagagaaaaaagacacaggtttaggagacaaaaaggccctgaggggccaggtgcagtggtttacacctgaaaccctagcatcttgggaatctgaggtgggaggatcacttgagccccaggagtttgagaccagcctgagcaactaagtgaaatcctgtctctacaaaaaatacaaaaaattagtcaagtgtggtgatgcaggcctgtagttccagctcctggggaggctaaggcagggggatcgcattcgcctgggaggtcaaggctgcagtgagccatgatggtgccattccagcctgggtgacagagcaagaccctgtctcaaaaaaaaaaaaaaaaaaaaaaaaagggaaaagaaaaagaaaaagaaaaaaaggcacaaagggagcttctccccagcagttgcaggtgcctccctggagcagagaaggcctcacaattcactgctgagagcagctggcaaaagccataggcccagagaagatagctgcttccagggctgcttctcagttcaaacggtgggtcaggaaccagcaggctgagtaccaagagcatggagtaacagctgagggaagggcttcaatgcagggcccagccatcatggtattttgggggattgggttaatagacataattgccttagtacaagcaggactttgggtcaagtctccttcacggtgtttagtaacacttaactctagttgttgcagtctttcttattaggtcttcatacaagtctacagagaacatatattttttttaatatgctaagagtttaaaaaaaaatgcagttcaagaccagcctggccaacacgtcaaaaccccatctctacaaaaaatacaaaaattagccaggtgtggtggcacacgcctataatcccagctactcgggagactgaagtgggaggattgattgatgtcaggaggtcaaggctgcagtgagctgtgactgcaccactacactccagcctgggtgacagagcaagaccctgtctcaaacaacaacaacaacaacaaaaaaaaaaacaaatgcagaggtcaggaagtggctagatagggatgcagaagctcaaagctgcacagtccctggtcccacccacttgtcttagagatagggatgctaatgcccagggaaggcagggccctgctcgggcctctctgtcccacaacaacattcttaattttgtccccgcctcacttgctatcttcaagcctcctcttcttaattgcagactccatttcgggaattgctgcttcgtagaaggaagctagtctgtgcaggcacacacagggaaaatgttggattagttcataaataccacacttcataagaacatcaaagcaaaccccagggagtgggaaggcccatttctttttccacacaattttctccagggaccccttggttcttccctgagctcaccccagactgacccactagggctggtcccaggaacagctcataagaagtgacctatagccatgtccctcattcagatgggcaactgaggcccagataggctcatactaacagaggaatcagaaggccactcggaacccactgaagtttgagaagcagatccaagattacttgcttgtaattttcttgctcaaaaactgtcagttagccaggcacagtggctcatgcctgtaatcccagcactttgtggggctgaggcaggaagattgcttgagccaggagctcaagatcagcctgggaaacaggctggtgaaactccatctctacaaaaaatacaaaaattagccaggcatggtggtccacacctgtagccccagctacttgggaggctgaggcagtaggccaggaggtcaaggctatagtgagccatgatcacaccactacattccagcctgagtgacagtgagaccctatctcaaaaaaaaaaaaaaaaaaaattgttctggctgggtgcggtggctcacgcctgtaatcctagcactctgggagaccgagatgggtggattacttagaggtcaggagtttgagaccagcctggccaacatggtgaagccccgtctctactaaaaatacaaaaattagccagaagtggtggtgcacgcctgtaatctcagctactcaggaggctgaggcaggagaattgcttgaacctgggaggtggaggttgcagtgagccaagatcgccccccactgaactccagcctgggcaacagagtgagactctgtctcaaaaaaaaaaaaaaaaaaaatttaacatgaaaatctcaacacaatatttgtatttggtcaaaataggctaaatgttctcatgattttttcccaatcccattggaaatgagaaaaaaatatattaaaataaaaaataataattaaaaaatttaagaaaaaagtaaatgtatcatattttctacattggcttatgagttaagccagttagcactgtttctataactttttagttaactaattaattttttttttgagacgaagtctagttatattgcccaggctagttttgacctcctgggctcaagcgatcttcctgcctcagcctcccaagacactgagattacaggtacctggcttaaaacttttataaaattaaggctgtgcatggtggcttatgcctgtaatcccagcactgtgggaggctgaggtgggcagatcacttgaggtcaggagtttgagaccagcctggccaacatgggaaactctgtctccactaaaaatacgaaaattagctaggcatgggggcgggcacctgtaatcccagctactcgggaggctgaggagggagaatcgcttgaatctgggaggtggaggttgcagtgagctgaaattgtgccactgtaccctagcctgggtgacagagtaagactgtctcaaaaaaaaatttaaaaattgtaaaattaaaaataatttatacgaaattattttcaaataaatataattatactaattaaaaaaaaacaaaagaaaaacagctgctagcagctccctacctcttatgacagcaaaccataattattctctctggtacatccatatctgtcacggtatacagccaatcttgcttctcacctaggtgatttcataccaccctttcccaactcaaattcaaactctccatcccagccgcacaacccctcaacattcttccagagatcagcactcccacagccctctggcttcctctcaggctaatgctggccactgctcttctcttctttctcctcattctcctcctcctccatgcagcattccaggcccatctcctcccatgcacttcctgatcatgctcactcatgggaattcttcctttccagaactagatgcactgcatgtggaatatattgccctgttgccctggcaagtgaaactgcagctgcctcttttctgtggtataattcttcccccaaacatcttaagcttcccaaagccggaactgcagcttaagtgtctaggttggtgctgaatttggagcaagtcctctgtaaacacatgcctgtcagttggctggtttctggcaatgtctatcctactacaatgctatatgtaacaaagggtaactaggccaaaagaggcaggccctactaggcccacaggatagtccagaaaaatgacagagagggcagtttggcctaaacaggttcagctgttgccaggatatgttgctggtgggagagtaaattggaacaacccctatggagggcgatttggcaagatctatggaaattaaaaatgtacataccatctgtccttgctagtctacttctaggaattattcctcagatatactcacagaggtaccaaataatgtgtgtgcaaagttattctttgtaatttttttttttttttgagacagtctcgctctgttgcccaggctggagggcagtggtgcaatccctgctcactgcaacctccgcctcccggtttcaagcaattctcccacctcagcctcccgaatagctggaattacaggtgcgtgccaccacatccagctaatttttgtatttttagtagaggtggggtttcaccatgttggccaggctggtctcgaactcctgaccccaagtggtctgcctgccttggcctcccaaagtgctggaattacagccatgagccactgcgcctggcctctgtagtatttttttgtatagcaaacaactgaaaaaaacctaaaggaccatctatgggatctggtattccatacagtggaattctacccggccataccaaagacattagagaaagggtgcttaatgcactgatgtggcaccactgttaagtaaaaaagtaaaatgcaaacagtaaatactcataatatgccagccttaaattttttaaaaggagggagacatataatgtgcacagttgctcatatgtgcatatattcttgcatatctctggaaaattccaccaaaaaaacctaatgatggctgtatgtgaataatagaactgggaaagtagaaagggggactttccagtgtgtattttatactttttgagttttgaaccatgtgaatgtgttatttattcataaaagtatatctactcagctatacttgaatagatgggaaaggaaggaggaaaaaggttattttgagagggattatcaacaaagctgattgggcaactgtaaccactttcagagaggcctggagaactgaggtggctgtatttgctcagcagggcgttcctggcctccagcacagttggaggctgggtcagccccagggtgttcgtgggtcaaaggcagtgttgcctttagtcaaaagtgtttccctttcttcctcctcaccctgagatgggtatagcttctcccctgcctctgctgtcccttgcagtaaagtcagctcttccaaaacttatcccttccccatctccaaagagcctttcaaaagcaatctgtgccacatttggggaaacactttaacaaaatgggaaaatgcctatgataagcgaaaatatgcaaggtacgaaattctaagaatagtatgatttcttatggtgattttaatttcctacttttctggattttccaaatgttctacaagcacatgctgcttttatcatgagaaaagatacctttttaaaaaagtggacagctacatacccctctcttctggggaaaatgccaggcagcaggttatcctaacattctctgggaggctcaataaccctaatgtctgatttttataagctgaggcgaccagggaggggtcacagcaccagctgccatctctggcacatgtaaggactaaataaatgttttgttaaatgggtgagtaaatgacagaatggacaggcagctgaatggatggagttgggcagctcccagaagctgctacaaatggtggggagaaacgtcttgctagagtgacaatcagaggccactaggaagaggcctgtgcccacaactgccaggcaatacgcaggttgccaaccctttcaccctggcctggaatgcccacacccacccctttcttactgcacaagcaacagatactcttggtgctaagagggcaaagtgggtctgcctccctggctcatattctctttcatatctgtctccctcccaccaggatctttctaacagctcctttggataaaagcctccaggggctccccactgcctacagcataaaggccctgccagcacatcccaggctccccacgatctgacttctactgacttacccaaagtgggctcttgttactggcttgttttcctgctgttctgtgtgtccccaccctctgcctcatgtcacacttcactccccagctctctctctgggcctctgcatgcttcacttcacctgcctaggatgcccttcctgctatgggaacttttctttgtctggaagatacctgttccttcaagacatccttcaagggtgatctcacagctccatgttggagcactcctgttgtttcctagtgtgtgttccccccaggctactctattgaactgaaactattcttggttgtgcgttttttttttttttagatggagtcttgctctgtcacccagggtggagtgcagtggcgcgatctcagctcactgcaacctccgccacctgggttcaagtgattctcctgtttcagcctcctcagtagctgggaatacaggtgcatgctgccatgcccagtaatttttgtatttttagtagagatggggtgtcaccatattggtcaggctggtcttgaactcctgacctcaggtgatccacccgcctcggcctcccaaagtgctaggatgacaggcatgagccaacgcgcccagcccattgtatgtgtgtgtgtattttttttccctgccctatcctggtcttggccaaaaacaggagtgcttctaaaatgcaggcgccacacaagcaggaggcttatctgtcgttttcactgctgcatccccaggctggaagagggactggtacattctaagcacccagtaaatatttgttaaatgagtaaatatttgttaaattagtacataagccagtatctctatttcaacagccagaactaccgccttacctgtaacaaaagtcgtgcttctggaaggtctggcaagccaaagggaagatatccagaaaggcccaaagtgtggtgcaggtatcacaaaggtagagaacaatgtcctttaattcctgttgccaaaagaatacactgcattattctcctctgtccacacatacagatctgcagagcacctgagacaacattaaaacagtcagggtcccaaacaggcaggatgttacacaggaggaaaagaacactggaggtcccaggcaaagtctggctagtccatcttcaggagcacgatctgggtgagtcacctaacctctctaagcctcaggtcattactccaatggccttacacccaatcaccgctagggttacttccagttctaagataatacagttccctcttctaagctaaaggaaaaccaactcttgaatctgaagacatcatgcaaagaaggaacatccgaggcaggacaagaatattaagtccataggtttttcacatcttgaagagggtatacaaaacactttcttctaagtttcttacacactttcctggttctcatgacaactctgaaaagtaggctgggaagctattgaggatctttattttacagaaaaggaaaccgaggttccgagaggtaaaatgatttgctcccacagcacctgccacgtgcccttctgaaatgagatcaccatctccaggaggacagctcatagctgccttgttcctgttctatctccagggctagggcagcacctgacacatgttgaggcttcctgaatgtttgccttctatctgtcacccttgtcaactctaaattccatgagcgcaggggccagtctgcttttgtttactgctttgcctccaggcatagcacagggtctggcacatgctcaggactcctcaatataagtccactgaataaatggctcaatgaataacgcacaagtgaacatgtcaaactgaaataaatgaggactctgaatccttattccccagttctttccactactctataaatgaagctcccagagagaaatccaagccagctgaaaatgctctaaacctgtgtgatgggacataatagttgctcactgtgctggaggaaggggccctgggcagggaagaggccactgggtcctctactggggcaatcttcccagcctctgggtagctaggccctggttggagggacccggcaggaaagagactgggccgaagggcaaccttaccaggagaggcatgtcactgggggtcaatcggcccctctcctcaagcttctggggtgtggtattggccccgtccccttgcaaaccacagtgctggaggatattgctgaagacctgtgaaagacaagaacgggctctctcacatcatactgaaccagggctaggacccctggcagcagccagggtcaggtgatctgaaaactgccttggagtttctagaatatttacccatgtttccaggatataagctgagacaattaccttctccaagagtgaggtcagagtaaaaactatgtaagatggggatgatgggagcatccttcttaaaggagggcgaagaggattaaaaagacaacctggggccaggtgtggtggctcactcctgtatccccaaactttgggaggccaaggataggggatcatttgaggccggaagttcaagaccagcctgggcaacatggtgagacccccatctccacaaaattttttttaaattagctgggcaagatggtgtgtacctgtaatcccagctacttgagaggctgaggtgggaggatcaactgagcccaggagttcaaggctgcagtgagctatgattgtgccactgcactctagcctcggtgacagagcaggaccctgtcttaaaaaaaaaagaaaaaagaaaatcctcccagaatcctgtagatattatctgaccgcataggccaggcaagtataatgaacatttaagatatactttagcaatgtataacaaatctttagaacccctgtagatggctatttatggaaactacattgaaaataagacaaatcaacagtgagaggaaaacggtccatcgtaggcactgaactgactgtgccattttaagaaggctagcatgtaaggattccaaaacttactgtgaacagtagatatctcttggtggtgggattatgagggaatgataatgttcctctttcattttttattttccgaattttctacaatgaacattatttcatgaaataattttgtaaaactttaaagctactttttgagaaacactggtctcttagagggatatccttagaggcatatggctgttggcaagcaacaaaaaatgcaagccaaactctgtctgtatgagcgccagccagccagcccttaggcttaagtcttgttcaaaagggaaaacggcaaatttaaagaggtgtagtcaggggtaagacaaagagactgtctggggagatgcgagagtcagggaataaacatttcctcagctcctccaggaaagtcaggcaacaccattgagttggggaggtggcctatcctccaagctcaacctcccctgcgcagggccaagagctggtacctgaaggatggtaggcagggtttcatccaggtcactgtagtaacttggctgctgtgtaaagatgtttcctaaaaagagaagagaaaggttggaattgagaaaaggtgggggctcggggcagtgaagaggacacattacaaatggttgccagcaggtctgtgacctttctcccttttcctaatcctatctgcagctaggacctaggacgagtcctggccccaggccctgctggcactgagctttggcccagcctagaagcttccccagggtgggggagggaccttgctcagtatgatttaaccttttaagtacctctgcctagtgaattacataaaagacccgccctggtcaaaccagctcacactgatgtccccagggagtgatcacacttgggtaccctgcctcctatgacagctttggctctgcaagttggagttagtcatccaggaaaattagcagataggatctctttgctcaagaaacatggatgcaataatccaggactctccaataatatgaggagattccagggagatatttctccggaaatttcatacctttcacttttagatatgctaaccatactaatccatcctactccaaggtgagaggcctgagaaggacttggagatagatttaccacacacttgcaattgttcctataagatgaagcttgtctccaagtgtttactattctccaagtgctgccgctgtgagtgcgtaggttcgagcatatggtaactggaacagaaaccaagtgttccagctgcccaaatggcgagagagggagagagggagagagggagagagggagggagggagggagggaagatcacagctagcttggggacgtgacaatgtgaaatgccaatgcccttaagcagccagggttcttggccccctgtaatcccagcatctaaggctggctgatggtcaggatgctctgaattctaggtgttctctgcctttgggcaggtctgtccttggtttccttatcgatgaccatgcagcccttgctggaccctggaggatttgaaaaatgaatgagttcaaaaaccagatggggctgggtgagtaagcaagtcactaggtggctggactttctgtaagcactttcctggatgccactgcatttcttgattccagaaagctgagttttaccagcccgcacttgctcagcacctcccacctccagatgggtgctgatcccataacctgtgaaggtgtgcccagaccatctgcacccacttcctactcctgataggcaaggaaagacagagctatctccccaccaaactctgttcttcctaaaaaaaaccctcaagattaagtccaaactcctgaccatggcacaaaaggccctgtgagatctggcctctgctggtatcccaggccaccctttcccccttccctacactacactcctccctcacaccattctcaacctcagaaaaccatccctgtccccgccttctgtttggagtgccttcctagagctaactccaccataaggcaggtgtcacctcctccacgcagtgcctcctgacccaggcattaggagaggtctcctcttacaacccccagggccataccatgttctccaaagcatcccaaccacttcgcactggggaggcaccctctcatgatccttccagtgctgcagcctgagtaaagcgaggttttacatgcatcagtatagatcaaatttcatactctattcttggggtcttctaagtccctttcctcaccttcatctgattctaatgacagtgacgatgtaacttttgatctcctaaagaaataataaaaatgtaaggaatagcaatggcatcctttgaaatgtcccttctcagatgaaagcagttcagaaacccagggtgaatggagatactgccaagtagatcactgcagtccacaattgggccaaggcccaagtcattcctggtttgcaaagcagtgtcaagagtctaactgaaatggcttgctttcaaaattatacttgttgatgcacaataccagccttgaaagttaaaaaaaaaaaattaggtgggggattgggataggtactcaggaggccaaggtgggaggattgcttggaaaaaaaaaaaaaaaagcaaggtaaggaactgggcttctactcacagaacactcaaccagtcccctttctcccaccttctttcacttgtcaatcctcttacaagtgatcactttgactgagtttccgcggtatagaaatcggcggctgccccttcttgtgccttctgctcaaaggttaaaaagagagctgctgtgtatgtgtgtgtgagagagacagacagaaaaagagagctgctgtgtatgtgtgtgtgagagagacagacagaaactgcaggtcccttctctgcatcactccctgcctacacacacacacacacacacacacacacacacacacacacacacacacacacacacacacacacacacacacacagtgaaggggctcctgaggcctggtcctgacttcttttgtgctgactcccctctaggagccaaagaaggggctcttcttaataagccagtttagggttctcaacctcaaggtctgagaactcttaaaaacacctcagaatctatgagggaggacatttttctggacagaagttttcatctgattctcaaagcagtcagtgatctggacgattaggagcccaggcagtaagtgagtaggctttctcactctcccatcaccacgcagtcccctctggatacctgcagccatcttacacccaataggtcccatgttgaacctcacctctacccaaagcttcctctcccacctcccaaagggcctttttcctgcaaccaacacctgttccagctgacctcaccaagccctgcttaaatctgcttcctggatttccttttcttccccagcagcccagccaggctctcaccttcaaacccacacagatgtgcccacctcctacaaggcctcctgtctccaccctccccacctgcatgtggccagatgaatcttgttaccagatggctccttgccttgctccaagctcctggaggctccgcggtctcatcacagtaagagctcatgcttaccaatggctgagacatgccaggcacggtcctgagtactctactcatgctatctcaacaacccaatttgtttttttttgaggcagagtttcgctcttgttgcccaggctggagtgcaatggcacaatctcggctcgctgcaacctccgcctcccaggttcaagcgattctcctgcctcagcctcccaactagttgggattacaggtgcctgccaccatgcccggcaaattttttgtatttttagtagagatggggtttcgccatattggccaggctggtctcaaactcctgacctcaggtgatccacccacctcagcctcccaaaatgctggaattacaggcgtgagccaccacacccagcctcaacaacccaatgtaatccctgcacccatcctatgggtaggtatattattagtcttcccattctgcagatgaaaaaaactggggcttagagtagttaattgacttggttaaggggacacagccaggaatagagctgtggtgtgaattaggcagttcgatttcaaagcctgtcttcttagccaccaagcaataccactccccaagtgctaaagcctggcatgaagcccttcccaatctggctccaaggctccaaatccccctcccccgtctcctgctgctgccctcctggaatgctccactctctaagcaaactggcctaagaattgtttctctaactgtaccttctgatgctcacttgctccatcctctcaatatgtggtaaaattactaggagtctttcttagtcagggtctaagagacaggatctcactttgtcacccaggctggagtgtagtggtgtgatcatagttcactacagcctcaacatcctaggttcaaggcatcctccagaatcagcctccagagtagctgagactacaggggcatgccaccacgcctaatttttaattttttgtagagacagggtgtggctgtgtttcccaggctggaaaaaaaaaagattaactgatgatcaggaaataattagatatgaatgagaaaccagagattatttcagtgaaaatgttggatgcaaaatttctttttttcttttttttctgagacggagtctcgcactgtcacccaggctggagtgcagtggcaccatcttggctcactgcaacctctgcctcctgggttaacacgattctcctccctcagcctcccgggtagctgggattacaggtgcacaccaccacacctggctaattttttgtatttttagtagagacggggtttcactatgtcggccagattggtcacgaactcctgacctcgtgatttgcctgcctcggcctcccaaagtgctggggttacaggcgtgagccacctcgcctggctgcaaaatttcatatacattatgatcaagtatggtttaagaaaaatacagagaaaagactagaaggaaaaaacaaccaaatggttgtttcttgtagaaatctggtaactgctttcctgcttcactatactttatatcctttcaaaatttcttaaattaacacatattatctttaccattaagaaaaaaaaaggctgggcgcagtggctcaccgcctgtaatcccaacactttgggaggccgaggcgggtggatcacctgaggtcgggagttcgagaccagcctgatcaacgtggagaaaccccatctctactaaaaatacctgtaatcccagctacttcggaggctgaagcaggagaatcacttgaacctgggaggcggaggttgcggtgggccgagattgcaccattgcactctagcctgggcaacaagagcgaaactccatctcaatacacaaaaaaaaaaaaaaaaaaaggaaagaataaaggaaagtgaccattataagggataactcagttttgtaactaggtatttcgaagactgtgtcctacagtctccaggtgaggagagctggcaagggcgtccagggtgagcacccctctgtgccaggcccagctccatgagctacaattcaaagaggaattcactggggcgctccctctgtaacgtcccacagtgcttctgtttctctttttttcttatttttttgtgtgtgtgtgcgtataaagaggaacctctaaaaaaaactgcttgtttttgatcaaaccttctcccctctgcctgctaatgggatccaacggctaatgtccgttccttttgcaacccagaagagccctctctgaactctgtccctacctgctctcagcaacaatgcaaatcatgacatttttgacacagtgccatcatccctgaagcagggagttgcagagcaagagcttgagagtcaggtctacgtttacacacgtcccagctgggccacttattagtcatatcctctcaggcaagtcccctacattttaacctcagtttccttatctgtaagtggggatgatgacagcacttatctcacagggctgctgtgaggatccaattgacataacatatgtggagtgcttggcagaatgccaggtccccggaacactctccaataaaggttagcttagttatcactgctgttcttacattcgtcgccaaaggaaacttccccattcctatgtctgatgcatggccaattgcataatactaatacactcccaaggcagaatggtggcttacactgtaatctcagctgttcaggaagctaaagcaggaggatgacttgaggccaggagttcaagaccagctggaacaacatagtgagaccccatctactaaaaaaaatttttttttaattcgccaggcatggtggtgtgcacctgtagtcccaggtacctgggaggctgagttggggggatagctttactccaggaatgtgaagctgcagtgaaatatgattgcgccactgcactcttgcctgagtgacagagcaaggctttgtcttttttctttttttttgagatggagtcttgctccatctcaaacactgcaacttctgcctcccaggttcaagtgattctcctgaaaaaaaacaaaaacaaaaaatttccagatccctggggaactgtctggtacacagttttatttccacctccctaggtagtgtcactacctagtcattttgaggtgacactcatatatctgttaagcaatttcccaagactccctgcccctatcgccctgagtccctgggcactgtcaaagcgctggcctttgcaacctttagtttggcatgtgggggccatcttggtgcatcctcccagtcctgcatcctacacacctatcatcttctggagcagtggtgagttgccttttccaaagagcacgcagaggtccaggatctttggaatgtcaaagaggaagttattgtagaggatttctccaaacgcagaaggggaaatgaagtgatcctaaggaaaaatgcagagagaaaggatagagattttctgaacactcctacattataaatagcaaactcatgagaaacgatctttggttccatcaaatggggactggttaatgatgccttatgcatagacctggagcaatggccattctccccccgccctttttttttttttttaaatgttaatctatctatgtttttgtgtctctagactaaacatccccatgacttttacaactggctgtattatcatgtcttttttttttttttttttttttgatacagggtctggctctgttgcccaggctgatgtgcagtggtgtaatctctgctcactgcaacctctacctcgccagctcaagccattctcccacttcagtctcttgagtagccggactacaggcacgtgccacaacgcctggctaatttttgtattttttgtagagatagggtttccctatattgcccaagctggtctcgaactcctgatctcaagcaatgagcttgcctcggcctcccaaagtgctgggattacaggtgtaagccacagtgcccagcctcccctttaaaaaaaatttttttttaaattttattttttgagacagtcttgctctgttgcccaggctggagtgcagtggtgctatctcggctcactgcaacctccgcctcccaggttcaagcaattctcctgcctcagcctcccaagtagctgggattacaggagctcgccaccacacccagctaatttttgtatttttagtagagacagggttttgccatgttggccacgctggtctcgaactcctgacctcaaatgattcatctgcctcggcctcccaaagtgctgggattacaggcatgagctaccataccaggcccattctcccttttaatgtaaaaacaaagcatgctataaaacaatcagttgggaatttatcctgaaatatttgcagataaattagtatgatatctaggattgctttaaaatacttcaggaaaaaagagaactaagggagagagataaaatgagattggcggaatgttgataattgttgaagggtacatgggattcactgtactttgtatatgaaaattttgtatttgtggccaggcgcgatggctcgcgccggtaatctcagcactttgggaggccgaggcagacggatcacgtgaggtcaggagttcgggatcagcctggccaacatggtgaaaccccatttctactaaaaatacaaaaattagctgggagtggtggcacatgcctgtaatcccagctacttgggaggctgaggtaggagaatgcttgaatccaggaggcggaggttgcagtgagcagagatcatgccattgcactccagcctgggcaacaagagtgaaactccatctcaaaaaaaaaaaaaaagaaaagaaaattttgtatttatgtatatttggaaatttccattctaggtcaggtgtggtggctagtgcctataatcccagctacttgggaggctgaagagggaggactgcttgaggccaggaattcaaaaccaaccagggcaaaatagcaagatgccctctctccaaaaacattttttaaattagccgggtgtggtggtgtctgcagtcccagctactttggaggctgaggctggaggattccttgagctcaggagtttgaggctgcaggaagctatgattgcgccactgcactccagcttgggtgacagagattctctaaaaacaaagaaaaaggaagagaaaatgtccatattataacactttttaaaaagatcctattttttaaatacacacacacacacacacacacacacacacacacacacactcaaagggaacaaattccctgaagaaatatgcatgtaatagggttgggtgtagtggctcatgcctgtaattccagcactttgggagcctgaggtgggaatataacttgagttcaggagttcaagactagcctgagaaacatagcgagacctcgtctctactaaaaatcaaataaattagccaggcatgatggtgcatgcctgtatctcagctatttgggaggctgagatgggaggatcacttgagcctgggagactgaagctgcaatgagctataatcacgccactgcactccagcctgggcaacagagtgacaccctgtctcaaaaaaagcaaagaaagaaaaatgcacctaacagtggttattttgcaggggagagattttgtcggtgacattcgtatttccgcaatgtttgggttgtttagagatagcagtattatttttaaagtcaggaaaaaaaaaacagtaaagatttttaaaaagagtacacaagttcctttaagaagtcagaatcaatgttttttctctctgacgcacaagtcaaggcagtcacgcgtcagctggcaaagggccctcggctctctttgatggaaatactgggtgtaacacagaccaacccagtgaattagaggataagggacgtggcacagatttcttccccaacagtgggaataaagatggaagagagacaaagaggaaactcaatgcttccagagccttccttcccaggggtggagagcccggcacagaggtgtcgagtatcgggtgatgacctgtcatgggatcagtggcttactttggattccttgtgagtggacatgcggaggaaggtgagaaaaacacttcgatggaggcgcttctgcatgtcaacaacctcaggggctgaggccaccccctcgtcgaatttgcgggggacatagcgcaggtaggagtccaggcacttctgtagagtctcgtcaaagatcacctaaaccaggagacagaggagagcgaggatttatcccttaggccccaggggcttgtgggtggactgtgcagggactcaatgcccatcagccctgccctattccaaacactccgaccccaagggaccaaggaggtatgaatgagccaagggctaaacacaagattctaaaattgacactttgaaaggtgtgtaaacattaagattgtgatacaagacagagcaatccgaaccacaatttgctgttaaggatccagtgaaagaagtagacaaaaaagcacctcctaggggaagaaaaacaacaacagcaaccaaccaatggcatgtcatgtgctttgtcttagcgttaattttgatagaatgttacctggcaccagaatttatcgtgaggcaaggccaggagccagtcgaggtcattggctacgaaggtggcgcgttccaggtactcctccactagggcgggaatgttgtctttagggggcggtttgtataacacaaaataccggtctgccttctgctcggggtgctacggatccaaaaaccacgtgttaacgtggcagaggttagtcagcgagggcccatttgccaacccacagcaatgacaacacttggctgttccaaccggtgaccctccaaggagcttttaagcataaagaaccaagtgtatctaacaaagagggcatggttgcattcagcgaacactaggcggtaattaaaatccatgttttcggagtggatttaatgacacggggaaaggttaagggaagagaaagcaggatacaaaactctctgtttaatataatcagttttcattttccttttttagtaaaaggcaaaagatttatttgttatgaagaaaaaccagagcatagttttcggtctttaaaaagtgtaagtatattcacacactggtattgatttttaaaaaagaagctggggagatgacgccccaaagctaatagtggttatctctgatgggggcggggggtggtgaattgtggcttgaatagactttcccattaaaaaaaaaaaaagaacatatattcatatattacttttgttttgttttgttttgtttttgagacaggtctcactcccgttgcccaggctgaagtggagtggcataatcttggctcacggcagcctctacctcctgggcttaggtgatcccccacctcagcctcccaagtagctgggactacaggtgcacaccaccatgcctggctaatttttttttagtagagatggggttttgccatgttgcccaggtggtctcaaactcctgggctcaagccatccgcctgccttggcctcccaaagtgctaggattacaggtttgagccacctctcctggccacatatattactttttaaattaatttttaattatataatttgacacaagcatcttttctttcaaaaacttacaaggtacagagaaggtgagctgcctgggactacactcccaggccccatgttccctgcagaggtaaccactcaccatctgatgggtgtccttgcagacctcttccaggcatttacattaaattatacccataaaggccaggcacagtggctcatgcctataatcccagcactttgggaggctgaggcaggcagatcacgaggtcaggagatcgagaccatcctggctagcacagtgaaaccccgtctctactaaaaatacaaaaaaattagccgggcatggtggcgggcgcctgtagtcccagctactcgggaggctgaggcagaagaacggcgtgaacccgggaggcagagcttgcagtgaaccgagatcacgccactgcaccccagcctggctgacagagccagactccatctcaaaaaaaaaaaaaaaaaaaaaaattatacccatgaaacaatttgtctgggtctgttctttcctttttttttgttttttatttttttgtaagtaagtctcagcgtagaatcacaagttctcccttccagcccctacttgccatgaacaaaccttactttgttcaccataaagaggagatgggctcagttttctcctctgactacataacgggtgctttctctggggaagtggtagcaggaggatggccaggcaatgtgtcagctcttatcaaccacagtccatccacttccaggtctgttgatccaggggatatagaaaaattgagactgataagaggtcagcctcctcaagaaccatctatgccttcctagtgccttacgcgagtttccaaactgtagagcctgtgggtaccacaaggattcttcaaggccacctctcatgtgggtctgcaggaccccctcccatttaaatcaaatttgtatcatggagttacaggtacaaatctgttgaaaaagaaattctgctggctgaaacaagttcaaaacaactgtcaggagccgaaatacatctccttggtttccaagcttcctccctcttctatctgttggcactttacctcttccctcacttctcactcaggccaggctactcattctcccgacacacacacacacacacacacacacacacacacaaccaggctactcattctgacacacacacacacacacacatacacccagactactcattctcctgacacacacacacacacacacacaccaggctactcattcttctgacacacacacacacacacacacacacacaccaggctactcattcttctgacacacacacacacacacacacacacacacacccctgagattctactttccctacaatcccacagggggaagatggacatctaaatcaccaagtgagcacaaaacaaaggaagtgacagctcaaacctggcagagggactgtggaaatgcagaagggaattaatagcacctggaggataagggacggcttcccagagcaagcagacttcctccaaggctccaagcattcgaggataaggacttcaaatggaagaaacatttttatggaggcataaacatgggtcataacaaaagggcacagattgcactgggcggtgggagacagatttggtgaatgctggaatggtgcaaatgaaagctgccactcattgtggacctgccctgtgccagccactaagcaggcacaacccacagcccctatttttttaatctacaaaaactatttaaaagagacatagtattcatcccattttagaggaggaatcaaacagtaagtttcaggaactttcccaaggtcatgggattaaagaggcaactgaggcaggatttgagccaaagcttacactgcagacctattaaatgacctatggtatctgtgtgccatcctggtctcactgattgtccttctgaccccagttccaatctcacctcttccaggaagcctccctgactcccatcccagctggattaggagctcatctaagctctccctcagcacctgcattctgtgctcacctctctataccacttgaacagcattaaaagtgctttcagatcagtggtttggatggggaaagggtgggaggaaggcatggattgcagagaggcacaagaaaactttcaggggtggtagaaatgctcattgatgatgatagtttcatgcatgcatacagatggaaaaaccaatcaaattgcatattttacgttttaatttttaaaatgttggctgggtacagtggctcatgcctgtaatcccagcactttcggaggccaagtcaggcccatcacttgaggccaggagtttgagaccagcctggccaacactgtgaaatcccatctcttatcaaaaatacaaaacttagccaggtgtagtggcacgcacctatagtcccagctactcgggaggctgaggcaggagaatcacttgcacctgggaggcggaggttgcagtgagcagagatcatgccactgcaccccagcctgggcaacaggttagactccacctcaaaaaaaaaattccctttcttttcataggtgttggcaaattgtatattttaaatatgtgcagtttattgtccttcaacaatgcctgaataaagctgtataaaaggggaggactggtcttcccagctgtctcccccactagcttgtaggtgtctggaggcagtctgagctttgctcacccagcattccgagtctatagaacaccacctggcattgagcagactttctgtacagatctgctggctggacaaagaaatgaatggaggctgactggacgtggtggctcacgcctgtaatcccagtgctttaggaggccaaggcgggcggatcacaaggtcaggagttcgagactagcctggccaacatggtgaaaccccgtctctgctaaaaacacaaaaattagctggtcccagctactcaggaggctgatgcagaagaatcacttgaacccgggaggcggaggttgcagtgagccgagatcgcgccactgcactccagcctaggcgacagagcaagactctgtctgggaaaaaaaaaaaatggttttgccatgttgcccgagctggtcttgaactcctgggctcaagtgatctacctgcctcagcctcccaaagtgctgggattacaggcgtgagctaccgggcctggccacaagactatttcttttgggtcttcaagtatgtgctattcaaatagatcctcaaccaacattagctctaccaattaccctgaaaaggtggtgtggtaactaccctttggctagagatcatgccccaagccaagactaaagggacaaatatagggtggacacatatcttagtacaatctttcaggagctgcccgtggccttcagagtaacactcttcagtctgccagcaagacccctcttcgatcaggcagctgtctccctcaactcatctgccttcccaccatacccccaatttagtgctgctgttgttgtccctgctgtcatcaccattgtaataacaatttattgagtgcttactatgttccaggcacagtgctcattcacaggcatctcatttaatccccacaaccaccctgcaaagctggtcctattattatcgcttttggatttgaggcttagagaggttcaataacttgcccaaagacacaaagacaaatattcaaatatgtgtgaaatgaacacgaagcctgtacttgctaactctgctatactgttgccacctcaagtgacttgtggttagtgtaagagtcaggatctctcaagactccagaactgcatactaaggttgtcctaccaggtccagccttctcctgttgctctgcccagctagtgttaagttgcccttcaatacccagttcagaagccctttccttcaggaagccctcctgggctgcacgtaccctcccaccaggccaaagcctccctgcccctacacaccccactggtctggatcggcggccccggctctgcactcatggaacagcctagacttccttctgtcacaaccctgatcacactagagaagctactggtctgtctttctcttaggtcgtgggctcttcaagggcagagaccatgtcttttctctttatagctccagcacctggcacatggcctggctgcagtccctgactcatgtaccaaatgttttctgagagcctcctgtgcgcctggcactggaaatcaggagtaaagggcaaggaccaggccatcgctctcacaatgcctgcagtctaacaacccacatgttcattcggtatgtggggaggactgaggtggaaaatcatactcgaccacccaaggagccagtctccatcagtgtttccatcagaactttctgcaataatataactgctctatatctgtgctggcactcaccacatggggctattttaatttaaaagcattacaattaaattaaaaatctagttcctcagtccacactcactattcacattacaagtgcttaatagctacatgtggtgaatgaccacctattgggtggctatcatactgaaaagaacacttccagattttctgataaatatctcccacacataaaaaggttataaaaagaaaatgagaggctttatagcagaaagaatttaaggatatgtgtcctagggtctgcctggctaggctcccatcctgactcccctgatttcctaattctgtgactctgaactctcagtttcctcatctgtaaaatggagacaatcaaaatgtctatttgtagggctgtgatgtggactaaatgagataatccgggtgaagtgtttagaatgatctggcacagggcaagtactgtataaatgtcaggtactattattagagactatttaagaagtaataagaagccatctagaaggcaggaaataaaacaccaagttcctgtttcccacgactttactcaaacccctagaaaacacttcctcccaccttgttcaagtgagctcaaattcttgggaaaacaacaagtgggtataggaactccagggctacatctatctccttcttcagcagcctggcacctctccatggctttaatctctctctgcagctggtaatcgacatgttcatagcctccttatttttcagtctcactagctctgccggggtgtttgtatgtggtgcttcctatctcagttgagataaaagacggcccaacctctgaaatcagcgttcccaccaaaatacggatagcagcttagatagctctgaaaacgctacctgaaacctgaacaccctccacagggtcaaatccccaaacccagctttgggctggatccatttctagcccgatccaggctgaattagaactgccattggactgatttgaaattaaatgctttggggggaaggtgcagggtggtgacatggaaaatcctatgcaaattcaagttgctgctcggaaggaaattcctactctgggcctggaagagactagtagtgtctcagctactgaatcaccgaccatggccctcgtgtcattcttggaacagataaagacggaatttactttttgctcctgaaattgcaagactgacaatatcaggctgaatggccttaagtgaccggctcaccagcgctggtgaagtcctcagctttcctgtcttcgggtccttgtgggtgatctggagttggtccaggggcagagctggcattgtgctgcgtgaccctcctgaaaggaatatggatgggaagaagagagcagacacacagactcctgggggcagggcctgctctggggctgatcccagagtcagaagagaagcttcaacctctcgccttaggaggctcctgttgtggttcaggacctggttcatgcacctactaacccagccaaagtgactttttttgcataaagcagttctcaattgtagaagaaatacttccccagatgacttctgatatatttccacccactttttttttttttttttgagatggagtctcgatctgtcaccaggctgaagtgcagtggcgctatctcagctcactgcaacctccgcctccctggttcaagtgattctcctgcctcagcctccccagtagctgggactgcaagcacacaccaccatgcccagctttttttttttttaaagagacagagtcttactctgttgtccagtgaagtggtgagatcatagctcactgtggcctctaactcttgagctaaagcaatcctcccacctcagcctcctgagtagctgggactacaggcatgcaccactacggccagctaattttttaattttttgtagagacaggttttattttttgatagatgagttcttactacatcactcgggctggtctcaaactcctgggctcaaatgatcctcctgtcttggcctcccaaagtgctgcctcaacctcccaaagcgctcacaggtgtgagcctctgtgcccagcctgtttccacccactttgagaagtactggctaaaaatatgtagattccctttattatggctccagctctgtgagctcagtagcctgtgagctctatgaagacaatgcccagggctctcctcttgctatcttttctgtgagcacaggattggtacagaggtggcctcaccaaatgtttgaagaatgactacatatgaggacactccttttaaaactctagccagattttaagtcttttgagggttgaagccatgggcctttcctcacttgtggaggatgttaagattttgcaacctttctaggcttcagggaagaagtacgtggaagaatagaacgacatgagaagaagggaagaaggacatggaagaagggaagaaggacgtggaaaaagagaaggaccagggaaaaagataattcatagaaaactgacagtgcaagctcctttctacaaaggcacaaactgacctcacagtcagtgagtggcagatccaaggtctcctgtcttgctgtccagtgttcttttcacaatatcacttggcctgacccacagaagggacatacgtgttaaatgaatcacggaatagaagtgtattaggcccctcaaaaaacatgccataaaaggctagaacagactcaatgacaacatgaagagagacagaggctggggtgattaaactgtcacctcttgagccttcacagacaagcagaggagcatgggggacatgagctaccagctgtgtcatatctcagatattgggccaggcttaatgatatgaagagctcctctaagtgcttttctttttcttttttttttttttttaaatagagacggggtttcaccatgttgcccaggctggtttcaaactcccaagctcaagcaatacgcccatcttggcttcccaaagtgctgggattataggtgtgagcgcctggcctctaagtgctcttctcagcattaacttacttgccctgttaactggctttacatgtattaatgctcacaaaaagtctaaggttagttctattattatcctcattttatcagtgacaaaacagaggctcacagaaaataagaaacttgcccaaggtctcacagttagtgggtggtgaagcaggctggttcttaactattcactatactgtgtctagtttagttaaacttaggggtgagacggggtgaaggggtggagtgaaagtcaaagcacttctagaggagagtctgagtagtcttgataatagagactggccagggaagaagggtgccccaggcagaggaaacagcagagcaaaggcaaggaggtggaaacagcctggtacccaaggaaccttggttctggcctgttataaagactgtgaagatccccaccctagaaggagtaataagagaggaccagtctgcctagtccttgacacctgttccagctctaggatcccagcagatcagacacacatggtctctgcatacacgaggtggcctgaaaaaaaatcacaaggcaaagaaagtaataaagggcttaggtaagttttcatctttcagctttgcaaagcatagataatatcctctgctgcacgtatttctaatcaagttactgtcttactagcctctcacaacaacccaattaaggacaacaaggattaccatgttcagatgtccaaagaggggccctgatttgctcaaggtaaatacattattggccaagctgaaaccgaagcccaggtcttttgctagggcacctggggctcttgtgccgaatatgttaaaaaataataataataatttttttttctaaccctctagccatgctggaaagtgagctggaaacaccactgctctgcaaaccagtgcagaagtctaaatgactgacaggcccagttctttccaggctcgcccgctgaagatggctgtgggagtgttgggtgtgagacacagggtggagaaaaagtcaggaggaggaggcaagtctccaccctttaacctctaggccccacagtccaggcctagacaggtagagacagcatttgctttcagaagaaattcacggccaggtgcagtggctcatgcctgtaatcccagcacttgggaagccaaggcaggaggattgctcgaagccaggagtttgagaccagcctaagcaacatagtgagacccccatctctacaaaaaattcaaaaattagtcaggtgtggtggtgcactcctgtagtcccagctacttaggaggctgaggcggaaggatcacttgagcccaggagatcaaggctgcagtaagccatgatggcaccactgcactccatcctaggtgacagagcaagaccctgtcccaaaatttaaaaaaaaaaaaaaaattttttttctttaaaagaaattcactcctacaaaccattgcctgccagggcaattcagggctagcctggtgtggtggtagggagagagcgctacagtcctacagcctggattcaagtcctggctccaccttttcctatccatgttgagaccttgagacagttccctaacctctctaacttttgattgcctcttctgtaataccagaattgtaatagtacataaactcgtagggttgctatgagaagtaatcaatgtgaagtgttcaacccaatacctggcacataataagcactcaataaagtttagttgttgttattattcaagtcccaaccagaggcaagacactttgggcttcctggtttattcagcaaacaattcctgaatacaatctgggtcctaggcatataactgactatgatttggcattaaagctgtaacaggaaatgtccaaaactacagtatagtagagaaaggaaggatattacaaagaaggtgatctataacctggatgttgaaggatgggggaaaaggtgacattccaagcagagagcaagcatgaacaaaggctcagagtcttaaaatgtgtggctttgggtcgggtgaggtggcttccgcctgcaatcagcactttgggaagccacggaaggagaattgcttgagcccaggagattgaggttgcaatgagccatgatacgtcactgaactccagcctaggggacacagtgagaccctgtctaaaaagtgtggctttgaaggaagagggagacatttggtgttactgaaaacacaggtcagataggggatgacagaagtgaagagagaagagaagctggatagggaagacaggaccagtttaaaaagagcctcaaaatagcttgaacccgggaggcgaaggttgcagtgagccgagatcacgccattgcactccagcctgggcgacagagcgagactccatctcaaaaaaaaaaaaaaaaaaaaaaagcctcaatgctacactaaagattttagtatttcacctgaaggcagtgaggagtcatttaagtatgagacagacatgaccagaaagagatgatgataacctggtggcagaaaagacctttaataaaccacgagagagcaaacagtacgttaatcatttcattcattcctttttttttgagatggagtctcactctgtcacccaggctagagtgcagaggaacgatctcggctcactgccacctctgtctcccgggttcaagagattctcctgcctcagcctcccgagtagctgggaatacaggcatacgcctggctaatttttgtatttttagtagagagagggttttgccatgctggccaggctggtctggaactcctgacctcaggtgatccgcccgccttggcttcccaaaatgctgggattacaggcatgagtcactgcccggccattcaaatatttttgaacacctattatgtggcaggcactgatgcccagagaatattaaggtgggcaaataacaaacctgctcctgcccttcacagagcttacagtcataatggggaaagacagatacttttccaattagccatacaaacaaataaaaaccaataccatgatgtagctatgtagataaggctcatgaagctgtggcagcatttaaaagagagacctggcttgaggaagaagtgatgtcaaggaagacctgagtttttgtctaaagcacgggtacaaattaagtaggcagggctgggcgcgatggctcacgcctgtaatcccagcgctttgggaggccaaggcgggcggatcacgaggccaggagatcgagaccatcctggctagcaaggtgaaaccccgtctctaccgaaaaaaaaaaaaaaaattagcagggcgtggtggtgcatgcctgtaatcctagctactcaggaggctgaggcaggagaatcgcttgaacccgggaggcggaggttgcagtgggacgagatcacgccactgcactccagcctgggcgacagagcaagaccccgtcttggggggaaaaaataaattaactggacaatctgaactttgagctccaaaaggacaaacaataatcatgactatgtctgtgcccaccactgtattcccctgccaggcaggacagcaaaagccaaaagctaagaaagggagggggagctccctacaagcacccaattgcaatatggcctgggagcatccccggggctactgctccctcagcctctttgtcatcattcctctagtctctcaattaaatactactctcctcagagaccttctgatggctctgcctatagtatccactctcccagttactgtcatagctttaatgaccttgtgcatttgcttgtcgttgaccatctcctcccactagactgtaagctccatgagggcagaagccttgtctgtcttgctttctttgtatccccaatgtctagatctgtgtctggcacataggaagcactccacaaatatttgctgaacgaatgaatgaaccctgaggaaactgaagccccgggtgtgaggacgtggggggatcgtggctggtccaacgccactctggggccgaacttcgaacccgtggctcctgaccctggcggccaagtctcgagaggcggctcacaacccctcaggtagcgtaagcgtgggccccgcaatggaggccagaggatgggagagccaaggctgcccaaggcatagccgcggctcctccggggtcccttgccctgcatctggcagggaccagccacgcactcacctcggcggctccaccaccggctctgtgccgccgccgccgccgccgccgccgaccacggtgacagctccctgagcgcccgcacttccggggtcaaactgcgattccgcaggagcagacaggaagtctcggcctggccccgcccccagagccgagcaaactaccgccgggaagccggacccgggttgcgcctctcttcttaagactccgccccacactcggcgtctgtagccacgcccccttcccctcctatctcccttcctgcttaagcagagaataggtcagctgagggcgggctgtgtgattacacctctcgggaaatccaagtatggcacctgagaggacgtctcggaatcccaggcttccaccttctgcccgacctccttagtcaccgttttacatatttaatccagaagagaaattttaacaagtcaaaagcacgaacataatgttaagcagatgtacaagtacagactgcgatttcatttacgggaaattctagaacagacagaactcatgagtagtgatggtgttaaaattggtggtttcctctggggctgtgggctgggaggggccacaagtgaggctggggtcaccccctgtcttcatctcggtggtagccatgtagatgtgttcactttggaaaattcatcaaattgtacgcttaagatttgtgcatttttctgtatgtatgcaatacagttttgttctgttttgtttaaggaagttacaagtatagctatcctaagagaaggatgcaattttttctacagaatgtctcaggtaatgtaggtttagtggttcctaagcctgactatggatcagaatcatcacagaaaacttgttaagaacacacattcctggcttcatctcagtgcctggtacacagtaagaattcaaaaccaaccaccatcattattggggtgttatagaagcccccgaatggagaacacaaccccaccctgggattgtgaaatatttcccaggacactcctgccaacccctgctatctgcactagggctacaaggaatgcttagttcagtgcctgtcttcaaggggcttacaggataggaagtgcaagaaaaccaatagcaatgagtcagtgtgatgaatgcagggtgctaaggaaataggagagatgggctgtaaaccagaaatgagatgagaggggctggatattatattagttttgtattgctgcataacatattaccacaaacttataacaacacactgcttgccacttataacaaacacatttatttatttatttattttgagacagagtctcactctgtcaccaggctggagtgcagtggtgtgatcttggctcactgtaacctctgcctcccggaggttacagtgggttcaagcgattctcctgcctcagcctcccaagtaggcaggactacaggcatgagccaccaggcccagctaatttttgtatttttagtagagacggagtttcaccatgttggccaggatggtctcgatctcttgacgtcgtgatccgcctgcctcagccttccaaagtgctggggttacaggcgtgagccaccacacctggccaacaaacatatttattatctcacattttctgtgggccaggaatctgaggatggcatagctggctcctctgcatcagggtcacccacaagactgcaatcaagatatcggccagggctggagtctcatttaaaggctcaactcaaaaaggatctgcttcccatgtctagtggctaaattcagttccttaatggttgttggactaagggtctcagttcctagctggattttggctaaaggcttgtcacgtaggcttctccagtgtagcagcctgcttcatcaaagcatgcaagcctaaaagttaatagggaagccaagagtggtggcacatgcttatggttccagcaggttgggaggctgaagcaggaggattgtttgcgcctaggagttcaaattgagcctgagcaacatagcaagacccagtctctaaaaattaaaaataaataaataaataaaagaaggcaataggggccgggcaccgtggctcatgcctataatcccaacacttcggggggctaaggtgggaagattgcttgagcccagaagtctgaggccatcttaggcaacatagcgagacttcgtctctacaaaaaaaaatttaaaattagccaggcatgctggtgcatgcctgtagtcccagctacttaggaggtcgaggcaggagaattgcttgagcccaggagttcgaggctgcagttagctgtgatcacaccactgcactccagcctgcacaacagagcaagaccctgtctcaaacaaacaaaaggaggcaataggagattctactaagaagagagaaattacaacctcatgtaacctaatcaagaaagtgacatcagttttgccatgttctatttgttagtagcaagtcacaggatttgcccacaggggattacacaagggcatgaataccaaaagatgtgaatcaatggaggccattctagagtctgcctgccacagatacttggaggatgcatatcaaccccaggtctgcagcagaggaagtagaggtgcagagagataaagacagttgtgataataatgaccacatttgtcaaacccttgcttcatcccaggcactggaataagcattttacacatattatctctttgacttttttttttttttaaatgagatggagtctcactctgttacccaggctggagtgcagtggcacgatcttggttcactgcaacctccgcctcccaggttcaagccatcctcctgcctcagcctccgtagtagctgggactacaggcatgcactgggctaatttttgtatttttagtagagatggggttttgccatgttgggcaggctggtctcaaactcctgacctcaggtgatctgcccgtcttgatctctcaaagtgctgggattacaggtgtgagccactgagccaggtgctctttgactttttgtaacaatgataagaggtagacgctattatgaccccattttaaagagaggtttaaagactagaccagagtcacagagctggtaagtgggtggagtggggatttgaattcagccctgtttagccccaagctccaagagatctcaagggccacaagctgcgtcagaacagtgaatgtttccctttgttgctgttattattattattattattattgagatagggtctccctctgtcacccaggctggagtgcagtggtgtgatcatggctcatttcagcctctgcctcctgggctcaaacaattctcttgcctcagtctcctgagtaggggtgactataggcatgcaccaccatgcctagctaatttttaatttttttgtagagatggtgtctcactatgttgcccaggctggtcttgaactcttgggctcaaacgatcctcccacctcagcctcccaaagtgctgggattacaggtatgagccaccatgccagcctgttgctgtcatttttaggaaaactgatcttctactgacatggaagggacagaaaaaggtgccagaaactgtgtgtttttgttttattttgttttttcttctctgtcatccacacacactgggcacaaggaaaatgcaatctgtatcttggtgattagttgggagaaaatcacatacagcagcctttggtccaggaaaaacttaaaatagtagatctggagaaaatatatgcactggttccatctttccctatgggtacaaagatgttcatatcactaaggttttggaactaaataacatgactgtaagaagacaaaacatccaataagtcacctaacttctccaaacatatctgttttctcatctgttaaacaaggtagttaatatccacctcatcatcattagaaggcttaaggctgggtgtggtgactcatgcctgtaatcccagcactttgagaggctgaggtgggaggattgcttgaggccaagagttcgagaccaacccaggcaacataatgagacttagtctctcaaaaaataaaaataaaaaaactagctgggtgtggtggcacacacctgtagtcccagctactctggaggctgaggtgggaggatagtttgagcctgggagatggagtctgcagtaagctgtggttgtgccacggcacttcagtctcaaaacaaaacaaaacaaaacagaaggcttaaatgagataatatagacaatgccaagaacacagtaggtgctcaaaaaatgttagtgaaaaggaaggaagaaaggagactccctatcagctggagcgttaacttttacatttctttcatctttctcccttgcctaaagagcttaatgaggaatgttggtttacaaaggacacattcttgtctgagctaatatgtgtccaactgaaattaaatttaaaagctggtttaacaggagaggactcaaatcatgcataagtcatttgcaaacatgcaaatacagagtaatttcttggcctggcttctcctctagattaaaagaaaaacaactaatttaagaacaatagtttgggttggcaaaagagaggagtgtccatggttcttaaaaccaacaaagtgtaggggtaactagggagaaaactgtcaatattcggtgccacgaaatagacattgaaatatctaggtctgagtcttgcctggcccagacactctgagtcacctcagatgaatcagtgttcccttcttttgcacatcagtcctccagcaagcatgtgtttgcagagcactcattgttgagattagctgttgtttggcatccagtgtttatttcctctgttttcctaccaatagcaacttgatcactccttagggaactgtcactcccatttcaatatgtgtggagtggggttgaccccttacccagagtttaagtgtccaaaattgtattagtcatctggggctatgcaagaaatcatcccacaatacagtagtttaaaacagtaataggccaggcactgtggctcacgcttgtaatcccagcactttgggaggctgaggcaggcagatcacgaggtcaggagatccagaccatcctggctaacatggtgaaacaccgtctctactaaaaatccaaagaattagccgggcatggtggcgtatgcctatagtcccagctacttgggaggctgaggcaggagaattgcttgaacccaggaggcagaggttgcagtgagccaagaccacaccactgcacttcagcctgggcaacagagcaagactccatctaaacaaaacaaaacagtaatcatagttttttaggccaggtgcagtgtctcacacttgtaatcccagcactttgagagccaatgtgggaggataacttgggcccaggagttcaagactagcccaggcaacatagcgaaaccccacctcaatttttaaaaatagtttattatcccatatgttgtctgtgggttgggagttccaaagtggcttggctgggtggttctggcttagggtctctcaggaagatgcaatcagatgtcagctaggactgaaggcttgattagagttgaaggatccacttccatggtagatcatttactcacatgactgccaggctggtactggctattggcaaggggcctcagttcctctctatggggctagttgagtgtccccaccacatgtcccctggcatctctcaaagggaacaatctaagagatcaaagcagaagcaccaatgtctttgtgacctagctttggaagtcacaaattatcacttcagccgcatttctactggtcgcataggccagtcttgactcagtgtgggagggggtcttactatccaagggcatggatatcagaaggcaggatcactgggggccatcttggaagctgccacatcaatctaatatgagcctggcatattctaaaccttcagccacagtgattggctcaagagtggatacgtgatgttcaaatcttttgtttgtttgtttgtttgtttgtttttaagagacaggatctatatggcccaggccagtctcgaacttctggtctcaagtgaccctcccacctcagcctcccaaagtgctaggattatagacataagccattccgtccagtctgccaaatctatccagtgatacccaattctggtatctttatttgaaatcaaaaggaaagagaagctctctttctgatgagattgttagcagtaagaatgaactaagcttttactggctggaggccaccacctagaacctgagaatgaagctagctcaaagaacaggagagccaagaaaaggaatgacaagcagagagagaatgaaagagacagatgacatgatttgaactctggatctaggcaaatctgaattcaggtaccctgaggcttttctcatgcctgtttcgcttaagccatttgagttgggcttctgtcctactacaacttttagatgctcagtcctcctcatgtttagttgaccagccttttctaaagattatgactggtacccactagggcaagaggtgtgaaattgctaactgttcaagctcatgaccagaaacagtggctggcatttcaagttgctagattagggacaaggagatattagcttacggatagaccaggtgtaccttgggtagccaccaattggtactctttaactagaccagtggtgttctggagaggtacatggtaaagaggtagctgatggattggctgtagagtctaatgatctaggtgttaagcccatttatatcccttaattactaggcaaactgggacaaattgcttagcttatctaagcctctgtttccttggctgtataataatacttgttcaacctactataatcactcagcaacaaacattcattgagcacctactatgtgccagttatcatcaataaagcaatgattcagttccagccttcagggttttcacagtcttgtcagaaatatgaatgatacataaattatagcatggtttaagaagtattgtgataggcacatacatgatgttttgaggtcataagtgaaaaagctttttttttttttgagacagagttttgctcttgtcgcccaggctggagtgtaatggcgcaatttcagctcactgcaacctctgcgtcccaggttcaagcgattctcctgcctcagcctcctgaagtagctgggattacaggtgcccgccaccatgccccgcaattttttttgtatttttagttgagatgggttttcaccatgttggccaggctggtcttgaactcctgacctcaggtgatccacctgcctcagcctcccaaagtgctgggattacaggcgtgagccaccgtgcctggccaaaagcttttttttttttttttttttgagacaaggtctcagtggcaccatcattgctcactgcagcctgggactcctaggctcaagtgatccttccacctcggcctcccaactagtattgcaggtgtgagccaccacccccggccaggaaaagcatcttatgtagtaggatatgcatggactttctggagaggatgctgtttaatctgagttttcaggaaatctaggagctgacaggttactagaacataacaaggaaaggagcaaagacccagaggtgtaaaagaagatagaccattcaggtaattgcaagtaaacatgtatagcttgaatctcagagtttaagggcattttatggagagaccagattatagagggctttgtggaccatgctaaggagctgatggtggggaaggtcctggagtgtttgaagggagctgaggaatttttagaaagataactctagtattcaatggtaggtagtcttgtgaaaagaataaaaggaaaaaagataactctactagccatggcagtggacaggatagatgatagcaagaatggagctagggctggtgcagtggctcacatctgtaatctcaacagtttgggaggccaagatgggagaatcacttgagcccaggagtttgagaccagcctaggcaacatagagaggccctgtctcttcaaaaaaaatacaaaaagccaggtagtggctcatgcctctagtaccagctacttgggaagctgaggcaggaggatcacttgagcccaggaggttgaggccgcagtgagccatgatgatgccactgcactccagcctgggtgactggctgacagagcaagaccctgccttaaaaaaaagaaaaaagaatggagctaggcctgtgttgcagttatctgtagctgcatgataaactatccccaaatttagtggcttacaaagatgtattatgtctcatgattctgtgaattggctgggctaagctgagtggttcttctgctccacatagtgtcagctgatgttatcatttggttacattgagttaggtgctcatttgaggctggaacgtcccagacggcatcattcatatgtctggcatctgagctggggtagctggaatagctggcagctgggtggggctctcttgccacatggtctctctcatcattcagtagtctagtccagtagttctcaagcaggggtgattttctcccacaggggacatatggcagtgtctggagacatttctggttgtcactactggaggaactaggaattagaggccagggatgctgcaaaacatcctacaatgcacagaacagcctcaccacaaagaactatctgacccaaagtattaataatgatcagcttgagaaacattggtatagccggagcttctatgtggtggtttagaccccaagagggtaaaaatggaaaaatggaaaacatatttctttttttttttttttttgagactgggtctcactctgttacccaggctggagtgcagtggcatgatctcaactcactgcagcctccacctcctgggttcaagcgattctcctgcctcagcctccagagtagctagaattataggcacttgtcaccacgcctagctaatttttgtatattagtagagacggggttgtaccatgttggccaggcctcagcctcccaaagtgttgagattacaggtgtgagtcactgtgcctggcctgatttttgtttttttgagacagggtctcactttgtcacccaggctggagtacagtggtgtgaacacgactcactgcagcctcgacctcctgggctcaagcaattctcctgcctcagccccaccaagtagctgggaccacaggcgcatgtcaccatgcccgactaatttttgtattttttgtaaatatggggttccgccatgttgcccatgctggtctcgaactctggggctcaagtgatctacctgccctggctaaccaaattgctgggattacaggcagtagccactgtgcctagtcaagacgctgccatatttattttcttttctttctttcttttttttttttttgagatggagtttctctcttgctgcccaggctggagtacaatggcctgatcttggctcaccacaacctccacctcccatgttcaagcgattcgcctgcctcagcctcctgagtagctgggattacaggtatgcacccccatgcctggctaattttgtatttttagtagagatggggtttctccatgttggtcaggctggtctcaaactcccaacctcaggtgatccacctgccttggcctcccaaagtggtgggattataggcgtgagccgcagtgcctggccgaagctgccatatttctttttatgtatgtgtgtgtgtatttatctttgtaagacctctcagggatgaatgaagttgccatatttcttaagccctaggctctggaacgccacactattactttgtccacattctattggtcaaagcaagttacaaggccagctctgattcaagtggagaggaattagttcttctccccatccatgggcaactactagtctattttctgtcttatagatctttggtgaccattttaacaggaaatccaccacagacagcgagacaatttaatgaaaaagattcatgtgagaagtgatagtggtgtgagctcaaacattggcaaagtgtcctcatgagaaaatgaaataatggcagttgaaatctctctgcaaagtgttacataaatatattaatttcataatccacactgtcctcagccaggaactgctgtccccagcagctttctgttaagccaggctttctttcaacaggcctccgttctgtgtctgtccaatccccctggcctctgttgagttcatcaaagcttctgctgactccagaagaatctagagaatgatcactgcagtgaaaagtctcaaatcatccccgagggcccctaataacaaaacatctgcttgtcattgtctcctaccccttttggttttagagagaaaacagcgttaagtgacgataatggtaaacaacttaaaaaccaggtctcctggcttccaggaaaagagctttaatttgaaggcagctaattatccattcattataatttacaaatagtagttgtcttgcctcctgtcactggtctgtgaacaacagtcagaaagatgaaaaaaaaagtcagagttaacacattttagaaatcagagggcagagaacccccaaattgaagaaaactcttacagaacatgtaattcaaacctctcattgtatggataaggaaactgaggcccaaagagggaatggggcctttttagagtcacccagcagtcggggggatggcagaatgggcactggaaccaaagctttcatgctggctctagcctaaagccccacccagggagatgaaagggtggttctgtctgcctccatgcagcctggagactctgcactcagaccacccatcaaagtggcagttggcatgttcaggtctctctataatcatcagggtgggacaataaagccacagaaccaggaggtagaaacaattcctcaagggctgggacatggtttaaattcagagggggttgggtcagcgaacattttgcttcacgtcaagatttaacattttttatttggtagcatcttgaacttttttttttttttgaaacagggtcttgctctgctgcccaggctaaagtgcagtgtcagtgatcacagctcactgaagccttgacctcctggctcaagtgatcctcctgcttcaggctcctgaatggctggaattacaggcacaagccactgtgcccagctatgtaaaaaaatttttttcttagagatgaggtcttgctctgttgcccaagctggtttcaaactcctggactcaagcgatcctcacagctcagcctcccaaagtgttaggattacaggtgtgagccaccatgcccagccacatcttgtactttccatgtaggatctgaaagggaggaatttcaagatgtctctgggctacgctggtgatgggaaatattgacacttagtggttttggccattaaacctggggtttcaatccagtggaatatcgccagctctttagctttccttgagagagtttgaaaataagttactggaagatttgccttgaccatcaagaaaagaggggaaccctactttctcttcttgctgggtatctactctctgggcttgcacagtccccagagatttcagtatgcagctgctctgacctaattccttgagtacaatggccccttcacacctcagggcactagcccatgctgcttcctcggcctgaaataaccccctgctctccttgtcaaggtaaagcctcctcttcatctcattttttcccaggttataatcactttcctgatatacacattcctagttagctcccttcacttcccttgtgtgtcactggtcacagcttatcttcttgtatttattgtgtggtcaatcagtgattgactccttcattaggctatgtgttctgacaaattagagacctcatctgttttgttcaccaaccttatccccagtgcttagcttggtacctggcatcttacagtgtgcattaaatatttgctggctgatgattgaatcaaagtgctaggataatctagaccaactcttccaattccaagtaaaaaaccatggtccagagatgggcaatgacttgcccagggtcacaaagaaggcatctaatagctccttgctgattactgacttccttaaaataccttggccctgagacagggccattttgaggagaggcaaaactgagagattgagttgttttccatgctgtcttagtccgtttgtgctgttaaaacagaacacttgaggctgagatatttacaaagaacataaatttatttctaatggttcaggaggctgggaagtccaagattaaagcactagtaggtttggttgtctggtgaggccttgctctctgcttccaagatggcgccatgttgctgtatccttcagagagaaggaacagtgcatccttgcatggcagaaggaagaagggcaggagggttgaactccctccatcaaattcttttatgaggctgggcccggtggctcacgcctgtaatcccagcacttttggaggccgaggtgggtggataacctgaggttaggagttcaagactagcctggccaaaatggtgaaactccatctctactaaaaatacagaaaattagctgggtgtagtggcaggtgcctgtaatcccagctccttgggaggctgtagcaggagaattgcttgaactcgggagacggagattgcagtgagccaagattgtgacaacgcactccagcctgtgcaacaagagcaaaaaaaaaaaaaaaaaaaaaatcctttcatgagggcacctaatcctattcatgagggccgtgccctcatgactcaatcacctcgtaaaggctccaccttttaatactgtcacattggcaacacctgaattttgaaggggacacattcaaaccatagcacacgttctgaacaactgtagttcctcttcttaacagaaggctccccatgaggcacaaattctaaacccaagtccatgaaggggctcccaagatctgtgtcccccttgaattatacacagttgtgtttggggaatatttttcagtagagagactgagaggcttcatctgattctcaaagaaacatcctcaaaagtctaagagcaactcacgccagcaccctgctgaacctcttcttcccttctagctagaaaagccatcttaaggcccaagaatctctggtgacagaaacatggcttagtgtgaggctgtgaggcaggcagtggtcagggcaatggtcagtggctaatacatggaatcagagagaaatatattctcagcttcagttggttagggacgtcagggaaagcttccaggagcaggtgccaatcaagctgggctataatggactgtgaaggttcaagaggctaaaagtgatgtggggagggaaacacagtccagaattcccttcaggcagccccaatgtcttcaccaatgcccattcccaaaaggggagcttgtttaaattgtccagtatttggtgtcattttcgtccagagatcatcttggatgtagagtttctttttccctttccctttattttattttttatttttttgagttgggttcccactctcactcaagctggagtgtagtggtgtgaccatggctcactgcagccttgaactcctggcctcatgtgatcttcttgcctcagcctgccaagtagctaagactacaggcatcgactaattttttttttttttttttttttttagagatgagatcttactatgttgcccaggctggtctcaaactcctgggctcaagtgatcctcctgcctcggcctctcaaagtgctggaattacattataggtgtgagttgctgcacccagccccgtctccctttattttttattattttattttcttttaatttttattttatatatatatattttttttttttttttgacagagtctgactctgtcacccaggctggggtgcaatggcatgatctcggctcactgcaacctctgcctcctgggttcaagtgattctcctgcctcagcctcctgagtagctgggattacaggcatgagtcactgcacccggctatttggctatttatttgtttttaatggagatgaaactttgccaagttgccaaggctggtctctaattcctgagctcaagcaacctgcccacatgggcctccaaaagtgctgggattacaggtgtgagctactgcggctggcccattatttcatttttttgagacagattcttgctgtgttacccaggctagactgcagtggcacaatcacagctaactgcagtctcagccttccaggctgaagtgatccttgatgctcagcctcccaaacagccgggactacaggagtgtgccaccacacctggctaattttttatttttatttttatttttattttttgagatggagtctcactctgtcacccaggctggagtgcaatggcacaatctcggctcaccgcaacctccatctcctgggttcaacctgcctcagcctcccaagtagctgggattacaggcatgcaccaccacacatggctaatttttacattttttagtagagatggagttttgacatcttggccaggctggtcttgaactcctgaccttaggtgatccacctgcctcagcctcccaaagtgctggaattacaggcatgagccacagcacccagtcccctctccctttagaagaaaacatagactgattttgtgatgccaaccactgccattggccctttgtccttgctgctgaattattcatcctgcacaatgaattattaatttccaattttggagagcaaatgccaggcaaataggtagaaatggaaatggaactgggaccctgggcatggagccacagacatccctaggtcctccaaagcacaggccaccacggccaataaattatacaggaatccacaaggggctcaccctgaaatgcacttgacagagggtgaagtaggtacaagattatggtggccctgaagtggctgggctccattacccctgggctctcagacctctcgctttcctgagccttagctgtagccaccctttggctgactctggcatagggatgtattgcatatttagagtgggctcaagcagcattctgtggagtgacttgggtttgaatctgagcctaccatccaagtgaccctggatttaatcaagcagggtttctcaatgtcagctctactgacattttggcctggataattccttgttgtgggagactgttccatgcattataggatattgagtaccatttctggcttctactcaccaggtgccagtaccacagctccctccttccccttccccacccccaagttacaacaaccaaaaatgtctgtagacattatccagtgtccctagtctcctgggttggggggaggggcacaacatttcttctgcttgagaactactgggtaagtgccatcaattttttaaatatttttttttctcatctactgaagggggatctgaatagtagtcaccagtatgagaaggcaatcaaatgagatcatggatgtaaagcctcagcttattcggagtgtctctaccctgggacttttcttctatttatttattttttgagacagagtctccgactgttacccaggctggagtgcagtggcacgatcttggctcacttcagcccccacctcctggattcaagcaattctcctaccccagcctcccaagtagctgggattacaggcatgtgccaccatgccgggctaatttttgtattcttagtagagacgggctttcaccatgttggccaggctggtctccaactcttacctcaggtgatccacctgcctcggcctcccaaagtgctgggattacaggcatgagccaccgcatccagcctgggacctttctattacatgaactaatggttctcttttaggtttaagttcaggcttggttaggtttgcattcagcttgcaggtagcaaaatatccaccataaatggacttaaacagtgaaggggaacgattgattcacataactggagatccagaagtaagtcgagcttcgagtttggctgatgcaacaactcacctgtgtcctcaggcactggttttgtctttgtgctctgccatatatagtgaggtgttctactgagactggttcaccttggggtcttaagatgccctccagcagcagctggcaccatgggtttccttcttcccatgagcacagaaagaacacacgtgttccagcattccaaggcagtcttgagagtcaggctggctgggccactttggtcacatgctcactccaaaattagtgtcttcattcagtggaatggatgtacttaaactggttagtttaagcctctcaggtcctacccatgggatggaatcgcattcccaaaatacatggctgtgtgagtactgaaatgaagatctaagcacctatgatctagggactggtcctgaactcatcattgtagctggcagggaggaacaggctgtgttgatcggctggacctgggacttgagcaacccttggagttggtgtcttgggaacgaggagaggttagcctcacccaatcacaggaactggaagtgagagagtggtttcccaatcccaaaatagagatgctgttcccagaaatggagggagggatgctgaacacatgtcttagtccattttgtgttgctataacagaatactgagactgattttgtttgtttgttttttgtattgttttctgaggtagactctcgctctgtcaccaggctagagtgcagtggcgcagtcgcagctcactgcaacctctgcctcccaggttcaagtgattcttctgcctcagcctcccaagtagctgggactacaagtgcgcaccacagcgcccagctaatttttgtatttttagtagagacaaggtttcaccatgttggccaggatggtctcgatctcttgacctcatgatctgcccgcctcggtctcccaaagtgctgggattacaggcgtgatccactgcaccaagacaattttttttctttttttttttttaagactgagttgctctgttgcccaggctggagtggagtcatgtgatcttggctcactgcaatctccgcctcccgggttcaagtgattctcctgcctcagcctcctgagtagccgggactataggcatgtgccaccacactcggctaatttttgtatttttagtagagacagggtttcgccatgttggccaggctggtcttgaactcctgacctcaggtgatctgcctgcctcagcctcccaaagtgctgggattataggcgtgagccatcctgcccggactcagactctacttttaggggaatctaggataagtcaaagattttacctggtctgagatttagatttgtctatacactttttagacatgtgagaaataagtatgttttgtgtttttaaattggcctcctgcctgctgatcaggggctgtgctcagaggatgctgcactaagggactgaaagtcaagcttctgaatttccagcgaggtccagacctttcctggcaggaggcagcagcccgccagctgctgtgcctggggtgggcaggagggtggcagaagcgtcccaacatgaaccgttgcccagagaagctgtcaggggctgactgcaggacttgagaactttatcaacatgtcaccagccaaagagagaaggcggctatgcctctagctgagctcctgtggttctgaccaatgtatcaggctactactggtgtgttctcaacgccactcggtcatcgagtgtttcattggggtggcttgccagtgacaaggcacaaagcagcttttgcagagatagtaagaggaagctggagaatgggctgtctccttgtctctagtggccttgctgtttccctactgactatagacagacatgtcataatacgtctctgctcccctgggctctgtgccctctgccaatgcccactgataatccctgacgctgtttggatgagtgcctcattttctcatccctctggcccctgcccagccacctactgtgtcctcctcctaatagggcccttggccacttccccgggctgaaagcttgctccttgtggattgccaatgagacccgcaggcccaatactttttgcctttgacaatcctttagctccgtaacagaaaatcagcagtgccagcagggcatgaaaacagcccagtttatacatatttgtcaatatctcagtttatggttaggcatatctgggcaatttggaacaaaatagaatggttactgacgagccccagattgatattttgtaatggttctccatggcagttcaaggaactgtgtggggcatttaaacctcttcaactgtatcttatcttgtcccataaacacccaccgttgagtcaactgtgactccatgaccatctcacccctctagctcccatgcctgtatcccagctggtcccactgcaggagatgttcttcctactcctgttccccttgtacctggtatacttagaatcatctttcaggtctcagctgagtgccatgtcctctaggaagcccttctgactttctcaaactgagtaaggttcctcctgtaagttcccaagttgcctaaaataaaccttagcacattgccttgtactcgtctattgatgtgtttgtccctcgcagcaggtgataaattcctagacattcaagtactatgtctagttcaccaatcatgtcctcagggccaaggcttgtgtctggcacagagaaggtgctcagtatttgttgaataaatattagctggcttcaaagtgtctaataatttgaattgagggtacattgggagttaatgaaatctcaggttttatattatatataaaagtgaaagccacgtctataattccagctgcttggtagaccaagatgggaggacatcttgaggccaggagtttgaggctgcagtgtactatgatcacacctgtgaacagcaattgcactccagcctgggcaacatagtgagaccccatctctaaaaaaataaaaaatggaaaaataattagttcatgtgttacggtatgttaatatggtatgttaatattattatgttaatacatcaaatatatacttacatacacaaatattttagactcacataaccacaaatttaaaaagactgtattattaaaaatggaaagaaaataaatatgcaacaatctaacaatataagcattgtttattttcctccagccatatattttcccaagtggcagcatatgttctttctaccctcttactttttttttttgagacagtctcgctctgttgcccaagctggagtgcagtggcgcgatctcagctcactgcaacctccgcctcctgggttcaagtgattctcctgcctcagcctcccgagtagctgggactacaggcgcacgccaccacgcccagctaatatttttatttttatttttatttttatttttattttttttccccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcatctcccggacagggcggctggccgggcggggggctgactcccccacctccctcccggacggggcggctggccgggcggggggctgacttccccacctccctcccggacggggcggctggccgggcggggggctgactcccccacctccctcccggacggggtggctggccgggcagaggggctcctcacttcccagtaggggcggccgggcagaggcgcccctcacctcccggaaggggtggctggccgggtcgggggctgaccccccacctccctcccggacggggcggctggcctggcgggggctgacccccacctcccttccggatggggtggctgccgggcggagacgctcctcacttcccagacgggatggcagccgggcggaggggctcctcacttctcagatggggcggttgccaggcggagggtctcctcacttctcagacggggcggccgggcagagacgctcctcacctcccagacggggcggtggggcagaggcgctccccacatctcagacgatgggcggccgggcagagacgctcctcacttcctagatgggatggtggccgggaagaggcgctcctcacttcctaggtgggatggcggccgggcagagacgctcctcactttccagactgggcagccaggcagaggggctcctcacatcccagacgatgggcggccaggcagagacgctcctcacttcccagacggggtagcggccgggcagaggctgcaatctcggcactttggggagccaaggcaggcggctgggaggtggaggttgtagccaagatcacgccactgcactccagcctgggcaccattgagcactgagtgaacgagactccgtctgcaatcccggcacctcgggaggccgaggctggcggatcactcgcggttaggagctggagaccagcccggccaacacagcgaaaccccctctccaccaaaaaaatacgaaaacccgtcaggcgtggcggcgcgcgcctgcaattgcaggcactcggcaggctgaggcaggagaatcaggcagggaggttgcagtgagccgagatggcagcagcacagtccagcttcggctcggcatgagagggagaccgtggaaagagagggagagggagagggagagggagagggagaccatggaaagagagggagagggagggagagggagagggagagggagaaggctcggcatgagagggagaccgtggaaagagagggagagggagagggagaccgtggaaagagagggagagggagggagagggagagggagagggagagggagagttttttttatttttagtagagacggggtttcaccatgttggctaggatggtctcaatctcttgacctcgtgatccgcccacctcagcttcccaaagtgttgggattacaggcatgagccaacgtgcccggcctaaaaaatattttaattagctagacaaagtggcacatgcctgtagtcccagctacccaggaggctgaggcaggaggatcacctgaacccagaagtttgaggttgcaatgagctatgattgagtcattgcactccagcctgggcgatagagcgataaaaagatatatatgcatatatatacatatacacacacacacagacacagatatatatatatatcaaaaataaaagagaatatactgtacggttccatttatataaagttcaaaataagacaaactaatctacagcaataaaagaatagtgggccaggcgaggtggctcatgcctataatcccagcactttgggaggccgaggcaggcagatagcttgagtctgagagttcgaggccagcctaggcgacatgatgagacccccccatctctataaaaagtacaaaaaaattagctgggcatggtggcacatgcctgtagtcccagctacttgggaggctgaggtgggaggttcacttaaacccaggaggtcaaggctgcagtgagctgtgatcacaccactgcacttcagtctgggtgacagagtgagaccctgtctcaaaaaaaaaaaagtggttatgtgggaaggcagttattgattatagggaacacgagggagttggtaacattgggggctgataacattctatatcttgatagagatgttggttacatgagtgtttacatatataaaactatgtcaggctgtacacttaagatttgtgtactttatgtgtaaaataaaattgtaaacatatattatgcttcctaaactagtgtaatctgagtaagtctgtagtcttgttaattgccaattaatttcctgactttggtaatgcactatagttacgtaagatgttaccattgggggaagttggatgataggtacacagaacttctctgtactattttgcaacttctcgtgagtctacagttttttcaaaatatgaagttaaaaaaatcttatccttcctattcttcatttaaaaatcagacagtttaaacatgctattctttccatcataaaatccttcttgccttcaaccaaatttatggatctaattcatttattttcttttctaagtgatttcaggctcacctttccctccctcccttcctccctcttttccttccttccttccttcctccctccctccctcccttcctcccatccagcctttccttctttcatccattcattctatttgcctgtcatccatccatctattattaaatccttccttctttcccctccctttcttccttccttctttccttttctccctccttcctttccttcagtatcattgaatctggtctgtttctcctttctgccccctctagatcaccccacctcagtgaatacctgctctgagagggcatctccacttttctacccatagactcttactgccccatgccttggtgaatctaagagctaggaagcctagaagtcttaattccactatcctgcctgctctaaaccctgctgacctatgggcaggcctctaatttcatttcctttccttccttccttccttcttttttttttgagacagagtctcactctgtcccccaggctggagtgcggtggcacgatctctgctcactgcagcctccgcctcccaggttctagcgattctcctgcctcagcctcctgggtagctgggattacaggcgcctaccactatgcccagctaatttttgtatttttagtagagacggagtttcaccatgttagccaggctggtctttaactcctgacctcaggtgatccacccacctcagcttcccaaagtgctgggattacagatgtgagccactgcgcctggcataatttctaagtctgggtttacctgtttggaaaatgggttgaataatagatgcctccttcacaagggtgttgaactttaattactgtttgcagtgttgcttaagggaggagatgaaaggcatttttaaagttcatgttactggcattagtagtaaagctgaggaatttgtttgtgagtttgtaaagttgtcataactgggaaaagggtgaaaaaaaggttggttttatgtggaaaaaccttacccaaaaaatagccacagattctggttagtacaaatagcaagaacacgttgtacctcaaagtactttgcaaatttcacattcttccatgcccctggaaagatagaacccacaattccaaaactgaaaataaggagtttacctggggtaaggcaggaaattcaagagctgagttttggctgagaccattctgagttctcttcacaatttacaagaaaaatgcagttaaagcacagagttctttatttttaccataaatacttttctttttctttttgcattctgatcacatttctatcaatattacagttaacaaaaacttttagaaatctaccattttgggagagcactttataaaggagaggttaggataaaataaaaggccaaaactcagctcaagccttcaaagcatttaccatcaaaccagaagataaataggagtgagtggcctatatttagaatttacttcacagtgccctgttattaataataactgccccctttggagtgtccaaagccctttaaaatacattacttcatttgatccaccaacagggctggaattacaagctctggtttaaagatgagagacttaagctcccacagaagtgacttttctaaggctacaaagccgccaagtgatggcactgggacttaaacttagtcttggtaattggaatggtctagaggaatctagtggaatggtgtagtgttctttccaccgtactgctatcctagtagaactcaaaggagagccctggtgttttgtcctaggttcaaagctagtctgtgccaaagatcaatgccatgtggcatctaatcagagaggaggtatagtgtagagggtaagggtgtgggcttagactcagagactctggtttttttcctggcttttaatggctataaagattggagcatatgacttgactttgctgagcttgtttcctcatctgttaagtgggtatataataacaatgcttccaactttactaggttctattaaaagagataatctatgaagggcacttagcactgtgcctggcagacataggctttgccaaaagctatgaggtgatcttgacgaatggccagtgcaccttaatccctgaaatgaaccatcttgggccaaaaactcaaaagaattaaaacctaaaccaaaccaaaccaaaacaaaacctttttattttattttttattttattattttttttgagacagagtctcactctgtcacccaggctggagtgcagtggagccatcttggctcactgcaacctctgcctcctgggttcaagcgattctcctgcctcagcctcccgcatagctaggactacaggcgtgtgccaccatgcccagctaattttttgaatttttaatagagacggtttcatcatgttagccaggatagcctcgatctcctgaccttgtgatctgcccacctcggcttcccaaagtgctgggattacaggcgtgagccaccgcgcccagcctattttattttattttatttattattgctattattattttgagacagagtctcactctgtagcccaggctggagtgctcactgcaacctctgcttcctgggttcaagcgattcttgtgcctagtcacctgagtagctgggattacaagtgtgcaccatcacaccagctaatttgtttgtatttttagtagagatggggtttcgccatgttggtcaggctggcttcaaactgctggcctcaagtgatctacccacctcggcctaccaaagtgctgggattacagccgtgaaccactgtgcccagccacaacccttttattttgagataattgtagatctgtgtgcagttgtaagaaagcatatggagagatcccctaggtccctatgtcttttgcccattttcccctaatggtaacatcttctataactatagtacaatatcacaatcaggaaattgacattgatacaatccatcaactttatttggatttccctagttttatattcattcgtgtgtgtgtgtgtgtttgtgtatgtgtgtgtttgcatgtatacctagttctgtagtataattttatcatgggtaaatttgtttgactaccatccacagtttcatcacaaggatactttgtgtaacccttttatagccatagccttctgccttcctccctgccttgctaactcctggcaaccactaatctattctccatctctataattttgtcatttcaagaatgttatataaatagaattacataatatgtagcctttctttttttttaattttataagtagagatggggtctcactttgttgcccaggctcattttgaactcctgggctccagtgatcctcccacctcagcctctcaaagtgctgacattatagacttcagcctatgaaccaaaaggccatgctcagcctttttttttttttcttgagacagtgtttcactctgtcaaccaggctgaagttcagtcgtgtgatcacggctcactgcagcctcgacctccctaggctcaggtgatcctctcatctcagctttctaagtagttggcactagaggtgcacaccaccaatactttttgaagttttttgtagagacagggtttcactatgttgcccaggctggtctcaaactcctgggctcaagtgatctgcccaccttggcctcccaaagtgctgggactacaggcatgagccaccgggccctgcctatgtagccctttgagatcgacttttttttttttttcactcaacataatttccttgagatccaacaaagttgttgcaggtatcaatagcaccttcctttttattgctgagtagtagtccatgatacgatgtaccacagtttgttttacattcacccattgaaggtcatttggttggtttccaatttgggactattatgaataaagctgctatggataatcatgtacagatttttttttttttttttagactgagtctcactctgtcacccaggctagagtacagtggtgcaatctcggctcatggcaacctccgcctcccaggttcaagtgactttcctgcctcagccttccaagtagctgggattagaggtgcccgccaccatgcctggctaacttttgtatttttagtagagatggggtttcaccatgttggtcaggctggtcttgaactcctgacctcaggtgacccacctgccttggcttcccaaagtgctgggattacaggcgtcatgtacagatttttgcgtgaacgttaagtttgtcatttctctggaataaatgcccaagagtacaactgctgggtattggtaagcgtatgtttaattttttaagaaactgtcatattttttccacactgtttttgccatttcgcattcccaccagccatgtatgagtgatccaatttctctgcatcctcaccagcatttggtgttatcattgtttttattattttattttatttttgagatagggtcttgctccacccaggctggagtacagtggcacaatcatagctcactgcagcctcgaccttttggactcaagtgatcttcttgcctcagcctctagagtagctgggatcacaggcatgccccaccatgtccagctattttgttattgttgttgttgttaaagacaggcgcttgccatgttgtccaggctgatctcaaacttctgggttcaagtgatcctcccaccttggactcccaaaattctgggattacaggcgtgaaccacctggtctattttttattttagccattctgccagatgtgtagttatatctcattgtagttttaatttgcatttctctaattactaatctgagcatcttttcatgtgttcattttccatctgcatattctctcattgaaatgtctgttcatatcttttgcccactttctagttggattgttggatctttactgttgggtttgtcattgttttaaagatggggtcttgttttattgcctgggctgaacttgaattcctgagctcaagcgaccctctcacctcagcctcctgagtagctaggactatgggtatgcaccactgcacctggcttaccgttgagttttgatagttctctgtcagatatgtagcttacaaatattttctcccagtctgtagcttgtctttttttttttttttttttttttgagacggagtcttgctctgtcgcctaggctggagtgcagtggcgtgatctcagctcactgtaagctccgcctcccgggttcacaccgttttcctgcctcagcctcccgagtagctgggattacaagcatacaccaccacacctggctaatttttctttttttttttttttagtagagacggggtttcaccatgttggtcaggctgttctcgaactcctgaccacgtgatccgcccaccttggcctcccaaagtgctgggattacaggcgtgagtcaccgcgcccggcctgtagcttgtcttttcatcttcttcacaaggtctttcacaaagcatcagttttaaattttgatgtggtacaatttatttatatttccttttatggcttgtgcttttggtgtcaagtctaaaaactttttgcctagtcctagatcccaaagattctctcctatgtatttttcttaaaaggtttatagttttatgttttacatttaagtctttgatccattttgagttaatttttgtatattatcgaggttctttttttcccatggatgtccaattgctctggcatcatttgtttaaaacgtgattctccctctgttgaattgcttttgcacctttgtcaaaaatcaactgggcatatttatgtgagcatatttctgagtcaagaactcaaaggaattttgactcaaatattgaactcaggtgaataaaacataagaaatcaatccacagagagactgaatgaagactaacacatgaaacatttatcaaacaatctaatgctctatgtaataaagtatgaaattataagaaattgactgtgagtaccctgatcattaaaacataggctcagggaagtggttccaatcagcagagtgcattgaaatagatactgactttggggccaggagacctgcaactggactgtgattccatcgtttatcacctgagcgacactaggtgggggtaggtaagttaatgaacctcatggagcctcacctccatcactcactggagatcacattacttgccttgcaggattaatgtgtggaccagtgagatgggagcctacagaatggcagacactaagcttggtccacattagctacagcaggggcagatatgaaaaattgtttggagtttttatctcatattttctatcagtcccctctcaattactaaaagtgaatatccactgtaagtaaaaagtgcatgtgtggccaggcactgtggctcacgcctgtaatcccagcactttgggaggcagaggcgggtggatcacttgatgttaggagtttgagaccagcctggccaacatggtgaaaccccgtctctacaaaaaatacaaaaattaactgggcgtggcagcgggtggctgtaatcccagctactcgggaggctgaggcaggagaatcgcttgaacccaagaggcaaaggttgcagtgagccgagatggcaccactgcatcccagcctgggcgacagaggaagactcagtctcaaaaaaataaaataaaataaaataaaataaaataaaataaaataaaataagtgcatgtgctatgcaaatgtgccctgcaaatgcactagtttcctagtccctttttccgaccagactactgctcttaaaccctcgtcttgtcttgttttatggaaattgcagagaaggcagggcatggtggctcatgcctgtaatcccagtactttgggagattgatgcaggaggatcacttgagtccaggagtttgagagcagcctgggcaacataacaagaacctatctataaagactgaaaaaaattacccagttttggtggcacacctgtagtcccagctacttaggagtccaaggtgggagaatcacttgagcccaggaagttgaggctgcagtgagtcatgttcatgcactccagcctgggtgacagagtgagacactgtctctttaaaaaggaagaaggaaagaaattgtaaagatgctacaagtctacaccatgggttgggcatctcttctgagcatcagggccattgagtggtgccttcctcttggccattgagtgattctgcaaatgagagtctccttttctttctctggacatcagcttttccctagaaaggagaagaaatttggtgcccaccccctaaggtggcttagaaggaccaaaatgtacaaaatgcagattacctggtagattttctcacactttatgtgtatgaaacactgttaagcacagcttggcaatctacagctcgggccaaaatcctgccccaacttttccctccatcctgtcttcatggcctgacagccaagaatggtttttatattttgaggcattgtagaaggttattatcaaaaagatgaaagataaagtgtcggcaaggatgtggagaaagggtacctttgtacacagtgggtgttattgtaaattagtacagcccttatggaaaacagtacggaggttcctcaaaaaactaaaaatagagctaccatatgatccagcaatctcactgctgggtacatatccaaaggaattgaagtcagtatgctgaagagatgctggcattctcatgttcattgcagcactaatcacaatagccaagatatggaagtaatggaagtgtccatcagtggatgaatgtattttttcaaatgtggtatatagacacaacggaatactattgagccttaaaaacacatgaaattctgtcatttgctgttgcatggatgaacctagaggttattatgtgaagtgaagtaagccaggcacagtgacaaacacttctatgtggaatctgaaagtcaaatgcatagaagtagagggtagagtggtagttctcagaggctggtgggggtggggaggtgagcaggaaaggggagatgttggtaaaggggtgtgaagttatagttagaggaataagttctggtgtcttattgcacagcaagctgactatagttaataataatttatttgtctattttgaaatagctagaagagaggattttaaattttctcaccacaaagaaatgatacatatttgaggagatgaatatgctaattcccctgatttgatcattctacaatgtgtgaaacagcacattgtatcccataagtatgcataattatctggcaattaaaaataaatttgaaaaaagaaaaaagagttcaaggaaggaacaaaggaagggagaaaatgtcacagggatgtatgtggcttgtaaaacattaaatatttattatctggttcttttttttttttttaattgagacggagtcttaatgtgtcgcccaggctggagtgcagtggtgtgatttcagctcactgcaacctcagcctcccaagtagctgagattacaggcacccaccaccaggcccagctaatttttgtatttttagtagagacaggattttgcaatgttggccaggctggtctcaaactcctgacctcaagtgatctacccgccttggcctcccaaagtgctgggattacaagtgtgagccaccgtgcccagcctattatctggttcttttttttttttttttttttttttttttgagatggagcctccctctgttactcaggctggagtacagtggtgcgatctcggctcactgcaacctctatctcgggggttcaagtgattctggtgcctcagcctcccaagtagctgagattagaggtgtgcaccaccttgtctggctaagttttatatttttagtagagacggggtttcaccatgttggccgggctggtcttgaactcctgactttaggtgatctgcccgcctcagcctcccaaagtgctgggattacaggcgtgagccaccgcgcccagcctatctggttctttacagaaaaagtttgctgtcacctgttgtagaggataaaaatgaagctcaaaaaggggagaatattactgacttgaggtcacccaacaaagaaatcatccatctaaaacaaacagattgggttccctttatatacaaggatataaatacaagatcatagaacagtcagtgcagtgtttctcaaagtgagtgccatggaccccagatcccagaattgcccagtaatgtgttctcagctcaaatgagttctggaaactctggaaactccataagctcttcttagatgattattatgtacatcagtatatcaagactctcagaagttctgctgcaaagaacaaaactgttcggttaccttgttgaactcggcatgtccccagttattttttagctgggaatcttttttggggggtttattttgatgatagcaatgtaatacctttcctcagaaatatttgagaaattctgaagacataggtcaatcacttaggtttgaaagccagcccatccacttctttgcataggaccctgtgcaagttgcccagtctctttgagccttgttggtgggaagtggagactcatttccagtgacatttctgatcccctggttcctgcctttagagctacatttccccataggggtgttcactggcaacctcccacaccactgggctcagagtagagaatgagctttattttttctctctgattgtacataattctataatttactggaaagactgaggcctccacatcacacttggggcccttttatgcagcatatgccctgataagggaggacacagtgggtcagattctagaagactcgaccttaaaaagtcacgaacgtgggaaccagggagacagatggaatatgtacaataaaaggatttgtcaggcccggcatggtggctcatgcctataatcccagcactttgggaggctgatgcaggtggatcacttgaggtcaggagtttgagaccagcctggctaacatggtgaaaccccatctctactgaaaatacaaacattagccggtgtggtggcttgtgcctgtaatcccagatacctggaaggctgaggcacaagaatcgcttgaacccaggaagtggaggttgcagtgagctgagatcgtgccattgcactccagcctgggtgacagaacgagactccgtctcaaaaaaaaaaaaaaaaaacggatttttcaacatccagagacttgttgggacagggttgattatttcctagaggtgctgaaaaaggaatttgtaatattaaaagaatgtaaccattatggaatccagcctgcactctgtgattaacaacacaacattagatcatagaatttcagcaaagattctctccttaatatggtgagactgcctcacagaaagatgccccaataaacccatacctgttgggggaagaggccagctctcttttgcctctgcgtatttgcaggttctgagtcaactttttctttgatttttgcccacttagctcctccccttccttcaagtctctgtatcaatgtcaccgggaccttcacaagtctgctgcacaactgctgccataaatcctatatcttctacattacagtacttacctgggcttctgttgactttgtcttaccaactagactgtaagtctcaggaggccagggactggttttgtcttgttcacggttgcatgggcagagcttgtcctggtactcaataaacatttacaacaaaaagattgactaggccaggcatggtggctcaggcctgtaatcctagcactttgggaggctgaggcaggcggattgcctgggctcaggagttcaagactggcctggacaacatggtgaaaccctgtctctactaaaatacaaaacattagccaggcatggcagcgtgtgcttgaagtcacagctcctcgggaggctgagacagaagtattgcttgaagctgggaggaggaggttgcagtgagctgagatcacaccactgcactccagcctgggcgagagtgagactccgtctccaaaaaaaaaaaaaaaaattgactgagagagcatttgcatctctttggactccttggttctcagacacattggggaaactgaggcagcttggccaactctgtagagatgcggcagggctgggaacgtaagatcctctgacaccaggtgtgagactctttcatagccctcaatcacttcttaaattcctccccagtggagcttctgtgaccttattctattctttcttgtcatctttgcagaggtgaagactgtttcagagaattactttataacaaatgagatccagaatagaagaaaatttatctaactctcaggggcaggagaaatgtgagcctttggaccttgaatttaaatgagccagcaaatccctgctaattctcttcccctgctgagtcccgtctgcttcacattcagcagaggagaaagccagcctgtgtcacccatgatttatgccgtgccgtttgctctctttctctagaacattaaacaccctgagcagaggaggaagaggtactctcaggaggcctggttgacagacgggtgtctgggggtggggagctctctgctctgttgggaaaagggaggaggttgagttaaaaaaaaaaaaaaaggcccatgcggcttccacataaaaggaataagggagtctctgtgtgccttgacctctgcaaaaacaattgacctctgcaaaaacaattggcctctgagccaagagacctgggtgcttgatttactcgtttactaagtacctttgggcaagactttcctgtttctgggcctcagttttcctgcctgtcaaagaagggtctggatggtttgagctccctacagcttcatggatctggagctagttggtacagcgaccttgcatagaccgagacaatgtagcacagtggttaaccatagggactccagtcccctgggtgggttctgactccagctccacctcttacctcccactatgtggccctgggaaagttcctcacctttcagtttcatctgcatggtgaggttaatagccaggaccttcctcattgggtggcagggaactaaagccaggctcttgcagtggtgctggcactgacctagtactttataatagagtcagctgttattgggactgttgttcctgagatggtcccctattgtgaccttggtgtccctcaaccccagttctctgcttggagctcgcttggtgcagggcagggcatcttagtgagcaattggaagttctgggcagaagggagaaggagctattttcagtgggttctggttctatttgtagctggtgagttggcccaggctgcagggaagctttgggccagcacactgggcactgagagaggtgtgttgtcttacattggagaggggagggaaaggagagagaggagacagggaggtcaaatggagaggaaaaggagggaagccacccccccactcaccctcccatacctttctaacctgttcttgccaatttcatctcctctatcttacctggggaaacttagaggggggccctgaccttttaaaggtagatttagtttgcaacacgaagtgatccatcaacccagttaccacagtgttccctaacctatggcgttgatttttttccagctgaagtgggacttttatccccagcagaattttggggtatttgttaaggtaggtggtgcctaaaccactaaatacctaagtcatttttcaaaacaaagaggaagcgctctcatttccccactggatactagggcagaacctgctgacttcctcttccagaaccatcccctacatggctaagcgagttgcttaccctctctggccctcagttcttcattcatgaaatgaggcagcggtgccagggagacacgtttggagctcttgagttgtttccagttgtaattctgtggctccctgatgcagtaatcaaaccaggtgaggctgatcctttaatcaaaggatggttggtagaactaggaggctccaaggagaggatgacattctaccctgtcattatctggatgataaaactgaggtcctaaaggtggggtcagatcaggcagtgagtcagtggctcagctgggtcagtaacccaagcctcttacctcccattgtagcaaagcctccctgacactggactgcagggtacctcttcctagagggatgatggcactcacatctactgagtgccattgtactattgtagttgtgttaactgatttaactcccacactaatccattttccagatgaagatcacccatatagaaagaaatggtaacatcaaaagctcaatcaaacactatttgagtatttcccaatgtccagttatctgggtatcatcctcatgaatttttgacataatttgcttcatacgtttatactaatatttacttcctacttttatttctctctttttaaaatttttttgtattttttggagagaaggtctcactctaacccaggctggagtgctgtggcacactcatagctcatggcagccttgacctcctgggctcaagtggtcctctcactcagccttccaagcagctgggactgcaggcatgtgccaccacatcagctaacttttgtatttttttgtagagacaggggctcaccatgttgtccaggctggtctcaaactcctggcctcaagcaatcctcctgcctcaccctcccaagtagctaggactacaggcatgccacagtgtatggtttcgtctctttgataatagccatttttacaagtgttatgtgatatctcattgtggtttcaatttgcatttccccgatgattagtaatcttcaacagtttttcatatagctgttggctatttgtgtcttcttttgagaaatgcctattcagaacttttgcccattttttcagtaggattatttatttgcttaccattgagttctttatacattttgtatattaacccctagtcagatgtatggtttgctaatatattctcccattcaataggttatcttattactctgttgttttctttgctgggcagaaggtttttagtttgatgtagtcccatttgtctatttttgtttttgttgcctgtgcttttagagtcatatccaaaaaatcatttcccagaccagtgttatgaagcttttatgttttcttctggtagttttaatttcaggtcatatatttaaatctttaatccattttgagttgatttttgtgtatggtgtaagatgaagttctaatttcattcttctgcatgtgaatatagtttttcctagcaccatttattgaagagactgtcttttctccattgtgtagttgtcatctttgttgaaaatcaattgactgtaaatgtctggatttacttgtggcctctctgttctgtttcattggtctgtatgtctgtttttatgccagcaccatgatattttgattaatatagctttgttattttgaaatcaggtagtgtgatacctctggctttgttcttttcattcaagacagatttggctattcagtcttttgtggttcatatgaattttagaactttaaaaaaatttctgtgaaaactgtcattggaattttgataggctagtattgaacctgtagattgctttggataatacagatattttaacaatgtcaattctttcagtccaaaaacaagggatatctttctgttaatttgccttcttcagtttgtttcatcgttgttttatagtttttagtgtacagatcttttacctccttggttaaatttatttctaagtatttttcttttggtagctattgtgaatgggattgttttcttgattccttttttggataattagttgttatgttgttagtatacagaagtgctactaatctttgtgtgctgattttgcatcctggaacttaactgaatttgtttattagttctaatggtttcctggtggagtctttagggttttccatacatatgatcatgttgtccgtaaacagagactatttaacgtcttcccttctgatttggatgccttttatttctttctcttgcctaattgctctggctaggatttcctgtactatgttgaatagaagtggtgagagtaggggtccttatcttattcctgatcttagagaaaaagttttcagctttgtaccattgagtatgatattagctatgggcttgtcatatatggcctttcttatgttgggatacatttctcctatacctaatttgttgggagttttatcatgaaaggatactgaattttatcaagtgccctttctgtgtctattgagatgatgggatggttttgcccttcactctgttaatgtggtgtatcacatttattgatttgtatattgattgatatttattgatttgaaccatccttgcatcccagggataaatcccacttgatcatggtgaatgatcttgttaatgtgctgttgaatttggtttgctaatagttaaaaaatgacgttatttaaaaaatatcatggtaaatccatgatgtgttaacataaatgacatatttttatgtaaaaaatctatattttctcacacaaaaaatttcatgagaagaatggcattgtttttaacatgtttgcaattttcattaaagtctgacaatggaagaattctgcattctcatatctgcttctgcatttagtctggggcaatttgttttggttaaagtacatgaagaaaatgcagccttatatatttcagttcattgtggatattctttcttgatactacaccaaaggttggcaggtaatagtttcttaaagtttatttgcataaattcatatcaatgaatttttcatactcacactaaaatccattggtctaccttatacttttttttttttttttgagacagtctcactctgtcatccaggttgcagtgcagtggcacgatcttggctcactgcaacctctgcctcctgagttcaagtgattctcctgcctcagcctcccgagtagctgggattacaggcatgcatggccacgcccaataatatcatgcattggtcatatggaaaatattggtttactatgtagtgctttaaaatgttggcacatttcattatatgatataaaatattcattttgctaatatcaccaaccgtctcagcagatgtattgggaaggtatattgggaggctgtcaagctcatggtgggacatttaagttttccaaaattgtaagtaagcttgaattttatcattgacaacaaatactattagctgtcttactagatgtgacaaacctacttcatatatttttgagaaaatgtctgccaaacacccaaatctgagtaactgtagtttgcatgttaaccattctttcaagtaaaaatgatatttccttaaacaagaggctagctcatcttgcaactcaaacaattgcaaaagtgtttttctttgagaccactgtcctacttctgaatagtaaacgtgctttttgtgtgtgggaaataagtgcctaataggtagagggctttattttacagtgatgaaaacgttttggaatgggacagaagtagtggttgcataacattgtgaatgcacaaaatgccactgaattgtccacttaaaatgattaatttcatgttatgtgaatttcacctcaattgaaaaagtgaaaaaagggctttatgtgtaatttccaatccatcacacagaatagtaaaaaggcttgtattcaaatatatagagataataaaatacatattttttgttactgcttcatcaatgattttcttaagtgaaactggcattttgtttactactagggtatgttggtgaagagtacaatggctactagtacatatcatatcactgccttgatttgtgataaagtgccaccagttttactaccactgcttttgcactattagtgcaaatgtcaacacagtaaaaaggcaaacaatttcttagtattattaaaatagtttttatttattttatatttatttatttattttgagatggagtctcactctgtcgcccaggctggagtgtagtagcgcaatttcggctcactgcaacctctgcctcctgggttcaagcgattctcctgcctcagcttcatgagtagctgggattacacacgcccgccaccatgcccagctaatttttgtatttttagtagagatggggcttcactatattggctaggctggtctcaaactcctgacctcaagtgacctgcctgcctcggcctcccaaagtgctgggattacaggtgtgagccaccactcctggcctatgaaaatagttttgacccaactagaaccctgaaaaagtctcaggaccctccagggacctgtggactatgctttgagaatcactgctctaggctcaatcagagttgaaattaccctctcctacagtagggttgcagtgtggtgtttggaaaatcccaggagacattgaatcacagcaacatgattcaactctaatttctgtctgacccgtggcaaattgttcctcaaagtctgaaaaccacagttactcctgtctgctagctggattgggagaccaaggagatgctgaagagattatgggctaattcacgcaaagtgcccactgaaatgagtgacatttagagttaagcagtattacccagtgttgggaagtctgcattttgggaggctgagggacccctgccttccaggggccctgcatgactttaggaagcctccaaccctcaatcagcattttcatctgtcttaggctatttcagagtccctgtgtagctggaataacattttcagctttgaagataggatggggagcaaggctgaaaggacagcaggaggaggaggagacggtcaggcgggtagaggacctcacatgagaaatagggcagcgagatgaagcgaggattggttccctctttccttgagtcagtgcacaaagctggggctttgtcttcagccaaagcacacaaggaacctgtgcactgctttggctttaaatggaatataaaacgttctcaaacccattaccttaaagaaccctaacatgcttcttttttctttttcttttctttctttttttttttttttttgagacagagtctcgctctgttgccaggctggagtgcagtggcgtgatctcggctcactgcaatctccacctcccaggctcaagcgattctcctgcctcagcctccagagtaactgggactacaggcgcgtgccaccacacccgactaatttttgtatttttagtagagacagggtttcatcatgttggccaggatggtctcgatctcctgacctcatgatccacccgcctctgcctcccaaagtgctgggattacaggcgtgagccacggagaccggccaacatgagttaagtaggttagtgattaccaccctagaaggcgatgaggaaactgacgcatagaaaagggaaaagagaagcagatatgaggaggcgacaagattcaaatttaagtctttagacacagaccagctttctattgagtctccttaggcccttcttcttgaggtgagttttcaaggccatgctgcagttttctctttcttatttataaataatttactaaagtctgtcttaaaggtaagcaagtgggcagcagtggtgatgaggtgtagtaatgaagttgacaagcatgaacttggagtcaaatcttctgggttcaaatcctgacctttacactttcttatgtgtaaaatggaggacagtaacaataccttcctatagtgttgttgtaaagattacattacctttaaattttattttattttatttatttctgagacagagtctcgctctgtcacccaggctggagtgcagaggcaccatcttggcttactgcaacctctgcctcccgggttcaagcaattttcctgagtaagcaattttcctccggagtagctgggattacaggcacctgccaccatgcctggctaatttttgtatttttagtagagatggggtttcaccatgttggccaggctggtctcgaactcctgacctcaggtgatctgcccgcctcggcctccccaagtgctgggattacaggtgtgagccaccgtgcccggcctaagattacattagatatacatgtaaagtgctcgtatagcgcccgccacaattgaaaggttcaatccagccagttgcagtggtgaatacctctagacccagtagggaagccgaggcaggagggttgctggagccggggagttggaagctgtagtgtgctgatatctggtcggtgaatagccactcactccaattcatgttagctattatgaaaatgagaaggtgcaaatagtgtgatttcatgggcatagagaaattcctcctatgtcccaaatactggttgaagattcaattgaagattatttagcccagattaaaaggcaaacacgatgacattccgtctaaaaagaggtcaaaattacaagccatctccttcgctctcccatggtgaattggggagctgtgggattggttgagtgtatgctgactgcctattggcagaactctttgccctgtgccttctcattggaagctaggtggcctatgggtgggctgtcctggagtcaggtgctagcttcagtccaatcagaggccaccaacctgtggcagttcgtcctatggcctttccctgagcagatgactggttaagggaatttccctgcgggggggcttaatggctgatgagaaccttggtttatcagacaatgggaaaaacaggttggaaagtcctttttttttttttcttaatttttaaagtttaaggctgggcgttgtggcttacccctgtaatcccagcactttgggaggcggaggcagatggatcgtttgaactcaggggtttgagaccagcctggggaacacggtgagacaccacccccaccccccgtctctatgagaaatacaaaagttagccaggtgtggtggagcacgcctgtagtcccagcttctcaagaggctgaggtgggaggatggctcgagccctgggaggtagaggttgcagtgagcagagatccagccactgcactccagcctggacaacagagtgagaccttgtctgaaaataaaataaaatataaaaataaaaagaggccgggcacggtggctcatgcctgtaatcccagcactttgggaggccgagactggtggatcacctgaggtcgggagttcgagaccagcctgaccaacatggagaaaccccgtccctactaaaaatacaaaaaattagccgggtgtggtggcgtatgcctgtaatcccagctactcgggaggctgaggcaggagagtcggttgaacccgggaggcagaggttgcagtgagccaagttcccgccattaccctccagcctgggcaacaagagtgaaactctgtctcaaaaataaaataaaataaaataaaataaaaaaactttaaatcattcatcaattttagtatttactgtttcttctcccattccattaagcctatagtcagtcatagaacagaaagggaaaatcagggcagccacatataaatacaggtgcaaagttgaggcaggagtggaccctcaagggccaagaagaggtcattgctgagcttcacatttagccctgggctttctggaagccagagtgaaaagagagacacaatcagatgcgtaacagttatcaaaaagcaggaagcacaccggtttttctggtagtaaagcaagggctttccaagcttttaactctaaagtaatttatttcgttctttcttttttctctctctgacacccagattggagtgcagtggcacaatcagggctcactgcaacctctgcctcccaggctcaagccattctcccacctcagcctctcaaatagctgggactacaggcgtgcaccaccacgcctggccagttttttggtattttttgtagagatgggatttcgccatgttgcctaggctggtctcgaactcctgagctcaagcaatccacctgcctcggcctcctaaagtgctgggatttcaggcatgagccactgcgcccggcctaaagtaatttcttacttgagattttatttcaggctactgtgtccatgcactgggcagtacagcctggtgggtaagacagcacagtattttttttttttttttgtctgctgggtttgaattttgttttaatacacgcaatttattctgtgcttcactttcttcatctgtaatatggagataatggcatctacctattaaagttgtgaagattcaattagatgagttgtatgaataaatgttagctgttagtttagtttcgtttttttgagacggagtcttgctctgtcgcccaggctggagtgcggtggcgcagtctcagctcactgcaacctccgcctcccgggttcaagttattctcctgcctcagcctcccaagtagctgggattacaggcgcccgccaccatgcccagctaacttttgtatttttagtagatccggggtttcaccaagttggccaggctggtatcgaacacctgagttcaggtgatccactcaccttggcctcccaaagtgctgggattacaggcgtgagcccccgcgcccagccagctgttagttaatcaagaaattcgactgcctactacttaacctgcacagttctaggtgctggggaaacagtgacgaacaagacaagatccttatcttcaagtagcttttacattttagtggagtaaaatgacagtaaacattgaaaataaatttcagaaagtgctgtggaaaaactttacaacagacgcaggaatagatttcatttgactagttctcccagtttccagaaaagtcaagggtagaatgttaaaaggcaactcagaggaggtgaatctgttagggcctacggtaatgcaatcctggtttgtggaattctgcaggctagtgtgggtaggttacaattttttgggggagttgttttttactttgtttgaaaactcacttcttcccgctgagcttttgattaggagctgaagttgaatcagtttgaaattgtattctggaccggatgcggtggttcatgcctgtaatcccagcgctttgggaggccgaggtgggtggattgcttcagcccaggagtttgagatcagcctggacaaaatggcagaaacctcatctctacaaaaaatacaaaatttagccgggcatgatgttgtgagtctgtagtctcagctactcaggaggctgaggtgtgaggatcgcttgagcccgggaggcagaggttgcagtgagccgagatgccactgcactccagcctgggcgacagagccagactctgtctcaaaaaaaaaaaaaaaaaaaaaaaaaagaaaagaaaagaaaagaaattgtattctgaatacaacttctaaaacactatatttacttgcattatattaaactggttttatcctgaccacaattgcaggtggaagataccactattgttctatttttctggtaagtagagtgagccatgtcttgcccagggttacagagcttggaaaagacgcctcctaaaaatctgtaggaccacctttggttttcttccagatttttttttgtcatctcttttcctccacccatttcccatctgtctagccattcttgctccgctgggctttttcgcgagcctctccccagctgcagccccgcccatctcctggggcgtgaccacctgtccaggccccgcccccgtccaaccggcggagacccgccccctttcccggacaccgggctcagcgcccgagcgtgcgcgcgcgtcctcgctcgtcgcccggctcggcgtcgggagcgcgctctgtgtggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccggtaagaaccccatccccgtcctccgtctcctcggcgggtgaggaagagctggaggaggggccggcctcggccccggccctggccaggcggctgtcaccctctgaggaggcagcgccctgggagggctggggactgcgtgcggggcccggggaggggcgtccccggcggctgtcgccgccagggggaggcgctgggtgtgggagtgggaatgggagctcggcggccgagctcggcccggaccctagatgcgggggaggcggggtcccgggctcgggctgccttcccagacctggcggggatgggcccgtgcggctctgggtgtgggacgtaccctcggagcgcccggagttattcccacgaactcccgggaggtgggtgtgcgcccttcgccccctgccgggtctgtggcggtccatcgttgccggatactggaggtcaggggccatgggagccccggggcgaacggtgcgggcctgggccttgtggaaaggaggagtgaccgcccgatcgtgcagcagggcatccccctgacctggtagtacttaggtgggtaggatgattgggggcggttggcgtaactgagggaaccctggtcagactgctccgcaaatgattacagtgttatttctccggtagtaattttgcttgatgtatggcatttccggacccataagatgatactgtaggttgtattttggactggaaaacttatgtcaaaattatggggtagattttttggccacattaatagactcccctggaatttgataatctcacttgtgagttttggacatggactgctattacatattgatgttcaaatgtcctttccagacccaggcctaaattcttactgttgtagtatcttgattctgacatctatttttccacaacccaaacaaacaaaacaaaacaaaacaaaaccccaaaaccatatacttttctagttaaggttcaactttctcatatgtgaatggtaatgccataagaggcctgggttgaattacaggagattattattatttttttcaatgtgaaatgtttgtgatttgtccatggagaggtggtggggaccttcccctttcagattcagggctgttcagtaggacaggagacattgatggcatgcagaaagtcttccctttatagggcctatgacttgggtaggctagaagagcttacagaatgacactttttttttttttttttttttttttttttaagacagaatctctctctcccgcccaggccggagtgcagtagtgcgatctctgctcactgcaacctccgcctgccaggttctagcaatcctcccacctcagcctcccaagtagctgggattacaagtgtgcgccaccacggctggctaatttttgtatttttagtagagacggggatttcaccatgttggccaggctggcctggaactcttgacctcaagtgatccgcttgcgttggccttcgaaagtgttgggattataggcgtgagccactgccgccagccagaatgacactgttttgagtaaacccagtatagtatgtgatattaaattaaatttggaggattctagaattttagattggctgcctatgaatacctcttttggctccaattactccctcattttcaggtgactcagagaacttcaagtgaccagcacagtggtacagccccgcttgtcgttaatgaccagccataaaaaaccctgagtttctcagctcataggccaggttcttcagtggttgtctagtttaaggctggtcattagaaatattatggactacctaaattcctcgaactcatgcaggacctggtgaattaaaatctctgaggatagagcctggggatctgtccttacaaagctccgtgaatgattctggtcagcaaggcatgtgaacttttgctttaggttgggtattccaaagaagtcccattaattatgacttctcagggtgcttttgtttatagatctttaagaatttaagaggtggagaaggggaagcatgagaaacttaaagagatgcaaattgagcatctcttaaaatataatggatttatgtaggggaaacagatttgttgccaaaagttaatttgcaaacaagttattaggaacacacttgataaaattagatgctgattaattggagatatactgtatccagagatatattgaaggatccagaggaaataaacagagaaggagagggagtaagtcggcttctggctcataaaggggtccactgaagatgcttcccaccattatggttgctcctaaaccatctgactcagatttctagtggagggtaggatgggtgtgttagcaatcatttgagacccgggttgtgaaccaggaagggttactatgtattgtgaaaagttcttgagatttgccgcaggccatgaggagtggtaaagtcagtttaaaaatctgctgtagttctagttaacacgttcacaccttcttcagtaaagtggaatgctgttaccaaaggaagtattcgtgttttagaggggggtgtggtgaaggttcttacaagtttggaagaggtggaagaaaatgttgttacaattgtgtagagtagtgaagggctttggtaaatatcctgtcaaatcatagagtagtatttttagagttgcacccagctgtccattagaagagccagaggccttgtctgttttgttccctggtgtccccagtatccagcgcagttatccgcatattctgtgccctcagatattttttaattaagtgaatactattgatatgggaaaaagaacagttatggtggtttatagcagtgttagttattaaaagctacctgatattttgcaatggattaaagagccaatttttgatcaaatagggctctgggtaggaaagaaaatgaaaatgaagagccagctttcagtgcttattgtttggaatttttgagattcctttaagaaattgttttctaaagactgtcatgaacattatcgagtcccctagtttttgagtcttaatgaatcttaagtgtttcagatgttagttacttttttaagagcacagtaagtgcaaaggtagtatagaatagtgggaagttctggattgacagacatatattctgattccatctgtgtcatttattgctgttgggaatgtcacttaacttctctgggcgtcagttttctcatatatacaattaagggcctatagtctttgacctcaagtagtttctctagcctgattctgcaaatttttaatcatttctaattatgttatttggtattcatctcatataggtagatgaacttttattatttaaaagaaacaagattctgtgttgggttctgcttttagcttatggattttagacattgtccaaaagtgcttccgatgttgaatgtatgttgcaagtgttatgtagaaagaacatgcttatgctgttgtaattggcttagtgttgaaatcaaattgggttttacattgggaacttcataatttagtgtgaagtcatgagacttgagaatggtttggggggagtttgtgcaatttatatagctagctgtttcttaccacctaattctgtaattttctatgatgaatatatagataaatttataatcagtgtaacattgatttaagttataagatgatatcagattcatactggattgaactagaactcccagtaactttagaggctaccaaattattaacatgtcattgctatttttaatcttaattttgtgatatcaatactgatatgctttcatctttgcttttgtatctagaaacaatataccttttaagttcatatttgtatcagatattaaaaatgaaaattgtagcatgaaagtgggtagatagtaaatcttgggttcaagcctgggttgttattcttcattacccatgttgtttctggcaagctacataacccccctgagctccagttccctcattagtgaaaggaagaagagcaacttttctacttttctaacagactgtggatcaaacaatagtgtatatgaaaagcattctaaaaatgtaaggggctggtattagaatcgtattgtattagaatcctattttatgtctttgaagaattggcttgtggagcagtggtaaacctagtctgtattgtcaagtgcagaatttaccaatatcactgatatggcaacagagaaggtttctgcttctgtactctggctggagaaacctttcagcacatgtatcctgtctgccagtcggaatagtcacaatgttgcagggacttcagaggaacctgggatgtctcacatttatgccaaggtctctacttggaatagacttggctagatttcacccattttcttatgttggagcagtggtagaaggtggtaggagcaaggagttcagcacattctgtgtaaagttctaaggctgtgtttttaagtagcaggtggcagtgtcatagggtaatgaaatcaatgtacttatttaaaaaagcattttcagaaagagaatatatcagtacattgcataaagtaaaagtaaatatagacacagaggtattgtcttgatgctgatagctgcagatattcagaatgattctgttacaacagatggtagcaagcttttctgatttcacttatctggggtctaaatctaatttctttagtagttaatactgttttgttttgtttttttttttggacacagaatcttgctctgtttgcccaggctagagtgcagtggcacgatctcggctcactgtaacctctgcctcccgggttcaagatttgggaaacttttgtttctttttaaaagatatttttatgtatgtatacttggttgccgtgtaaaatgtattttttctttttaaaaattataattttcattttttgtagagacagggttttgctacgttgcccaggctggtcttgaactcctgggctcaaaggtagtcctcctgctttggcctcccaaagtgctgggattgtagacatgagccactgtgcctggcctaaaaggttgtttttttcttttgggttgtgataaaactttgtcgtcgttgtttggggacatagtacttgggcaatgtggatagaatgactgtctataaaatagtaaggcatgaaactaacgaaaacaaaaagaaaattgtgaaggtgggttaccttaaagctattctgttagtggtgaaatacctcatagctatgttctgaactgttgatttaatgaacaaagcacatgaacttatgctgtaataatattcttaagtactcttttcccttaacatggagtatggagtactttaaccacagaggtattgtcttgatgctgataactacggatattcagaatgattctgttatgacagatgatagcaagcttttctgatttcacttacctggggtcgaaatctaatttctttattagttaatactttttttttttttttttttttttgagacagagtctcgctctgttgcccaggctggagtgcagtggcgcgatctcggctcactgtaacctccgcctcctgggttcaagtgattctccctgcctcagcctccccaagtcgttaatacttttataacttagttgcagaagagaaatataaatttatttagttttcagaattattcatagatttataatctggcaaaatataaggaaattataagtatattgataaatcatgacataactggcaagaattggtatgaagacaagatggttataacttgaaatagggttgttatttattctatgcctatcatttttccatgagataaaccaaatatttaattgtttagactgattccacaaatgacatgggaaggcagagtgtttataaagagttttggaagtgatataggacactataatttggagttttaacttaatcttattttaaatttcaaaatgaaattatttctggttatgaaagctacggaacttttttttttttttttttttttagatggcgtctcgctctgtcactcaggctggaatgcagtggtgtgatctcagctcactgcaacctcagcctcctggttctagcaattctgctgccttagcctcctgagtagttgggattacaggtacctgccaccacgcctggctaatttttgtatttttagtagagacagggtttcaccatgttggccaggctggtttcgaactcctgacctcaggtgatccgcctgccttcgcctcccaaagtggtgggattacaggcgtgagccactgcacctggcccagaacggttttagtgttttttaaaaaaaaaagtagagatgacctgtaatcccatctggatgtaatgtttggtatttttgttttttttcttatacatatctattgaaataattttaaaaagaacaactttccctgtaaaattgatattcccttaatgagcatttagtgtttataatatggatgcatcatagtttatagcagttctgtgttattaatggatattgtcaatttttctcttaaagcagtactgtgatgaactcgtttggacattgaattgcattgaattgttctattattttattatttccttaggataaattctttttttttttttttttgagacagagtctcactttgtcgcccaggctggagtgcggtggtgcgatctaggctcactgcagcctctgcctcccgggttcaagcgattctcctgcctcagcctcctgagtagctgggcgtacaggcgcatgccaccacgcccggctaattttttgtatttttagtagagacagggtttcaccatgttgaccaggatggcctcgatctcctgacctcatgatccacctgcctccgcctcccaaagtgctgggattacaggcctgagccactgcacctggcccaggataaattcttaaaagtgggtttattacctgggcgtggtggctcatgcatgtaatcccagcactttgggaggccaaggcgggtggatcacctgaggtcagcagttcaagaccaggctggccaacatggtaaaaccccgtctctactaaaaatacaaaaatcagtcgggtgtggtggcgggcctctgtaattccagctacttggaaggctgaggcacagagaatcacttgaacccaggaggcagaggttgcagtgagccgagattaagctgctgcactctagcctgggccacagagtgagactcagtctcaaaagaaaaaaaaaagtgggattattaggtcaaacggtacgtgtgttttaaatttagatatactcaagatgccctttagataggatgtctatttcaaattcccatcaacagtgtattagtattcaattccatatattcttgctagtgatttgtcatctttagcttgttgggagtttaaagtagtttgaaacagttttctgtttctttttcagcatcaggacttacttccatagcttaactcttcggagggagctgataaaaatgaaagatcagtgacaagggagtggtgtagaccagtggtcttcaaactttttggttgcttaccccatcactaaaaaattttgagcattaagcaggtgcggtacatggttctgtggtcccatctacttagttggctgaggcaggagaatgtttgaggccaggagttcaaggctaaagttcactgtgattgtgcttatgaatatagccgctgtactctagcctggacaacatagcgagaccatctctttagaaaaaaaaaaaagatgagatgggaagaatgaagtcagaaaaaaaaaattgataggacttcgtgttgttgctttgagaaaagagaaaaagaaaaaaattgagcatcaattcttaatccttagatatttgatttacaaataatatatgtatagtaactgattattgtggactttataaaatacgaacaaaaaatcaacaaggatgataattaaaaataaagttcagatattttccttttttaccctggggtgtcttggttactcctggaggtatgcgtgtgcgtgtgtgtatgtatgtatgtgtgtgtgtgtatatatttaatatatatgtgtatacattgtatatgtgtatacataatatataatatatatgtgtatatataacatatatatatgtgtatgtataatatgtatatattttttagacaagagtctttttctgttaccgaggctggtgtgcagtggtgcgatcttggctcactgcaacctctgcctcctgggttgaagtgattcttgcgcctcagccacttgagtagttgggattacaggtgtgtgccaccatgcctggctaatttttgtattttttactagagacgggattttgccatgttggccaggctgatctggaactcctggcttcaagtgaattgcctgccttggcctcccaaagtgctggtattacaggtgtgagccaccgtgcatatgttatacttgctttggatactactgctttagactcttaaggtttaatattgagcatttatagatgcttgtttttgggcatttcactagttttgctggtccagtttagttggatcatgaatacctttaaaatgtcccatgctaggctgggcgcggtggctcaggcctgtaatcctagcactttgggaggccaaggcagacggatcatgaggtcaggagatcgagaccatcctggctaacaccgtgaaacccgcctctactaaaaatacaaaaaattagcccagcgtggtggcacgcgcctgtagttccagctacttgggaggctgaggaaggataatctcttgaacccaggaggcggaggttgcagtgagctgagattgtgccactgcactgcagcctgggtgacagagcgagactccatctcaaaaaaaaaaaaatgtcccatgctcttgagagtcgtatctgcaataagggtaaaaataaatttaaaacatcagttcaatactttttgcattgttgaggtggctgaatttgaaaaggacaaatagtaggataagaagcaatgtaagtactctatttcttctagatatgaagaattaatattttgtagaacatattttaaaaaattatgttttttggaaagccgtttggctgtaatatgtatctccctgttttttaagagttaggtcctagagactgagtgaaggtatgaataattgctacttgctctcctttgctttcaaagtaccacaattaacctgtcactaactctgtttggattagcctgagcctataacaaactttccatgatgattcttagattaaaagataatttttttcttgagttagaataagttgcttttgatctgtggctgcctgccccccaacccctataaattatgacatcaggaaacaaggctttttgtattagaaaaaaatggggaaattaatttcagttatttcatgtgggtcattggcagagaaagataatactaaaatcttagagactgtgaaaagagattatattaagcaacttgagtgattacttttttgccagttaaaagaaatgagataatttatattgaagatgattgctatatacagtgctttgcacaaaaggccacatatctctttttaccttaggtaacatgatgtataagctactttcacatatatcttcttaggtcatcacaaggatttgagatcatcatttaatcaggactgttgtgacttgcttgagaccacatgcctagtgtttgacatcatatttcaagaggtagactgaaagttctgcagaaatagggactggtggctgttctctcccttactccctagcagttaatacattgcctggtacagagtaagctgtcaatatttgtggactatttaaactcctgcatatttatttacacatgtaaataagttatagcattgtaaaaccaacaggtatattttccgtagtgagattgttccttcatcttatgtgcacagaaaatattttcgtggaagaggtcttgaattttagatcaacctttcacatatccctttactttctcttaagatactttcatggtgacaaaaaaaatactcttaatgtcattcctttcactgtgtgtgtaactcctgtggcaagactgtatatttgtatgtatgtatttgtttatttagtaggctgctatttataaaggaaacatactcattagttggtctttgcgtacataatggttcccaaaacatggactccatggtttgctgtgagtgaatgaaaaagagcaggtatgattcccctcacctttgtcattctctccagtttcttgtacatatggttgacttactcagcagtaagtgtaactttacaatgaagaaaattagtcttccaaagaactagtatgctacttcccgcttgttctgcagtatttaaaatcctgtttggtaaatgaactaagacacttatatatagaagagaccctggatggccatgaatggaaatattagtagtgattaatttctgtcttggtgggataatgtggcttttttgcttcttattcttttagagtttcccatttttctacaacgagcatgtattacttttatacgtaggaaaaactgctattttattttattttttattttttaagacggagtctcactctgtcacccaggctggagtgcagtggcgtgatctcagctcactgcaacctccacctcttgggttcaagccattctcgtgtctcagcctcccaagtagctgagactacaggcagaagccaccacagccagctgattttttgtattttttagagatgggatttcgccatgttggccaggctggtcttgaactcctgaccgcaggtgacccgcccatcttgaccttccaaagtgctgggattacaggtgtgagccaccacgctcagccaaaaactgctattttaaagtctttatttttcactggatgtcttctgaaggtttatgtcgcactcaccattgagaaagtgggtggttaactggctccagttcctaagaggagtggcagcggtaggaagtagtatgggaggagtggggcaggtaagctgatttgaactttatcattgtgaactccactatgactaaagacattctgggatttgatcacaattaaacccaagaggactgagccatctagtttttttcttcttaataagctgattgagaattataaaagacaccttaagaaaaatcagtttctatgcactctgtaaacacagaactcagcccgaactcccaagttctgtatccgtgtgtgtgtgtgtgtgtgtgtgtgtgtgtgtgttgtggtatgttttaaatatcaaatggagttgtggcaactcagatgggatatggtttatattaatacatctaatatgaattggaagatgcttaggcaaacgatttttattatgacagtataggcttattggagttttggtgttaatatacagctgggagttgagccgttctaagtttatatagccatctggtgatattttaggaagagctgtgtcacatatcctctagagtttaagtgattagagcttgttggcttttgctgttagtttactgcacacttgtagtgttttaaatgcttctgtgaatggataacataattcaaaaaggttagatttctgggttaagacatttgttattatcggcccttactttattcttttaaagagtaagattaggctggatgcagtggctcgtgcctataataccagcactttgggaggccaaggtgggcaggtgaggtcaggagtttgagaccagcctggctaacatggcaaaaccccatctctactaaaaatacaaaaattaacggggcgcggtggtgggcatctgtaatcccagctactcaggaggctgaggcaggagaatcacttgaacctgggaggtggaggttgcagtgagctgagatcgtgccactgcactccagcctggttgacagagggagactccatctcaaaaaaaaaagttgaagagcagttgaaataataaatgtaggtactgttaggtgggtgcaaaattaattgtggttttggattgtgaattttaaatcattgtaactaggcccaaacagatcttcatttatcaaaataggaactgttacaatcaacacatttttaccgatgagaaataagtttgtttatacctgtagtataaaaatccatgctttgagattcgatgaactcttggaaagcattttctgcatcctgctggttgtggaagcattttccctgcaaaaaattttctagatgtttggaaaagtggtagtcggttggcgagtggttagttgaatatggtggatgaggcaaaacttcgtagcccaattcaacttttgaaatgttggttgtgcaacgtgttgtcgggtggttgtggagaagaattggaccctttctgtggaccagtgctggctgcaggcattgcagttttcagtgcatctcatcgatttgctgagcatacttctcagatgtattggttttactgggattcagaaagctgtagtggatcagaccaggagcagaccgccaaacagtgaccatgaccactttttggtgcaagttcggctttgggaagtgctttggagtgtcttctcggtccagccacttagctggtcatcactgttgttgtataaaatccactttttgtcgcacatcacaatccaaccaagaaatggttcgtcgtcgttacgtagaataagagaagacaacatttcaaatcgacaatttttaaaattttcggtcagctcatgaggcacccacttatcaagctttttcaccttttggctgggcgtggtagcccacgcctgtattcccagcactttgggaggcggaggtgggcagatcacttgaggccaggagttcaagaccagcctggccaacgtggtgaaaccccatgtctactaaaaatacaaaaattagttgggcatggtggcgggcatgtgtaatcccagcaactagggaggctgaggcacgagaatcgcttgaacacaggaagtagaggttgcagtgagcccagatcacaccactgcactccagcctaggtgatagagtgagactccatctcaaaaacaaacaaacaaaaaaaactttttcacctttccagttggcttcaattgcctgccaaacaagggtagaatggtcgacattgagttcttcggcaatttctcgtgtagttgtaagaggatcagcttcgatgattgctctcagttggtcattgccaacttctggccggccactacactcctcatcttcaaggctctcgtctcctttgcaacacttcttgaaccaccactgcacagtttctgggccagatgtgtagttgatgttgtgagttgtctccactgcttcacgacccattttgaactcaagaaaatcacttgaatttgctttttgtctaacataatttccatagtctaaaaaaaaagcaaaaaatacgttattagcaagaaaaggcaagaaatgtgcattaaaatgatgtataacataaccatttatttaagagtgtattccagtattaaatggcaaatttcaacagtgcaaaaactgcaattacatttgcaccaaactaataatataatttttttttagttaaaaattttatagtacagaataacaggcttgtctcacacacacacacacacacacacacacacacacatacacacacacaaatcccatatagaatctacaaagcctgtctgtctctgaattccacaaccttggcttatttttttaaagtaaaatttaaatatttaaaaaatttagaaaaatatggagaataagttaacaaacaccatgtactaattcagtagattttttttctttttctttttcttttttttcttttttttttgagttggagtctcgctctgtcgccaggctggagtgcagtggtggaattggctcactgtaacctctgcctcctgggttcaagcgattctctacctcagcttcccgagtagctgggactacaggtgcacgccaccatgcccagctaatttttgtatttttagtagagacagggtttcaccatgttggccaggatggtcttgatctcttgaccttgtgattggcctgccttggcctcccaaagtgctgggattacaggcgtaagccaccatgtccagcccattcagtagatttaatagatgctgacatcttgtcagatttgcttcaaaggtgtatttaagtatgtttttatttatttatttatttatttatttttgagacgggctctcactctgttgcccatactgatgtgcagtggcgcaatctctgctcactgcaccctccatctcccaggttcaagtgattcttgtgcctcggccttttgagtagctgggattacaggagctcgtcaccatgcccggctaattttcttatttttagtagagacagggtttcactatgttggccaggctggttttgaactggcctcaagtgatctgcccatcttggccccccaaagggctgggattacaggggtgagccactgtgcctggcctgtatttgcttttaaaaattaaaatatgcatacggttggagtcccttttgtcatcctcttagatcgtattttcgtatgcagaagttatttatctttttagctcatgcacttatattcttcctacaaatatctatatatattttatgtagtattgggtttcaaatttatgtgatattttagtacatactttctataatttgaaaaatgacatgttgatatatgtgtattattattattattttttgaaacacaatcttgctctgtcacccaggctgtagtacagaggcacaatcttggctcactgcaacttccgtctcccaggttcaagtgattctcgagcctcagcctctcgagtagctgggattacaagtgtgagccactgcacttgccttacttcattaattttaatagctgtatagtattcagtcatatgaatgaatagtacacaattttagtcctttattgatagttgttttcaacaaatatacaaaggtaaactttttcctcaaattgggtcaagctatatatattgttctaaattagctctttttctcccaataataatagtgtgcaggtttgttacatgggtatattgcatgaggtttggggtacaattgatcacatcacccaggtggtaagcatagcacccactagatagttataagttttttgagacagggtaggtctctgtccctcaggctggagtgcaatgttgcgatcactggtcacggcagttttgaccgctcgggctcagtccatcctcccagcttagcctcctgggtagccgagactacagtgttgggccaccattccctgctaatttttgtattttttgtagagactgggttttgtcctgttacccaggctgcctcgaactcctggactcaagcagtccacccacctcagcctcccaaagtgctggtattataggcgtgagccaccgtacccagctcctagtaggtagttttgaaccttcacgccttcccatcctctcctctctgttagttccctgaatcccatgtttacttccatgtttacccaatgtttagtttagaatgatgatctccagctgcatcatgttgctgcaaaggacatgattttattcttttttatggctgcagcgaacctttgggtaaagaaaatttacaaaaatttctcacatctttttttttttttttaatgaaagtaagtagtagtaatccatagttcagatctactttataagtgagtcactgataaagacagtagttacacattttataacattaccttgatgggacaaatttttcttgttttgtttttgttttacttgagttaatttggatgagactttcttgaattacttacatttatagcatttacctccagtggggttgagatgaggagccttcaatccaacaaagttgtatacatgcattcatggagatgacacttaggctatttaatcaggaaacactcatacttgtccacatgtagatagtcctattctttggaaattttgctatgttgcccctgctggtcttgaactcctgagctccagtgatcctcccaccttggcctcccagagtgctgggattatagacgtgagccattgtgcccagccagaaatatgattttaattccatagtatatagtatatgttattgtgagtagaatatgtttattctgtaagtagcaaattgactccttcaacagttttaatagttttctagttgttttgtctttagtttcccaggcaaataatgctgttgtcttcaatcacagtattgattagttcatcccattcttcatattgatcattgtttttggatattaaataatactactgtaataattaagaaagatggaaagcctcaccaatttgcatgtcattcttgtgcagggaccacgctaatcttctctgtattgttccaattttagtatatgtgctgctgaagcgagcactccatttctgtaaagcttaaaaaatggacaaaactaacagatgggaatggaaatcagaataatggttatctttggtggtgaggacaggggagattgtaggtatgctgctaatgttctgtgtcttgatctggatcttgatttcatggttgtgttcagtttatgagaatcatcgagtagtagacttaggaaaggtgcacttctttgtatgtatattatacctcagttaaaaacttttgcctcgcaaaattttaaagaacgtaatctgctgagttcgtcgtcttttagcttttgatgtaacttttccactacttctcttcatatgtgaatacacttaatgataagccatttaacctttttattatgatataaaacaaacatacagaagagtgcacaaatcaaatgtatagcttaatgaaattttaaaattattaaattggaggttttttggggtacattatacctgtgtctttgttaggagggaaggagttgatggagggctaaaaattctggagaggacaaagttttaaggaatctcagaacaccaaaacctcatcttggctctgccttcacattattgtttctttgggtaagtcatttaacttatttagacttcacttttttttgtataagtggtataatacttaacgtttcttttgcaaactgaattaggtaggtgaaattcacgtaaaataataggaatatagagtactgttgctaaataggtctttatttaggccattgaatttaggccacttaccttacagagcagaattgtgggatacaaagactacacagctggtgattattgatatcattcatttatattaggttagtattgaggcttagttaactatgccaggcactaccctgtgatttattataatacatgtattaactcatttaatagtctaggattattcccagaggtaggtaaaattatcccaattttactgatgagacaattgaggcaaaattaagttaaataatttgcctaggtgggttgagttcttgagcctgtgctttaaaaaaaattttttttgagaaagggtctcactctgtcacccagggtggagtgagtggcgtgatcttggctcactgcagcctctgccttcaaggctcaagtcatactcctgcctcatccccctaagtagctgggactacaggtgtgtgccaccacacctggctaatttttttgtgtattttatagagatggggttttgccactggactcaagtggtttgccttggcctcccaaaatgctgggattacaggtgtgagccactgcgtccggcctaagcctgtgctctttttttgttatactgcctagttatgtgaaaatacgtaaagacttttaggcaaatgttaagattttataataatctgttagagagtttttgaagtaaaaattttggtattttgaaccaaaattaggagaagagtctcatttgttttgaccatgatgattctggaaaagattgatgttaatatttattacttgggctttattcccttaattttctcctaaaatgactaggatgtaagcactaggtagttttctttaagaatatatatatatattttaatattaaaggattttgtgactaatttacaaatattgtttaatttttaggcgaaatgttaatggaagggagttttcaaacttggaggcagatgagaccaaagtttagtgttcttgcttcggtggtttaagcagcatctatttggtcttggtattagagcaataattaagactctatcatatgtatggttgaaaattatttttattaaggtatgtttgagtatggttctgtgaggttgggaaacacatgtagttttgcaagcaccatgatcaagatacagagtagttcctcaaaaaatttcctcatgaccctttctatagtcagcccatttcctcacctctagtctctggcaaccactgatctgttttttctctgttgtattgtctttttttcagaatttccatgtaaacaaaatcatgcagtatttagcctttttgttttaatttttgtttgtttgatagaaatgggaggtcttgttatattgcctatgctggccgcaagctcctggtctcaagggatcctcctgcttgactcagtatgtgacttcttgagactgacatcttttatttaacctaatgtattttgagattcatccatgtttttatgtatcagtaattactttctgttgtttaggagcattccattgtatggatgtacaacaacttgtgtgttcattccccagttcatttgggttgtttccagtttttggtaattacaaataaaagtgccataaaagcattgatgcatgcatacatacacatgtgcccatgtattttttttatggtttaaaaaaatatggtgcctagaacttttataactttattagagaacctgaaaaagctggtgattttcacagaacattataaattgcttggtaaactaccctaaaaaagcccactctggaatgagaagaatctgtttgtataaataatcttataatataaactgtaagtcattagaatttttttaaattaaagaagtacacacacatacttgttaaatgggtaaatttatatataaaactccttagtgcataatttcatattttatgtttttagtagcttttaaattgtcaatcattgacttttttgttcctctaagtagtagaatggttatataattggttatgaaagtttttttttttttttttttgagacggagtctcgctctgtcgcccaggctggagtgcagtggcgcgatctcctgtctcagcctcctgagtacctgggactacaggcgcccaccaccacgcctggctaatttttttgtatttttagtagagatggggtttcacgatattggccaggctggtcttgaactcctgaccttgtgatccgcctgtcttggcctcccaaagtgctgggattacaggcgtgagtcaccgtgcctggctggttatgaaagtttataagtaaaaaataactgggaaaaattttagcactacagaattcctttttcttctcctctcctcccctctcctcccccaagatggctggaggtattaatattgataagcagagtttcatgtgaataagacataaaacttaggttgattacctatgttaataaattatcttctttgttcctatgtagtgagctttctttttgcagcaatctgaggccaagagaaatagatgagacctttttaccttagaaaagagattgcaggctggatgtggtggctcacgcctggaatcctagcactttgggaggccgaggagggcagatcacttgaggtcaggagttcgaggccaccgcctaggcaacatggtgaaatcttgtctctactaaaaacacaaaaattatctgggcgtaatggcatgtgccttgtaatcccagctacttggagggtgaggcatgagaatcacttgaacccaggaggcggaggctgtagtgagccaagattgtgccagtccactccagcttgggtgacagaatgagactccatctcaaaaaaataaaataaaaataaaaaagaaaagagtttgcaggccatttttgcaagttaattttttgaggttccagttccaaccctgagtcagactacagaggccataggtggtttgacgtttcagagaatagcagtgtttttgattttctttttttctttttctttcttttttttttttttttttgagacagggtcttactgtcatccaggctggagtgcagtggtgcagtcatggctcactgcagcctcaacctcctgggctcaggtgatcctcccaacttagcctcccgggtgctgggactgtaggaacatgccaacatgcctggctaatttttgtggttttttttgcatgtacgtagagatggggttgcgtcatgttgcccatcttgaattcctgggctcgagagatccgcctgcctcagcctcccaatgtgctgggatcacaggtgtgagccaccttgcccagccatttcttttgtgtagtatggaatcttagtttaagccctcagtttaaatgtattatataattgaggtgctaggtgtacagaggtactagaactacagagcttttctcattaatgtatgttccttctgatgttgaatatttagaaaactgaatattgtgtttggagccaagggatattacacttgaaatatggtcatttggtgaacaggtatctcatttgtaggctatcattatttttggtgaacaggtatctcatatgtaggctatcattaattttggcagtttcacattaaaatacctgcctggaaatacctgcccagttttgccagtaatgggaattgcaggttaaccgttggtcttctatatgtggctctatgatgtggacaagacttatagctctttactttaactgagacaacaatgttggtgatccaagtctagaattccaggatagggttgccaaaattaacaccgtgggagtatggaggtagcaactgtgggattagtaatacaaatacaattttaattagctttatcagttgcacacttaatcttcattgctaccttgtgaagtaggcacggcaggctgtatattgttacttctactttacaagtaagtaaattgtgtttcatagctgtcaggacttacctgaggttgcactgctagtgagtagctgaaatagtacttgagtccagacatcaggttggatgctgtttccacttttgcagttcactgtcgtgaataagagctcaggcttgggtttgaattgtggttctaccacttacctgtctgtgatcttggggaagttctttaacttctctgagtctcaggtttaaaatggggctaacaataatacctcttagggctcttgtgagatttcagcaagtgcttataatattagataaccaatagtaagcactcagtatttgctaattgtggttgtttctactgttattaaagtgataacaacactacagttacacatcctctttcccctaaggatctgtgttaagagttgaaagacaataaatgtaagaagcaaaaatattcaaagatgatagaataagtagcaaggggagttgattttagcaggaagatggacaatgttcagaggggtatgtgtgtgtgttgtgtgtgtgtgtgtgtgtgtcttggttttaaacatggtagcagttagacaatgaagttacaagtgtgttagacagttggagctttaggacagggttgagtaggaggaccagtgttggaggaaaactttttaatcaccatcacagatggcatatggaaatttacatttctaccaagatttaaacataccaatttgctatcctctgttatggttcttagagctattgttacatcagaatggagtaagaagcttatcatacatttttcatttttagtggttatacagagaacaatacagaaagtcagcatatatcctactacagtttatccttggtatacttgggggatgggttccaggacccccacatacaccaacatctgggcatacttaagtcccccagatgcccctgtggaacctgcctatatgaaaagctagcccttggcctgctgtatatataggtttcacatcccgagaatactttttccatccacatttggttaaaagaaatccgcacatgagtggacctgtgcagttcaaacccctgttgttcgaaggacaactgtgtaaataaaagggtggtccctctccttaaaatttcatagttgatacttgtatcatagttgatatatagtagttgatactatgaaaatttcatagttgataaagtttcatagttgagcccttttaccatgtgtgtaagtcttaagggctagggaattcagaagtataagttacagggttgtatcttttggtgcttgagtcctttcctttggataaggtacttccttgatgtaaggtaatgttctttcaagcattttaaattaaatgaagttgtttgaatttacttgttggggaatatcttgcctttaatataatagctgctatgtggaattatgtattttatgtattcggtgtttttgaacttgcatcttttattactgtatttttacagctttccccatttttgatattaaaacaattttatggggttttggtgcatattttaaatttgtgcactaaacacttgcaaaagcatattttaaattatggcaagtttcctaaacctgttaaccttttatatattagctgttacatattaacttttttcaaagtcattatatatccttctactgacaaatgtcaaacaagttctgagcatctgaaagtctagattcatccagagtttgctcaggatggcattttttttgtttttcttttgaggtggggttctcattgtgttttctacgctggcctttaactccttggatcaagcagtcctcctgtgtcagcctgccaggtaaccgggactaggtgtgtaccactgtgccaggcttgttttcaaagttcataggaaaaactttggtgtcttctaaagagaccagtactgtacacaaatatatttgtctcacatttatccatccatccgtctgtctgtctgtctgtctgtctgtctgtctgtctgtctgtctatctatctatctatctatctatctatctatctatctatctatctgtctatctatctatctatgacggagtcttgctttgttgcccaggctggagtgcagtggtgcgatcttggctcactgcaatctcctcccgggttcaagcaattctcctgcctcagcctccctagtagctgggattacaggcgtgtgccaccatacctggctaattttttttttttgtatttttaatagagacggagtttcaccatgttggccaggctggtctccaactcctgacctcaagtgttccatctccctcggcctcccgaagtgctgggattatagggatgaaccaccgtgcctggcctgtctcactttttataccccgaaagcattattactatccattactttattcagagctaggagctttttcattcctgtactgtggaactacttgagttgccctatatctactccccctttccccattctgaacattgtttcaccttataaaaattaaaaatttggctggtgtggtggctcatgcctgtatcccagcactttgggagacagaggcagatggatcacttgaggccaggagttcgagaccagcctggccaacatggtgaaaccccgtctctactaaaaacacaaaaattagccgggcatggtggcgtgcatctgtaatcccagctactcgggaggccgaggcaggagaattgcttaaaccaggagacggaggttgcagtgagctgagattgcgccactgcactccagcccaggtgacagagtgagactcggtctcaaacaaacaaaatccaaaaacatcctaaaaattacaaaatttggccaggcgtgatgggtcacacctgtaatcccagcactttgggaggccaaggcgggtggatcacgaggtcaggagatcgagaccatcctggctaacagaatgaaaccccgtccctactaaaaaaatacaaaaaattagccgggcgtcgtcgtgggcgcctgtagtcccagctacttgggaggctgaggcaggagaatggtgtgaacccgggaggcagagcttgcagtgagccgagatagcaccactgcactccagctgggtgacagagcaagactctgtcttaaaaaaaaaaattacaaacttttttattgatgggttcctctaaaacccattactaaagctacttactaaagagtagatgttttcccccttcaccgatagttgatggaccgtcagagaatccttgagtatctcaagcttttacttaacttcagagttcttacctgagacagaaaagttgagttttctttcctcaagggcataaaaaattttaaatgtacccatttgcataaaatctactcaaagaaaattatcaagtgattttacaggatatttttggatgcttgcacataagagaatcttttaacaaaactgcttaacctcctttgtattattcattccctctcttactaaaacaagtgaatggcttgcttggatgtgtatctgtatctttttttttgatacacactttgaaggagtcttctgaaatgcagtgttttggccaccattccagctctacaggaatatggtttcatgataaagccaacaaagagcacactggcagcagtccagcagctgactcaccaaggagtaatgatagacactttgaaaggagtgacctgtctcaggatctcacatttcaaagcttcgtgctatgattacattggtagaaggcagccaagaaatctagatgagatcttgcttgtacctcctaagagtaatggtatataggtaggaaggacttccacagtcggatgcaagtaagattttttttcctaacaaccttgtaaaacctgggggtgggaaacaagttgaggattcagaatgggagtaaccgtggtggaagctttccttctacggacctggatgagaacagccttatagtgactgagggtaactcaagaagctcaatgccatattagttttctagagctaagggaatatacatagtttagtagtaagcacaagtatcgtgttcatgtcagacactgtagctactgcttcctgctagaacagaccagaagaaaccaaagcaagaccagaatcatttcagttttgaggaacagaccctttccttactagcattgcacactttaggagtaaaaatagaatgaaagtggatttgcttcagtactctgaaatagttaactgttgattgttttggtggattagagtgattgcagctctgtttctaaattgaatttcatggctatacgttgttctaggtggcaaattaatcttttatcagtaccacaaattgattgttggccctttgcggaaatagcaggaatatgtctttttcattttgttgaagggtagctcagagataaaacatttacataatctgaaaatatttttcagagataagactaagtgactgtgtataccacagtgatagattgatccactttgattattgtagaactttctatttctcagtaaaaagtgctaaacatggtaaaattatgaaggattgcttttagctatttgctgtattctttaaagcatatttaggaataaaaagttaatttccaaagtgctgtcatttatttaatacatgttttctccagaatgtgcttcccaaaagttaagagtgcttttatttatttaagaaatatgttaatttttcttttcttttcttttctttttttttttttgagacaaattctcactctgttgcccaggctggagtgcagtggcacagtctactgcagcctcgaccttccaggctcccacgaccttcccaggcccaagccatcctcccaatttagcctccaccatgctcagctgagtttttatttcttgtagagactgagtattgccgtattgcccagactagtctcaaactcctgggcttactgtgcctggcccacaagaaatatgttactttttttgagatttttgtataatttgagaacacagattatttgccctactcccccaacccccagtgatacagacctggtttcattgcactgagagaaaaaaattagtttcttaatttacgttgcgtttctgcctttttgagattgagtgctttgacttttctcttgtttttgtatttgctgtatatgtgttgttcctacttaatttcttatatggtttaaacttgcatctgtaaattatttattagctagctttatgacttgggcaagttaccttatctctctgctccttagtttccctctttataaaatgaggataataatattacctactttgtagagttgagtaagattaatgactaataaatggtgaagcacttaaaagagggctctatacatgttggctgttaaaattataagcgaggacctggacttctcccctccattaattgtaactcttcatttttataattttttcataaatagtatgtctctcagcatataacagaactttgtattaaggaataataaatatcaccatatatgtaattctttattataaacataaatttgcttcttgttaaaaacagagtatcattttcttgcctcagatcgagcttgaaagaaattagtagaaagtgggcccttttggccgggtgcggtggctcacgcctgtaatcccagcactttgggaggccgaggcgggcggatcatgagatgaggagaccgagaccatcctggctaacacggtgaaaccccgtctctactaaaaaatacaaaaaaattagccgggcatggtggtgggtgcctgtagtccccactactcgctactcgggaggctgaggcaggagaatggcgtgaacccaggaggcggagcttgcagtgagccgagattgtgccactgcactccagcctgggtgacagaacgagactccatctcaaaaaaaaaaaagaaagtgggcccttttctgtgttttataggtacccacacaccactgaatgtaggtcatcgtttaaaatctgagtgtacatccaaatccagtgcagttatgtagaacaaaacagtttgtatggaactagaagtgttactggaaaggtaaatactgtagttggtagtaaactgatcagttaaagtgatggatcagcaaagatttgggggttgctggtttttatttaacactcagttgtttcagagtgattactcctgaaacaaagttatttcgaacatagatgtgttaagaaatttcatattcctttccacttaaacctcttgagaaaggaagcatttcttcagggagagttagctatgtgagtgctacatgaattttagtcattactgtggcgactatatgataaccaaaagtaggagtctcacactttagtttcaaatttgtgctgttattgagtaaatttttaaaatgagattgccctctttcttgctaaactgtcatatatataagcccattaaattgacttttatgcctcttttccttttttttttttttaacctgttaagactttttttttctttctcatatttacccctgcctaagcaaggcctcaactctccacggaaatctttagtaaaaggcaaaaagatttattcattatgaagagaaaccagagcatgtgtgacaggactttctgtaattataagttagtggttcagtgccaggggttagattttcttaacttttatgtttagtaggattattgataattcctaagttgtatccttaaatcatattttttgaacattagggatctgcgtccaacacttaattatactagtaaaaggaatagaacatgcactggatttcttgtttttgagattctttcattcctgccctaccccaggcaggaggtctgtctgcagtggaagagaatgaaaccagaatgaggccaaacaagtaaagaggagcatgagatagagatggatcccatggcactgtgcctttgaggccctggtcctgaagtttttttccttgtttctacgcagcatctcattatcctgtgagccattaaattctgatttttgggctgggtgtggtggctcgcacctgtaatcacagcactttgggaggctgaggcaagacgattgcttgagcccaggagttggagaccagcctgggcaacgtagggagacttgtctctacaaaaaataaaaaaattagccaggtgtggtagcacacgcctgtggtcccaactacttgggatgctgacatgggagggtcccttgagtctggaaggtcaaggttgcagtgagccatgatcacgatactgcagtccagcctgggtgacagagtgagactgtgtctcaaaaaatttttttttaattttgtgtaaaatagcttgatttgggtttttttttttttacttacaactgagaattttgaccagtatatttaatgttagtctgaccatttctccagtgggctttctacgtatttaaaaaatagtttggactttaatctcagggtaaacaatatatataggtacactcagtttatatatgagataatattcaggatcagtggagtgaaaatagtaaagtatcttccatttttcaatggcttagagggaaaagtgttcataatgggtatagaattaatcagtattcctttcccattatttatgcctatacagtgtagaagtttcccttaaagagcttatcaccataataagtacaatagcaaagatataaagtcagtacttttcactgattaggcataaatatcctctttattgttttcttacaaagtagctatgataaacatataaaagggtcagaaagagaggggagaaaaactcggtgaaaagtcagacaagaggaaatgaagaggtgaggtatgtatagtaagcattagtgaacttgtagtaattgctttaggtttcatggattgcccacttgtggattaaatgttagacttctgcaaaatgagttgatggtagagatgaagaaaagtcttaatttgttttttttatgctaaggttaaagttgatgtggctaattaggtattaagatcagttttcctgtctttttattatttatttatgtttatgaatgaatgaatgaagaaatgaatgacaaagtctcgctttgtcacccaggctggagtgcagtggcatgatcatagcacactgctgcctcaaactcctgggctcaaaggatcctcctgcctcccaagtagctgggattacaggtgtgcgctaccatgcctggctaattttaaaatttttagtagagatgggttctcgctatgttgcccaggcttatctagaactcaagcgatcctcctgtgtcagcctcccaaagtgctaggaggattgcaggcatgggccaccaaacctggccttgtcttgctttttaataagctgttgtcattatgttgcctttcaaagtccagttcttctttaccaccccatttgcctggaggtaatgcattaggtgagaatgaaaggtgagtacctaaaagattcagaattggaaggccttaataggatcaatgtgtaggagctgcagagaatatgaaggacttttaaatattccagtcccaaaataaacttgaccattggccaagattgtggtaagctaagtatttgagatgtctgtgctacatcatccaactcttggcctgaactgttttagctggcttgcctatgtaaattgaaacttcctttaatacttaactgtgagttaaacatagttctggagctccatcgaaagggtcttagtcagccaggcacagtggcttacacctgtaatcccagcattctgggaagccgaggcgagagaatcacttgtgaggcctggagtttgagaccagcctgggcaacattgcaagaccccctctacaaaataataataataattattatccagctgtggtggtgctcacctatagtcccagctactcaggaagctgaggtaggagagttgcttgagcccaggacatcaagacagcagtgagccatgattgcaccactgcactctagcctgggtaacagcgagactcccatctcaaaacaaaaacagaaacaaagggtcttagttatacagatcttcttaatcattcctaaagcgtacattccaagtttatatttacagtaaagtgatctatatcccaaaacatgtttccactggttactaatttggggcaagtcattaacttctcagagccttctgtaactaagatt
